United States Patent 10,240,205 (METHODS FOR ASSESSING RISK OF DEVELOPING A VIRAL DISEASE USING A GENETIC TEST) - sequence listing, part 17

SEQ ID NO: 1831 - DNA, 157663 bp, Homo sapiens
ccatccataaacatatgtctttattctctttctgtacatatgggcaatgataaagcttaaagatgcatgtcctaagaaatatgcaaaaacaatgaatttacataaataatttatacttcagaaaattaaagttgaaaaatattttccacattattagagttcacagtatttaaatcaagctttcccacttatactccagactatattgtcttagcagagagtgataaaatctaatcaggaataaaatgatcaagtttctgtttttattcagtgcacgagtagacgctatttcagtatcaggccgcgccaagtgtcgaggctgcagcctctcatcctgacccttcccctcctgagtggctgtgacccagcagaggtcactggcgtggaatggttacagcgtcaccaaaccactccacggtggacacattcaaccgagcggtaacatctggtggtctgatgcctcatttccaagtaatactttttatagccctgaaaatggaaaccttggcatctaaacaaacagagctgaacatgtgaacactaggacaaggcactgtactatggggtttggtttctttatgggaaaggtgtttgcatagattgctagctatttagtgtgcaggaaaacagagcccccagcgtgcatggctttgtgaggggtgaagctgcatggtgctccctcagccccaagagagcgcagtctctcattctccagccccagccttgtgggctgtcccgctggtgctgtcctttagaacccctacaggagagttttttgctcaaaaagctgcaggtcaaaacggacccagacctccccggtggggacctcatgcagcagcagtcggcgggtcatagggcctttgctttcctgttctgttcgaatttttgccactggaatttcagtacgacccaggaaatctggtgaataaacacaggagagtcagaagtctttcttctttataaaatcattaaagagctacatccggaagaagtggattcataaaaccttcaaatctgaaacaaggaacttcttttggctcatggctgttgaatgtcgtgagtgggtgtgtggggaatgatggcaggtttgtgtgtgagaagctgccacatggaattcaaatctccattctgagaatgctccaggagtggtgttcacgtcgtgtgtgtagggagtgatgggtcaaagacctgaaacacatctcaggccacctcctcccctgaggaaggccacccacctgctgccaaagcgagatgacacaggcctgtgtcacttccctgaagtggcatggggtctgcacacagctgaagcccctagatctggactccaggatctaggaaactgggaaagcctttagatcccctggctgagcgacacttaccatctggtgaaaactggtctctgtcaaacagggtgagacacagcacgtcttggtagagatccttaataaagaactggcagttaaaattccacttgggattgagtgtgtcctggatggtcctggtggtgtagctctgggagcccatgctgatttcacagtatgggttgctctttcctgaacaaaaacaaaccacagacacatgtggtgcatgcaggtaaaacgaagcgactgacagtgccctccctgagcagaagcaggattccaataatgggtcactcgagaccatggcagcaggagccgctgcctggggcaccatatccctgtggtctagtaacagggtctccaagttcccagtgctgacagcagcattaactggggagtggccgagagctccaccgccaggaccactccgcacggaacaatcctgggtgagtgtcactgcaacctgctgcatgcttcctcggcgcagacacactcgggaaggcgggcactggcacttactgggaaaacagtgataagaatattggtccaatatgcgcattttagtggcactggacacactgttagaaagcattcctttattcagtgttcagaagagtcatcagtggctgggcgcagtggcactttgtcagtgacaaagtgctgtaatcccagcactttgggaggccgaggcgggcagatcacttgaggtcaggagttcgagaccagcctggccaacatggtgaaaccctgtgtctactaaaaatacaagaatttgccaggcgtggtggtgcacacctgtaatcccagctactcaggaggctaagccttgagaatcacttgtaccccagaggcagaggttgcagtgagccaagatcgtgccactgcactccagcctaggttatacactgagactctgtctcaaaaagtcatcagcaaaaactggggcagggcagttatgtctgctgaatgaatcaaggcagtatttaccatttggtttgcaggcttttaattctgtagcttcaatgacatgcaccatcaggcgcccaatgcctgaagtcttttgggagcgggctacaaaagaggaagacaagtctcattaatctcttctccaaggatgcagaccctgtctttcaaaccaaccataacactaccggctccctgtccccatctgccactgccctgggcccaacagcccagcatctggctgccctgtgcctttccccaggctgtgttgcctgctaggaagcccctgcttgctctttctgccctgcctgctttctctgcccgtcagcatcctactcatccttcaagatgcaggtctgatcccacatctacctcccagatcccttccctcctctgcatccagtatccctcgcttatgagcagcccacagcctgctgggtctgaaatcgtgtgtaatgtctgtctcctctgccagacaggagccagggtagagcatggactgtttcgatcatccttatattaacccctcaattgcctagcaaatagtaatattaataaaataatacatggtatttgtgcagcacttaatagcagctaacatttactggatacttactttgtgttaggcatgtgctagacttatgtaaattatattatttaaactgcataattacctgataatgtagctccccattttactgatgagaaacactgaggcttagaaaggactggagtgtgatccactcagagctgctaaatggcagggtcaacatttaaacatcagataccaaagtccaggctcagttaagcctagcacagagcctggcacaaagtaattgacaaatgtgggaaggactgaacgcacggacgatgcacagcaacatatgcagatgctgatgggaagcaaaactcaggcagaaaaaccggattgacatctttggccaattaagagatcatatgcgttatgaaatgatcaatcattgatttttcaacagcaagcttttaaagtaccattaaaataacactaaattagcaaaagctgttttaaacataccttttaggagtatataacaaaatgggggaaacctgaataaaaaaacacataaagagctgcaactatagcagccaggaagctggtgggaggcccaggcaggagggcaggctgcatgggggggcccggcgggaaggaaggtggagatgcagggggccggcggggaggaaggtggagatgcagctggctcagagcacaggccccctgtggggtggaggccacaggctggcctggcacagctggagatgcagcagggaggttggggcctggcattcatgtggaggctggagaagaatgtgggagctctggtctgaaggccacggtggggcagggtggggtggggggtgctttacaaagaccattgcggctccactgagcaggtgagtgatctgtgccatgaacacagaggacatcaccggtgcaacaaatctggagccccactggcataagtcacatgctggccccgatgtgggagggagttgccttgagggagcttatggccattaagtgagaaaagcagggactgagagggcgcaagcagaggcaacagaggatgagcgcccggaggatgatcgcagcctcaggacagcggggggtccaggtagaagtcacactggttagggcaagagggtgtcatggaggaggctgtgtttgacgtgggccttgaaggatgggaagaatttaaggtgagggcagagcacttgagctggagggggagctcacatgggaaggccaggcagggcaacaatgggctgctcaactaggcagctggatgggccgggcacaggaaagagctagggatggggctgggtggcaggtagtagtggggatgggccctgagtgtggggtaagaaatgtgtcgttaatttgggaggcaatagggaagatacttcagcaggaagaggtataagagcagctctggaaaaaagaatactccagaaatgaagaggatgggtggcagagaggaaagagagccttgtgctgcagcctgggtgggagatcgggggcctgtgatacggggacaggaaagggcgatgggaaagtggcgagggaggaggactgcagtgcagctgaccaggtgtgaggtgccagggaggggcctgggtggccagggaccacactactgtccacagagggtcccaggaggagctgctgctggaaggaggctggtggtcccttgggaaaagccgatgtgtgatgtgggagcagcggggcaggtggttctctggagggtgctgttcagaggcgcgggcttgggagagtgtggctagcctgaccctgaagctgggggtcggtggggtccccgagggagagcgctacagaggtcggggagaggcctgggcaagggtggaagaagaactgggaaggcggccatggggtccagagggaaggcagcgcctcagtgactgccatcagtgcagggagctggggcagggaaagtgagctgagccactaactaggccactggtgtcactggtggggacaggacgtggactgaagtctggtgaagtgagaagggggaggaggcaggggcagaaggatggggagagggcagacttagggtctaggccccctggctgcaaagggagagggtggatggcaggccctagaggagggtgaggaggagcagtggctgctcaggagctgaagggagacagaccacaggtgtggcatgtaatggagcaccacagcccaagcagaggtgaggtgagtcatggagagaaaggagtggagaaggtgcagtggagtgggggggatagaggtggtgcagagagggaggtcccggagctggcactgccagcccgtgtctgtgtgggcaggagccccagggaggtttgcagtagtagcttcaagaggggagggctctctggtctgatcccgcagcaggtctggtctttcagacccgtccctatatcatcagcctgactgcaggagcagtggccggcattcctagggcccctgggggctgcgtcccaccctccgggcaccctgataccttggtaagctttctcacgcttcttcttctcggtgtcgatgtactgctcagacgccgccttgatcttctgcacccaggcggtcctacgggagaagcaggggcagccgttggccgcatcccaccctcacaggtcagcgtggagccccagagctctgcacatgttcttcagtcttttgctaacctcaactttcacaagtttcctatcaaagacctgatattagtcaactgaaagatgcttatgctaatggagtatgagagctggtagtgacccttcttggctgaccacaaaatgccaggcactcgcaaggcgctgggacctggagacagatgatgcattggccccacggatgatacctgtcacgaggggttctagcgcacacagaggagcagcagcaccccccgggttggcgccgcggaggcactgttggagctgcagcctgaaggaagctgggaacagcggggatggcacccacacaagggcgcctgaggggcgaaagtctgcaggtggagggacgagggctgaggcctgtggcccaaggaggcctcggaaaccagcaaagcacagtgggctgtcgcctgcgggcagcccctgcagggactgtagcagggcctcaggtgctgatctgccatttgggaaggctgctgagtggtgtggggagagactagaagccgggaagcatgttaggaggcagctgcagtgaccaaggcctaccatgggactggagcagaggggatgtgttaagagaggttcaggatacagaattagtggggcttaagcacggctggagatgggtttatggcagagggagacgtccaggccttctcccagagttcaaggcaggccacacatggtcaggactgacctctcattaatgttgtctgttcggagggtgtagacccgatcaatgtgggaaatgtggaagacaggctcatcgctggaagggtctgtgggcagtttcaccaagacttcattcaggaaaatgggctgaaagaattagggccaaaacacaggctgtgagatgggctagaacactccacccgcctatgtccagagagagttctgtttgttctgaagagccttgttgagaaggagaaaggggtctagcgtctaaggtcttctacacagaacaaatgaaacctccatttgtaagaacaatgaagcctccatttctggaaaagtcattatcgaggtgggtcaggtgttgggactgggtggggacaggagctccaagcgcccatgacggctggtgcaaaaggctctctgctagcaacgctggtgctgtgctggggctcggcttacagagacccaatgctgaatgcacacagtggtgagcccaggtgtcacgctggccaggaggaagccagaatctcagctggaatctggctgatggcctgtggcaggtggggagtgcccagctgcatggggcccttcccgtgggaagcagcaaaggaagcacgagcgatctggaaccaggtgaggagggtcccgtaaggccagctcagggtctgccaggaaggccttaagatagaggcaacacctcattaggcccctgatgctacccccagacgcgtgatactcaccgttttatacattttgaattgagcattggacttcgagctgaaaagtttctcagagccagaggaaacagcaaactgcttgaccatgtaggtaagaagcaggaagtcattgaagaggaatccgtgcagttccttgttgctcttggtcttgtataatttcccactgtgtaagagcttccggggccccaggcagttggtgagagagttgaaaataagttgcttaaagagaaagaaaatttcactttttaaatcccggcacaaaccatccagtgcccctgagaggccagtgccctgggcctgaggatactgtggtggagttttctaggtgggaatgtggctagaatcattcactttgcatgaaagatccttaaatacattactcttcagagtccaaactggcccagtgaaaatcattacttctagccacagaacactgattctaccagctgaattcaaagaactcaaaacaaaaaatcccagtgttctctccttaggagaaaggaagatgacaatccaagaaggaatgcccttcatgcctgcaatcccagcactgttgggagacagaggcgggaggatcacttgacgccaggagttcaagaccagcctggccaacatggtgaaaccccagctctactaaaaatacgaaaattagctgggcatcgtagcagatgcctgtagtcccagctacttgggagatggaggccagagaatcgctccaacccgggaggcagagcttgcagtgagccgagatgatctcgccactgcactccagcctgggcaacagagtgagactccgtctcaaaaaaaaaaaaaaaaaaaagaaaaaaaaatgcctttgcaggggcagggtggtgagtccacgcaggctgcctaaggtgcagactgtccacgtgagggaaggctcggagctggttccccacccagagcctccctggaggcgcacggcttaaccacacaggcctgacctccgcgaggccttcacactgcacgtgcgcctggatccactccagtcggtccgagttttccttctcccgaactccctcattcacttgagagcacagctcctctgcccgctcgagggccagctttagggaggaatggtctgcatggctctccggggtgttctccagaatctggaaaagagtgggcagtgtcacatgggggagctgcgtctctcacctgcccacctggaccttcgcaggaccgctcctccaaccccatgttatggactgcttccatgccctggaaacgcggcggtgaacaagacgacactttccgcccttgagaaactcgtactcccacaagttcttggggacacagggacaggtaacgctgctgtgacaaggtgacagtgctaaacggatcaagtgctctgaactgtgtgggtctctggttgctctccgactggctcccggtaataggcgggagcctcccgactccttccgaaatttaagccatgtaagggtgcgccctcctgtataaactggctgcagctgtggtaagtgtgaacttgctgaatagcaatggttcataacaattttggggtcactgatccttttgaaaaaaatctgatgaaagcaatgactcccatgccacaggaaaaatacaataaaatcacattgtcagcatgtggaagaaatgcattctgttcattctgaagcgatttcaaacgacgcatgctgcaactgtgaacgcgcagaggccagaatacaaacgtgtgtggtccctccagaaattaggagccatcaccagatgccccgtctggactctctcactctagtcagatgagtgcacagtccttcatttacaattctaaaatgcagaacagcctgagagcctaaagtttttattcagtacccatttggtggcaaaatctgacctaaacagaagagatatatttacttactcttacagtgattgttcttatgttccactgtaggaatattagtgtgtctggttgtaagtgctaccctaaggctcagttgaggagtcatatattatatggtatttgagctacattccgaattctgaaacacatctggccccaagtatttcaatgaaggggctgtgaacctgcattatggttcagtttagtgcaggcgtctatcacatgaggtctatgttgaggtcacacagctaacagaccaaaagtcaaggaatcatcaatagaagtaacaagcttatcatattcctgctgcttttctttgtaagttactgtaatcaatggttaatcgtgggataatcttttgtaaagtctgccttttccttagaaggcttatgggctcaagagggccctattgcttatcaaaaagaaagctggaaggaattttagaaggaatgttgaagccgaatacagcgagggacacaaatgaactctatttatgatgtgccaagtggagcctcctgggacatctaggaaaggtgttcagggtggatggaggcagatctcagaggaaagactggagtctaaggttactctggtctttctctgggttcaagatgggctccacaactggagacctagaggggcctttccctgcctggacaagtatacttatgactttgagatgctggggagtttcttgaaaggtgggtgacaggttacccaagtgatactggattcctctctgatttgcccacttcaaggattcagcgtgtttctgtgcacacacacacacaggcatctggtccccgggacagtgggatcacttgtgcggtgtcacactgtgtgcagggtgaggtggcatgctcagggctccctgaggatctggcctctgtggacctcagcgcatcctgctcctaactcagaccccactgcccggcctgcacactcacacttctgatgagcagtgggtagcgggtgatcctctgcatgggtttcagcaggaagctggagaggggcattcctttacaccgcgggtcagatgccagcttctgcaaaacaacagtgaggctcgtgaggaaatcacagctccgatcacaggaagcactggtctttgatcgccttttagatttcacatttcttttatttatttatgtttctccctgtcttactgttttagaattttttttaggtgagtgttctattttttatttttattttaaaatttgtgtatattcacaacatacaagtgtaattttgctacactgatatgtcgcactgtagtaaagtgagggggcttcgactttcttttaaataactcaggatctaaaatgatacctattaggttcacagtaggaatatctcagctcatgtgccaagcccagcggatgctcctcagctctttcccatgacctgtgctgggactgtcccctgccctctcttctcggagctgattcacacttgaccctcaagactcaggccctgcttccccttgtccaggctctcccctgggacaccttccctcctttccatgaccctccctggccacctttagcatacaccacatgtgcaccaggtgatacagggagaggcatcgtgttgcagtgtctctattccacacccgatttgtgaacgccaggcccagggcccacatcctacttgcctctacccctagctctggtacactgcctgaagacagcagctgctgctctaggatggcagcttttaatgactgaaaagtacactcactgtaatccacctcatcatttccccactactggatatttaaattgccccccttttgttttggccgtatctatataggttgctgtcacaagcatcttcgtgcttcttatttccatattttctgagtctttttaaaaagtaacattttagaacacagcttattgctagattttgctttttaaggtaacctatagcaggcctttcatgaggcagtatttttatttattttgactactgttacaattgtgatgactttgaaatcctatttacatcattattttaaaacatgcacatatactaacaattctcagtttatctcattattctgatgaatgtttaattctatggtcttggtttccatgtttcttccagttcatttcgaggcaactccctgcctcctacccttatcacaaatcgaagggctctgtcctcactgccttatattgaatcatttttgcatccctgagatcatcgtaaggaaaaatacgataatcatttattgaatgctaatagtaatgtgttggtctctgagttaaagtcctttaaaagtactgtgtgataatctccttttatagatgaggggactgaaggcacccacatgttaaataacttgcctctggtcacacaattagacagtgacggggccgagattctgaagcctgtcttgttctaagcatagtatgctatagcctcctgagataatcctatttggttatgataggctcttcttttcatgtaatgcttaattttatgaattgttactttaattaagagtttaacagctgtatttgtaaatgatagtgggttttaacttaaacaggccttggaatcatggctacttttgctttatagaatgaattaggtgacctttttactttttcctatgatctgtaacagtttgtataatatagaataatctgttcctttagagttggagagaattccctgttaaatccatcaagtgaacccagctcctttttggggtaagtttctcaattttctccttggtgtatagtatcgtaatagtaagattttctatttttaaaagattttctattcttattgagccagttttcaagttttaatagaaaattacaaattttgttcatgttttcacatttgttagcatgtcttttggaattacatgcactttaatttaagagatctccttacatccattctgttacttgtgttttttcctctttctctattagattcatcagttacattttattacctctcttcaatataacagttcttggatatattgatataatttgtgctttttacctttattacttcctccattttccttttctaatttctattctctgcctaaacatctttatattttattcttactttctactcttttctgataatgaaaatatttaaattatatactctccttaagtactgatatggctgtttaatatatcccaatatgcagtatttcatgaacaaaaaaacccaacaggaaatatgaaaaaaagcaagaaaacagattttactttcaatttcctcaccattttaacaggtataataatagtttctactactgaacaacatcaatgcaaataacttctcaaaatatgactttctattataataacctgtacgaaggatgttgttgactcattacattatacacagtgttctctctctgagtacagctgtagctttacttctcatgtttaacttgtgacgtggcatcacggaactgatcctttcttcttctgctcatcagtttctggaagctttgatgacatctgtgcacacttctggtatatttacaggatcacagatatgcattttatatattatcctaattcctggtatcgtctttgtttcctactctcatttccttttgtccaagtttattcatctagttattttaaattttatcttgttgcattttatatatttgagtaagctattttagggccgggcacggtggcttacacctgtaatccaagcactttgggaggccaaggtgggccgatcacctgaggtcaggagttcgaaatcaacctggccaacatggtgaaaccccgtctctactaaaaatacaaaaattagccaggcgtggtggcacatgcctgtaatcccagctactttggaggctgaggtaggagaatctcttgaacttgggaggcagaggttgcagtgagccaagatcataccactgcattccagcctgggcaacagagcaagattctgtttaaaaaaaaaaaaaaaaaaaagagtaagctattttatactctttctggaataaggcaggtattaaatgaaggcaatttacaaaattaagaaagtgacattctggttgtttcttgggagtataaagtagctgataagtaagtatgcttaaaaaaaaacactctgctatcagatggggaaaaaatgatggtcccagtgccaggaaaaaatcaggtctacataaaggcaacacaaaacaatcggaaaattctctgccgttttggtgtttcctttggaaactgatggggatgcccttctccattgctgggattccctgttgggctactgtgtgctgttgcctccagcctcagaaggagcctgacccgcaaggcccagaatggaattacctttaaaaattctttgaaatctgtgtcttcatctgtcttctgctgtaacagagctgctccattaagctggcagctgcagaacctgatgtaagcctgcatgtgggacagctcagcggccaggatgtccccaatcatctgcaccggcatcttctcgcccccggtcttcttccgcacccgcaaagccctgccaagaacacactctcattttgtgtttctaagtgaatgacttaggtaattaaaggatgaatcccatggcagaccaatggtaatgataaccagtgagctacctaagaacctctggcactgggaaggagaactcaagaggaagaggagatagcttgggccaaaagctctgctggtcaagccaaccggggtgtgatgtcagcaaagaaaaaaaaagtaaataaagtccctgcagttgggtgggctgggcacggtggctcatgcctctaatcccagcatttcgggaggccgaggcaagaggattgcttgagcccaggagttcgagaccagcttgggcaacatagtgagaccctgtctctacaaaaatgaaaaattagctgggcatggtggtgcacgcctgtagttccagctactccggaggctgaggtaggaggattgcttgaatccaggagttcaagttgggtgcagtgagctacgatcacaccactgcactgcagcttgggtgacagagtgagaccttgcctctaaaaataataaaaataaaaataaatttaaaaaatacacacctgggtagctgggcatggtggctcacgcctgtaatcccagcactttgagaggctgaggtgggtggatcacgaggtcaggagattgagaccatcctggctgacacagtgaaacaccatctctactaaaaatacaaaaaattagccgggcgcagtggtgggcgcctgtatcccagctactcgggaggctgaggcaggagaatggcgtgaacccgggaggcggagctggcagcgagccgagatcgcgccactgcactctagcctgggtgagagagcgagactccgtctcaaaaaaaaaaaaaaaattagccaggtgtggtggtgggtgcctgttgtcccagctactcgggaggctgaggcaggagaatggtgtgaacccaggaggcggaggttgcagtgagctgagactgtgccactgcactccagcctgggcgacacagtgagactccatctcaaaaaaaaaaaaatacacttgggtgtttcaaggcctttagaattgttttggtttcaccttagcttcttggcaaagtttcttttgaaagattctaacttgttcttggttgaaccaagaaggaaattttcagtctgtaagagaaaaaagggagcaggagctgcaggggccaggtgtggaggcagagaggcactatccctgagggaagctgggactgctcatcctcccttggggggcctgtcctcacagccacgaaggatggaaaatcaccccaacagtagaacttcacatggggatagagacttaggaggccaccaaactaggcagttttatctgcgccgtgagctgcagctctcctctgactcttctgccctgccagggtcaaggacatcttatatcttggaatcatagattgatatgttgtttaatgatttaattttttctttatcaaaatattttgttatatttctttactttcttcaatacttatgtattttacagtcacaggatatttcataaaatgataataaaataacaagcctgaggaagcagaaagcagttgaagttcctttgctaagaagcccttgcagagggttttgtgtgagtctcagtctgggggctttggggtcagcggcaatgacaggtgatgctcaggactcacttcagcagctttgtgttggacatgatgagctccttccagttaacaaaaatcagggccatctccccttcagtgagaaagcctgactctgccatgcgtttctgaaaaacctaaagtcaaaacatagaaaaactagttagcttaagtgtggatacacagcctacgtgtggtctaaatcaaacaatgtcttcataaactgaaactaatcagatcaaataatgtcaacataaactgaagctaatcatccaaataagcatacttatgacacattttatactgcataatgttctttctttttgctagtgcagctcttatcaaggctagttccaaggactgaatctagtaatctggttaagaggagattttcagatttctctcttagggatgttatgaaggttaaataaagccatgggcatgaacacctaggcactgtacaagcttgcaggattgaggaagcaggccattgttaggtggagcatcgtagagttctagacaacaatttgtgagacattcaacaggagaaccagagtaacaacttatgccacccctaagataactctaagcagatgtgggttttagaagttggctgctgagggagaaatagtaatactctacatctgtattacatagcacttaaggatttacaaagcactgatatgtacaaatatgcagatgcttgtgtgtgtgtacacacacgcgtgtgtgtttgcagggttctcaagtagcttcacgggtgatggaggcgaagctgagtcaggtattattattaccaattgacctatgaagaaataaaggcttagagggagacttgctcaagatcacaaagacagaatatgaaaggcctaggactaaaattcagctctttttgattctaaatctaagtttcaactgcataactgagattcctagggaatgactttaaacaccttaaggaaatagagaagttacctgagacactcttctcatatgtcatctttccaaaatgcccatgacatgctgctattagaatcactcaaagctctccactgtccgtgtgataagacacagactcctcctggaggttccagggcctatgagacctgccccctgccaacctcaccagcctggccctcagctacttcacactccagtcaccctggatggcctgtaggcccctgactccctccatacatgccatcccacttctgtttcctcctcctggagtagcaaacttgtccttgtccaaaacataactgggaaagttcttcctggctggggtggtcactaaccccaggtttcagccttactggccccactgtacctctctccatccaacaggactctgaattcctggaggacaagaactttctttcatctctgttctctggcatagccctttgcacatcgtggtttgtaattcatgtttacagagttgagttgaacatggattcacagaattcaagtacaagtgctgggcactctctaaagagagttttacagttccaaatcagactgaagacactaggccactcctgtgagagcagccctggaaagacggccggcctgctcggaggctgctatggagggacagggaagagtctggctgtccatctgtttgtttatttgctgattcattcatgcccctctagccatccatgtagctgctttgtgccgggcttggtgaggtaagcagatgggaataagctggtcaggcctctgggaaccttcatgaggatggtcataagaaggcctcacctgtgaatggtgcttttcacccagaatcctggacccagacctgatgcttcactcctcagagtatggggcaagcacccggtgcctgctcacctctgtcctagtgttagggagacctccacacctacttacagtgccttaggactggaatctgaccagcagcagggctgatccttgtaggggattaatcaaaatgatgggcttttcttctaggccatctatcctggccagagaggtgcagacataaacacacccaattcactgactacttatggaaaggccgaccaagggccaggctaagttttgggaacacaggatgaaggctgcacggtccctgttctcagtgagcccacaggcgtgcagtgaagatagatatcaccaaccgagaagtgccatatagtttgcatgggaggggaacaagtattccatgtctggatatcccaggcattaggcctgcgtttaaggtggagagtgaatccagggcagggcttgctggggaacagacgcagaaggacgcagcctctgctccattcagctatgaaaggcatggccaggtatacgctgcacctgttgggtgtgtgggggtaggggacgcctgttcttttcaggtggtttgttaatgtaactggtcttctcacctgagggcctgtacactgggaactgaaaggcatggaaacaaaggtatagtagaaatggaaagtcttcttttgttcactcaagcacaaatcattttaaagtgctactcgaataaggatagctgtcatcagcgtagaggtcactggtataaacaaacagtagctatatgatatttgggaactattttacaatatgctcccattgggttttccaaactgatacaaccatgaggtgaacactttcactgtttcacagttcctccagagataccagtttatgaaaatgtcagatgttaaaacagatattaggcaaatatccaaggaagctacggtctgccataggcccttcccatccactctatccccgtccttccttgatggggctcctgccacatccaacgaagccatgcgaatgccctcttgttctcccgcttcactctgagtgacctcatctgggggaaagagctcattagagactttcaatctcaagcattatccggcaggcagagacagcatttggaggatgtgagagcttccgtcactatttgtgaattcacacatcaaaagtgatgccttgctttgactctgcgtggaggcagccctgagtctgatgcccaccatctctcatgagagacagcagataccccgagagctagccagcagcagcctcctcacctcgacgacgagctgaaggtcagccatgtaccgctcttcggtctgaatcagctcatgaatatagccctgtcttttcctctcaattggctgcattgtgtccagggtttgcagatcagcacaccctgtggaaaaaacagggtagtttaaaatattactttagtcaactttgtagaaaatagacatttgtcagcagatgtgctgggtttacaaatgctgctttgaaagaatgacgcagccttaaaaaggacgctgctaacttctgcagagcagcatgcgtacgcggagagttggcattaatgagccggcactcacagctccaaagtggcaaatcagcaatgtctgtaacatttcaatgtgctcctaatttcttttcagaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagaaattaccatgcatatggctttggtaaatattgtgaaatgtttagttatgtatgtattcgaaatgtaaaatgtatttctcactgtgagctactgttaaaaaaatgtttgagaaacagtctctagatttcttaaaggaaagttctaaggttataaaacctgaaattcccagatcccagcaattcccagaagaccactgcctcatctcactagaacaaataactcctggtacactgcagatatccagccacaaatgacaggaaagtcacaagcaaccttgcatcagggtgagaggtactgcattcactatggatcaattcacaggcacatcacagctgaactagatgtcaaactatgaagtgacataattccagagtcacttaacaagtagctgagggcttgcctatacacagtgatgtggcgaaatacctcaggaaacccttcttagaaaaaaaagcaaaagcagccgggcatggtggctcacacctttgggagtaatcccagcactttgggaggccaaggtgggtgtatcacgaggtcaggagatcgagaccatcctggctaacacggtgaaaccccgtctctactaaaattacaaaaaattagccaggcgtggtggtgggcgcctgtagtcccagctactcaggaggctgaggcagcagaatggtgtgaacccaggaggtggaggttgcagtgagccgagatcgcaccactgcactccagcctgggcaaaagagcaagacttcatctccaaaaaaaaaaaaaaaaaaaaaagcaaaagcagtggaagttgtcagaatcaaaatggagtcacttgtgttaaaaatcctgacaaagggccagggaaggccatgaagagagagttctcatccatgaatacttgataactagaactatcacaaaagactgcaaaaccacaaacttacataaaggccatggtgacctgacacaaaaaaatagtcctgcaaggttatctgcccagcaactgcctgtccaacctcggacaagtgccacccttattgattctcacggccaaggataattatatatttaaaaaaattatgtgatcctcttcatttttcctttaaaaacttttgtcctcctttagttctctgaatatgcacctgttggtatgcatattcccattacaataactatttttcttttctttttttttttttttttttttttggagacagagtctccctgtgtcagccaggctggagtgcaatggcgcaaatctcggctcactgcaacctctgccttctgggtgcaagtgattctcctgcctcagcctcctgagtggctgggattacaggcacacaccaccacgcccagctaatttttgtatttttagtagagatggggtttcaccgtattggccaggctggtctcgaactcctgatctcaggtgatccgcccaccttggcctcccaaagtgctgggattacaggcatgagccccatgcccggtgcaataactattcttaaataaatatcactttcttttagagagtctccctctccgttatttaggttgacagcatgtaggtacccagcaagctacaacatgaggcagcaagtggcttgtgtcagaaaactgggaaagagacgaatgaagtagggaagaccttctgtagctaaggcaaccaagaagggcagcagagcgaaggcgcaccctgcacctgccaggacactgtccatccagcagggcgtgttgctctttccaatttcctttgcatttgtatacattttgtatagatctgggcttacagacagttctaaggaagacagcttttctatattctacagatgttgccaacagctttaaagaaattactcccacagagaacaaaaaaataaatgaataaggcaggttatgtttggtgtttctaaaaagaaatcatagactgtggtgcctgtaatcccagcactgtgggaggctgaggcgggaggatcacttgtgcctaggagttgaagaccagcctgggcaacaaagtgagactctcatctctaccaaattaaaaaaaaaaaaattagccaggcgtggtggcatgtgcctgtagtcccagctacttgggaggctaaggctgggaggactgcttgagtctgagagttcaagtttgcagtgagctgtgactgcaccactgtactccaggccagataagagtgagaccctgtttcaaaaaaaaaaaaaaaaggaaaagaaaggaacagggagaaggaaggaaaaagtgaatgtaaggggaaagggaaggggaggggaggggaggggagtgagggaagaaggaaggagtgaaagaaggaagggaagggaaggaagggaaaaaaaggaaagaaacaagaaaaagaaagaaagaaaggaaagaaagaaaaaaaagaaagaagaaaaataaagaaaagaaagaaataaatcataatgccactgtcatgttcaaaattgttacgcttttagggagatagtattttattatcttctgccagggggaactgcagagggtaactgagtgttaaaaaaaatcactgaggctaatccaaatgtctgcttgacgaggcttttgtggagcaaggagaggcttggtgaccagacacctggcgaaatggcactgatcctgatatgatccagtggtgctactcggtgtggccaggtgattgatggagggaactcagaccagtttccaaggttgccccacctcccacaccactgtcttacaaacttcatgttctgctttcaagacttttgccatatccacattccatctctattattatttacttaatatttttctctaaacgtactcgtgtttgaagttaagtgtgctcattatgtttcttctaataatcattaaagcaaatatataatcattcgaatgaaacaggtccattttgtgtaccagtgcgttgagcaccacaaggatacaactatcacaccttgggaaacaatgatttacattaaaaaccacaagtattggccactgtatctggaataataccttggaataatagcaagaacctcagatatttgtttctaaaactagactatacattgcattagctgtagcaggataatgtggggacacccctggcatgccatgcctagctgacccttttgcatttcatcatgacggctcttcaactttttttttttttttgagacggagtctcactgtgtggcccaggctggagtgcagcggcgcgatctcggctcactacaacctccgcctcccgggttcaagcgattctcctgcctcagtctccgagtagctggaactacaggtgcccaccacacccagctaatttttgtatctttagtagagacggggtttcgccatgttggccaggctggtctccaactactggcctcaagtgctctgcccatctcggcctctcgaagtgctgggattacaggcgtgagccaccacgcctggcctgctcttaaatttttaccctctgtttaagtttccaacccagctcctaccctcacttccagatgctcttacctctgatgtcagggaaaaaataaagacacgaggcctctcttcctccccttctgtctgtccatttgtccctgtgtgtccttcctgagttagggaaggaggggtcctgtttctttctaaagccactgtctgtagtcagcctctcctccagggcccctccctttccttcacgcttctatgttcactcttcgccatttccttcttagcccataaacattgctaagtgtccctcctatcccactgtttgaaaccaaccaacaagcacacttctccaaccctgccccctcctcagcaccgcctgcctttggtctcattggcaaatgtcactagaggggtttacacccatggccaactctcgctagctttccctgtcacatctccactcgggattctggtttctgccccactgcccgacactgctctcgggaaggtatcgatgaccttggcattgccaagttcagtgacctcttctgagcttgcaccctcccctgccggcccacagcacaggcgccttggatgggaggcttttttggagacttgagtctgcctttctcagcccttgagcctctcctcttcttggtgtttccttctgtcttctgcctcttgcctgctgcctggctctctgctccccccagtccagcaaatgccaaaataggctcctgatgctcctgtcctgtgcggtcagatgaatccagacaatgctgcaggctgtatatctcactcgcagggccccagtgcacattagcctattaggcagtgagaaactctgtgctacagaaaaatttgatgagctcagggttcccaacacgtatttgaccacagaatcctctttttttgagaggagggagggtaacatcttttttgtcctgagaaaagtcctgatgaactgaggaattcgggttttatggataggatacacccctttgccactctctatacctgcattgtcaatagagtagcccttagcaagctgtgaccgctgaacacatgcagtgtttccatggtactggtttgtatctgtcttttaacattacacatcgtctaactggtgctgttgttaatctgtgtagttacggtgtcagtggctctgactgcagaccagggactgtgtctaacacatttctgtaatagcaagctgagcacagcgtgttggctacctgcagtcagggaatatttgttaggggatagaatattgtgttggtcctaggcctgtttgtgcccaggtccatttctcaccttttccctgttctgctctgggctgcaaaaaagccaatcctgcaggctgttttttctaagcttctgttctatttggcctctgcctgggtttggccaatgagaggaaactctggcaggagactgaatgttacagggtggagtaggaaaaatgtcctctctccagaagagtgacatgattaaaaagttttttgtctgttaagtaatgaatggaaatgctgggcttgcatcttacacaaacttggagttcaagaattcagatgaattaacacaaaaattggccaggtatggtggctcacacctgtaatccaagcactttgggaggccgaggtgggcagatcacttgaggtcaggagttctattagcggtaaatgtgctcagactttgtctgaaaatgtatttatttctctgtcatccatgaattagatttctagctggacagttattttttctctgtgttgtgtgttatgtgcagccagtctaattgctgttcatgtggttattctggtttttcttggtgctcacttgaggtctgagcacaaaggaatcaatattactgtagaaaaatgtttactgaatgtagctggaaaattacacatttaacattattttcagatatttcactttaaagaaaaagaacttcctaatctccccaggtagcctcctctgttattttactggacctattgctaacatttagtagagatgaaaccccatctctattaaaaatacaaaaattagccaggggtggtggcgtctgcctgtagtcccagctacttgggaggctgaggcaggagaatcacttgaacctgggaggcagaggctgcagtgagctgagatcgtgtcactgcactccagcctgggcgatacagcaagactccatctcaaaaaaagaaaaagaaaaacaaaaaacaacacaaaaattggtcactagctggtgatacccttagggtgactggccaaaggaatggtgcaactggcctggagggtcacactcacaactgtggctccatgagattccacagaaaaaccaagtctcattaaagatgagctcaaagtaaaaaaaaaaaaaaaaaaattacaaaaaacgggaaaaatccaccataaattgaaaaatgaggattagaacaccaagaacatatgacagtagaacaaaaatacacatggagatgtaaaatatatatgtttaacattactcaagacacataatgaagggcttgaagccataggtagtctattaaaagaaagaataaggagagttgaaaaagaataaaaatggcaaatattgtcatggaaatgataaattaatagattaaatagcagattaaacacatcctaggaattagtaaacctaaaaacagatgtgaagaattatttagaatgtagcccagaaagaaacagagatggaaggctgggcatggtggctcacacctgtaatctgagcactttgggaggccaaggcgggtggatcacctgaggtcaagagttcaagaccagcctggccaacagggtgaaccgtctctactaaaaatacaaaaaattagcggggcatggtggcgggtgcctgtaatcccagctactcaggaggctgaggcaggagaattgcttgaacctgggaggcagaggttgttgtgagccaagatcgtgccattgcactaaaaaaagaaaaaaaagatggaaaacataaaacggaagttaagagacacagaggacagaatgacaaggcccaacatacatctgacaggtagtccaggagaagggaatagaaagaattgagagaggtaatattgagattataatggctgagacttttctagaattgaagaatgatacaatgcctcaaattcagaacaatggcttctgattaggaaaaaaataaatccataccagaacaccaaggagggaagaaaaaacatgattaaacagtcagaaagaaaaatcagaataaccacatgaacagcaattagactggctgcacataacacacaacacagagaaaaaaataactgtccagctaaaaatctaaatcacagatgacagagaaataaacacattttcagacaaagtctgagcgcatttaccactaatagacatgactggaaaaactattaaaagacgtatttcaggaagaaggaaattacataagaaggaaaaagaaaagagatatgagaaatggtgagccaaaatactagtaaatgtgtaagaaatcaaaataatcattgactgtataaaacaacaataatactaagttggcaggtataaatacaaggtgaagttaaaacacaaaaatgtaataacatgaaagacataagagaatcattagagataaatcatcctccttgcattgatcagcagaaggaagagatattgatcaaaggcaaacaggtatgttaaaaatggaaaggtaaccactcaaagaacagacatagactacataatttcccaaccagtagagggcaataaaagaaacaaagaaacttgatcagtgcgacagaagtccctgtgtcagcagaacaaaaaggggcaaagaaaatgcctggtaaatagaaaatacataataaaatagatacaaataaaagtattaaattgttttaatcaatgtaaatggcttaaatctgtcagtgaaaagagaggctctggattaaaaatcaggtcatagaagtgttggaagtagtgggctagaaaaagctatccaaataaaaattctaaaagcaactggggaggttttattacaacagacaaattaggctttaaggacccgtatgagatggtagaaacattcaccaggaagaagaataattctgatcttatttgcaactaacaggaaagcctcaaagtgtaaaataaaaaaacaactaacaggaaagcctcaaagtgtaaaataaaaaactaagacccataccccacctccctccaaaaaaaagaaaaaactgacatatctataatcgtagtagagtttaatatagttctctcaatgaaaattaatgagaatatgaaagatttgaacactattaacaaggttaacatatgaacacacatacaagagactatacattctttttccatagaaccaggctgggcgtgctggctcactcacgcctgtaatcccagcactttgggaggtcgaggtgggcagatcacttgaggtcaggagttcgagcccagcctggctaacatggcgaaaccccatctctattaaaaacgcaaaaattagctgagtgtggtgacaggcgcctgtaatcccaactactcaggaggctgaggtgcgagaatcacttgaacccaggaggcagaggttgtagtgagccaagattgtgccactgcactctagcctgggtgacagagtaagacactgtctcaacaacaacacaaagaacccacagaaccaatttcaacaaacaccaaggaatcaatattactgtagaaaaatgtttactgaatgtagctggaaaattatacatttaacattattttcagatatttcactttaaagaaaaagaacttcctaatctccccaggtagcctcctccgttattttacttgacctatcgctaacatctgtgattgctgatgactcgatcctcatgagatcctttttcactcgtcttccaggtcaccacctctcctctcctcatatcctcccacctcactggtctgcccttccacggctcctttgctcgttcctcctcaactctccagacttctaatgtcgcagtgccctaagattcagtccttggaactttcctcgacatactcagagccttggtgacccagttcattctcatggcttatttatgtactgataggctcccaaatttacactccagcctgaacatcttccctgaacttcttcacacgttctgctgtatactcagtatccccattcagatgtctaaaaggcacatcaaagtaacatcaaaagccaaacccctaatcatctcccaacctgctcctctataattttccacctcagtggatggcaatatcatctctccagctgctcacgccacctgatacttctcacacttcacattcaatccacctgtgggatccctcttcacaatacatccagaccacttctcacacgtcccccatggctgttctgatccaagttatcatcatcttgtgcttggattactgaagtagctttccaatggatctcctggcttctgatcccttcccctctttaatctggcaaggcagagcagtactgttaaaacacaccagatcatgtcactcctttcattaaaacccttggctgggtgcggtggctcacgcctgtaatcccagcactttgggaggccgaggtgggtggatcacctgaggtcaagagttggagaccagcctggccaacatggtggaaccccgtctctactaaaaatataaaaattagctgggcatggtggtgggcacttgtaatcccatctacttgggaggccgaggctggagaattgcttgaacccaggaggcagaggttgcagtgaccggagatcatgccattgcactccagcctgggcgacaagagtgaaactccatctcaaaaaaaagaaataaaaataaaaataataaaaaccctccaatgggttcttctcactccaaacaaaagccaaagtttataaatagcccacaagaacctaaacaacctccttcatttcctaggtcacacccagaccctcgcttcctccttctctcctgctcttccctcttcccaccgcacaggcctccgcactattcctcaggcaccacaggatgctcctgctgcagggattttgcaggtgcaaaatctgcccagaatgatcttccagatatccgcatggctccctccagatatcctcacacccctccagtctctgcctgccgtcactatctcagagaggttttatctgagtattttattcaaaataaaatccctctggatccacctcccttgcagaactcccattcctcttccctgcttcatttttctaagatgctacacacttcacattctcattttgttcgttttctgttttagcctactcaaacaccagctccaagatggcagaaatttttgtcttataatttgccacatccccagtgtctgacacacaggagggcttcgataagcatttatggaatgtgatgtgaagatacactctgagcttcaggagacagtacagcagtgttgactacaggcagtcagagaaattgatgaaaacttcctggtaggtcctttttggtagacaagaagagtgggcaaagaagaaagatgagagatcatggctactatcaggttgatgttcccagaggaataattagtagtgggctgggccacaagacccacccccacactgtgggaggatgtggagactgagagacaagttatgaatcataggtatgtcgcaccatagttgggaagcactattccaagttacagtgcaagcaagaataagaagcaaacaagagatgcctaagaaaggagaggggaaagatctgggcagattccaggaggtaaaggacaaaagacaatctgtgatgacgaacacagagagtgcttgttcagattatgtcacaagtcccacaaaagtccttgcccatttggaggggagcagtgccggtgaacaatgctattctctgtgtgcccacttatgcggccagagtatcacataatggtttccagttatactgtagttaagctcagtgaaaagatgagatttttaacagtaaatctagatgaataaactgcattttctgaaggctgcctttttattgaagttttatcaggacactagaaagttacaagatattttatgttgtaaaagaatagcttttcatccacttggcaaatatttattgagtaccgggtagcatgcttccaccacaaagatatttgtttttacttttggaaatttaaataattactggacaaatttctaaattcatgtctttttgaggcctgtcaagttctactccattaggagctatgttgctcctgtaagcacaaaaaggaaagaagttgaaatcatattctaatgttgcagaccatcagaaagcaaactatttgcctatcagaaaatagtcatattctagaatttccaaaagcaactatattgacaagtgcaaccagataaagacaaattttattggttttatttttacttttgaatctactgtaaaaggtcataagcctaagacagcaatgacctcctaatgatagacaaaagcgcagacctggccccagagagcagttagttcaggctaaaatctgcattaccttctaacctgccagacttgtaccatgactcaattgagggagttaatgtgagatgcaggatatagactattataaagagatatgaaatagtagtttcatcatgttagaactttcaattctaacaataaaaataactataccaatatgtgtatgatgattttcaaaccctgatcaatcctccgaataactgataacagctctgacccctgctctataagtaaatagataatctgaagcttagtggtgaagagacttaccagataaattagagctactacatatctaaatctaggtaacttgattcaagtcttatactttccaatggcaggccatttaagatgatgcttacactgcaattactggagattccatgtataaacctaccaggtcctatgcttggtgaactgaattctaaaggcaaaaaaggtttaggataaatattctgaatgccaattagcccaaagcaatgaaaaagcaaacaaggcccttactctaactcttttttatgtctaagtgatataattattcccttacacacccttctactctgtcacacacacaattaggaccttgtatctaatagccagttccaaagagactgttccatgcactgtagcactttgtatcagtgcactgattactacagttctgtccttgggcaatacgggtttcatatgcacatatatattttttcttagtattactgaacagcttattacaccattaatctcccccaatggtatgttcatataactcatgttttccacttgtttatgactacatacataattggagactttgccccaaattgctgagtttaggacacacaaattctatagcactggctgactctgacttcaggtggctaatggatgaccaccggtgacacagggatcccagtggcaggttcttcggtaccttggaatgtaacttgaccagcttggattcatttaaagcagttaattttctttaccctccatcttgcaattaactgatgactgttctgcttttgtggttgggagttaagagcagctcccagttaatggaaagcagcatgtgggggtggctaagagaatgagttctgaagtcagatctggacttgagttccaactctactacttactcagacaacccaaagattagttcatgacttggtacacagcaaatatttactaaatgttagctgttatttctagtatctattatgtgtcagacattaaacttgtgctttacaaaccccttaagcctcatgtgcaatgtgggtattattattctcacttatacagaccaggctaaggctcggaggggtgagctagctgagacaggaatcaaagcaatcctcccactatacttcccactacactcatttatcgttctctttgaaagagtaagtgatttttgccttttgacaagcttaaaacatctctcttaagaatgtccttcataatttgttgttctttaaagcaaagtttaaaaagtgattctaaaactgattctaaaagtttatacggagaggcaaaagacccagaatagccaacaaaaaaattaaaggagaagaataaaactgaagaactgacactacctgacctcaagacttactagaaagctgcagtaatcaagccagtgtgatactggccaaagaatacacaaatagatcaatgaaacagaatagagcccagaaatagacccatataaatagagtcaactgacctttgacaaaggagcaaaggcaatacaatggggcaaagatactcttttcaacaaatgatgctggaacaactggccatccaaatgcgaaaaaaaaaaaagaaattgtctttaaaatgaaatatagacacaggtctctactgttcgcaaaaatcaactcaaaatgcatcacaaacctaaatctgaaacacaaaactataaagctcccagaaaatagtgtaagcgaaaatctagataaccttgggtttagtgatgactctttagatatgataccaaagacacaatccatgaaagaaagagttgataagctggacttcattaaatgtaaacactttcattctgcaaaagatgtggtcaagagaatgagaagacaaggcacagactgaaaaaaaatttgcaaaagacgtatctgataaagaactatttttcaaaatatggaaaggactcttttaacagttcaacaataagaaaacaaataaaaaaatgggccaaagaccttaacagatgcctcatggaaaaagatatgcagatggcaaataagcatataaaaagatgctttgcatcatacgttgttgggaaaatgcaaattaaaacaaaaatgagataccactacacacctgttagaatggccagaatctgtaacactgacaccaccaaatgctggcaaggatgtggaacaacaggaactttcattcattgctggagggaatgcaaaatggtacagccactttggaagacagtttgccatttacaaactaaacatactcttaaaccatatgatccagcagcaatcacacaccttggtattgattcaaaggaaatgaaaacttatgtccacaaaaaagcctgcacacagatatttgtaacagcttcattcagaattgccaaaacttggaaggaatcacaatatctttcagtgagtggataactgtggtatacccagacaacggaatattatttagcactaaaacgaaaggatcaagccatgaaaagatatggaggaaacttacatgcctattactaagtaaaagaagccaatctgaaaaggctatgtactgtgtgattccaatcatatgatattctgggaagggcaaaactatggagacagtaaaaagatcagtggttgccaggggatgggagggagggagagctgaacaggtagagcacagaagatttttagggtagtgaaaatactctgtatgatactgtgatggtagctgtatgtcattacccatttgtacaatcccacagaatgcacagcaccaagactgaaccctaatgtaaactacagactttgataatgacatgatgtaggtgcatcaattgtaacaaatgtactgctctggtgggggttgttgttaatgggggaggctatgcctgtgtcggggcaagggacatatgggatatctctgtgtcttcctctcaattttgctgtgaacctaaaactactctaaaaaatgaagtcttttaaaaaagtgattatgaagacaaataattttaaaacgggcaaaggatctgaatagacatatctccaaaggaggtatacaaatggccaacaagcacatgaaaagatgcccaatatcattagtcatcagggaaatgcaaatcaaaaccacagtgagatgtcactttatgtccactggatggctataataaaagtcagataataacaagtgccggtgaggatgtggagtaacagaaagccctgtacactgctggcggaaatagaaaatggtgcagccagtgaggcaggtcctcaacaaattaaacatagatttgccatttgacctgggaattctactcctagatatatatccaaaagaaacatggacatatgttcacacaaaaacttgtagacaaatgttcacagcagtattattcacaatagccaaatggttgaaacaacccaaatgtccactaaataatgaatgaacaaaacgtggcatatccacacaatgggatgttaatttggccataaaaaggaatgatgtacagctacatgctactacatggatgaaccttgaaaacattatgctaagtgaaataagccaatcacaaaatgctacacattttatgattccatacatatgaaatgttcagaatagacaaacatggagacaaaagattagtgcctgctcagggctgaaggctggaggggggcttagggaaatgggggtgatagctaaattgtacagagattcattttgaggtgataaaaatgtcttataagtgactgtggaaatggttggacaactttgttaatacactaaaaaccaccaattgcatggcaagtgaattgtatctcaatgaagctgttaccaaaaaaagtgattacattcagctttatccttctggatactattgtcatagagtcttgtccttgtttattatgttcagtctttgactccttgactcttctctgtgtgtcctttttacatagagaaaagcctgtgcaatctctgatttttcctgtgtttttttttctttttttttttttggacatagggtctcattctgtcactcaggctggagtgcagtggtgtgatctcagctcactgcagcctcgatctcccaggctcaattgaactgcctgcctcagcctcctgagtagctaggactacaggcgtgcagcagcaccactcccagctatctatctatctatctatcttttattttttatttttttttgtagagacaggtttcaccaagttgctcaggctggcctcaaactcctaggctcaggtaatcacccaccttggcctctcaaaagtgctgggattacaggcatgagccaccatcctgtttttgtttcactggtatgagtaacagttgtagtgccgaagttcattattaggagatggtggcaatatcagcacactagtgtagaggctaacagcatggacttgggagccagaccatggaccacctctaccgcttactagcaggttccacttggacaaattatctaatctgttttaatttctgtatctcaaaaaagaaaacaatgaagaggtaatacattcaaggaccttagaaaagtatctaaactaagaagtcctcaaaaaagagcacttttcctcttttatttttactggtgtgagagatggttgcagagccaaaatttcattattttttaaaaatcatgaaaatagcaaaataatctctttctcatataacctgtttcccatctttgtgagttcctttcactatccaacccttaactgctgatcttctaggaggtctgatcttcttcccaagtaatctcatctactttcactggttcaacaactaccaatatgtatgtcattccaccaggtggtgtacatctgatgttgtctatcttatctgaccacctgcttgacaactctatgtggacatcccataggtgctccaaactcctcttcttcccccaactctaattcttcactgcagttggtggcaccattatcccatcctgtccctcaagacacaaatctggaaataactgacttttccaccgacactcatattccatctatctccagttcctgccaattttccctcagaactccgtttcatcattttttgctccaccttgggtgcatatcagaatcatatgggaggctttgaaagatccccacgatcaggccgaacttcaatccatttaaattaggaccctggaaactatagatttttcaagtttcccaagtgattccaacatacagctgagctagagaatttctgacttagcccttggcctgcctctcaagcctcaacttttatagttcctggctctgtatttccattctgacgatactgaaatgcttataattacacttccccaccatgccatttcttgtctttatcatacactccaccatcctacccaccaaatctggcttattgctacttatcttatggacctggcagttgcttcctccagcaagtctctcgttcaccaatctatggctgaatttggtattccttctctgtagtccttaagtgcctggcaaatatctatcactgtgctgaatatgctgttttataattatctgcatatgggcctaatcccctcaaagaactatgtaccacctaagacaatggccacttgacactcagttttgtatccccagcacctgcttagccttatgtaaacacttcatacatgttagttgaataagtttccggagatgaggaaaggctttttggaaagaggttgtttgtgctagatgttgacagatggactggatttagatccatatctttctttccacccaagggcttatacgaccaccaacatgattaactttaacactgcttaactttgatacctccaagcattcactgctgtttcttttacataaactcttattttgtactaaaagtcttactctacatttgcaatgagtattaatttgtaagttccatccaatctttttagaaaaaagttgcagtaaaacttataaaaacacaagtctattaccctagattatgttttccttacttttgtgagcaacaatgtattaaaatcaaactttatttcacttttgagatacatatgattatctccaatcaaattatcttcatcttgaccacttatacatttattttgccccctatgatataaaacaatttgctggcctgttctcatgagactacattaaggaaaaagagacattccaaagacatttaatcatgactaaataaaaacaattaaaagtaagttttaaagaatgtttcaaaagaaatacacaatacaactaatatagtttgtgttcttttaataaacacacttgcatagttatattacaattttgtaaaaataaaaacagattatctcatgccaagcgtgcccagcatttgcacaatctcaatacctttaatactataattttcaagacacacaaaataaaattttaaggcaaaaacagcactttgcaacaatttaataatttattacattacagtagcatcacagcagcattcaataatgccactttaggcaaaagtctttcagtatttccattatagattctgtttacaagaattcataaactggtaaaagtcattctaagaaaacctggcaaataaagctttggactggaattggtatttctttctctacttttctttcccccagtttctttcttttaaactacagtatttatattttaaaatgttttatttcaaaacatttaaatatcagttacatttttaatagttatattattttaaaatgactctttaagataaagttttagagaaactatattatggatagggctgatttacattctcaaattttctaaaaatcagctttggttttagaactgatttttttcatttctggaaaacctaaaaggtttaatcaaataatttaaaagtgattattatacattgcaattgcaatctttaaacaggtattttgattctttacctcctacagaaattcaaatttattcagttgaactcacattttaaaattctatgtttctgatgaactctaaccttctaatgttgccttctaagcaaattgaaagctgacttatactgaatgaggaagagaacaaatacttggctgaatgaggtattgcaaaagacagcatgcacttttaagaaagacttaagttattatgtcatatgatttccattctttttatctttttcttaaatacatgacaaaatacctacacaaagagtggtatttcagttaatatagtaaatttattttccagactgacattcagcttaaatacgccagtatatgatttaatccataggtacctgatgaacatattattttcaggttggttacagatgctaaacgctgtctgaaggtcattcccagtaatttatatttatcagtgtaaaagtgaagtgatttgaactataaaaatacgtttgaaataattcatcaatgtattagataaactcagtttcagaattataaagaaaaaaccttagaccaaataatgtggctgattaacagtggtatgatttctaccccgagggtttaaaaatggatttaaagtaactgtctttgaactcaaaagaatgcaaaagcagcaagttcagaaaataaaaggcaagaacaggtaattaatacaatttgggagagtcagttgaattcacaaggacccagtctttgcactctttcagtgaatgcaggcaaatctgttattctatctgtaaaatgaaattattgctttcctattaatgtcatatttataaaagtatcatgaggatgccaaatgctaaaaatagaggtggtctagtaactagaaattgccaccctagggagcacacatacttatctccctacatcctaataatgtgatgtattttggaacacagacattataactttatgaagttttaactgttgattctttcccaagcatcataaagttatgatttaggcaatgtatgactgaaataattcattcataatgtataggcacattaacataaatattgcacaaaatatgcctctaactgaaactgagaggtacaaaaacatatttcactctttgtaaataactttgtgaggaaatatgactctgtgattgtatatacacttttcctgatactttgacattcacaaacagtagattgcactgcagtttgtaaacattttaagttgcataaaattctccttgattttcaaatatagtataatactgtctactaaaactcctttttgtatcaactaagtactctcacatatattagtttataataatgtttgttattattttttaaagtgttttccattccaggaaaagaagtaaattcttatgtcaaagtagccaatatggttgaagaacaggtattagagaagtctgatggtaaaatcaatcttagagcctcaaagaagctccatgaacacagaggaatgccaggtgttacacagctttccttcactctaattcattcttgactagagcccacatgtctgttttggggacatttaaactcttaaaggatttcttatgatatttactaaatacattaagaagaatgtcaaccagtgcccctttgtatactgggacatgtagtcacctgattaaaacaggtaacaatgaactctgactttaaaatggattaagatataaatgctctaagctaggaaaggtttttcccatctcacagtcaatgatgggagcctttcattcctcaaaaataatccctttataggtcatcgaaaaagaatacacacgctgcagcacatgatgcagtaccttcattagcccagagcacataaagatcctaagcgaactaccataggacagtgctcattcttgggactggaacaaatgaaacactgcacatacctgccagagcaggccactttcctcttctctgagatttaaaaagctcccccaaaatgttgttattcccatcccaaatacacagaaaacagggcatggctgtttccagttcttggcctttaaacaaatctaaatgtcagtactcatagtggcatattacaaagtaataaacagtgcacacttgagggcaaaccacatattgagctaattaagagctcactgtgattaggattagatcaaacataatagcagaacataagcaaattttatctgaattctgtaaatgaatacacatgttgcaataacattaaaaaagcatggcagcctattccaaaccagtaagaatagtttgtgcaaatagtgggtctttgtgtgtttgaactcccaccacataagggcaaactcaatatgcatgctaatgacctacaattatcaaattaaaaaagaagaaaaatgctaaagatgccagagtgaacagcagggaaagccacacaaagacccactatcctttaactttttacaaataaatttaaactgtaagttagaaacacaaaaaaataatcacaagtggctctaacattcaaacgaagtaaacgaattgtgtaggagatatttgatcagggctgcctgccctgcctccacgctagagtgaaacttggatagtgggtctctggggtgctttcacaactggaagacaacattgggtcctaaaaaaagaaaatgaggaataaaatgaacataatgcaaattaggtgggtgagataaaatttgactagtaacaacatgcaacatcaactaaacaaatttgaactgttaaaattctctatcttaaaaaaagttctaattatgtaacaaaatgaaaaataatacttaaaagggccaaagaaacacaaatggtaatctataatttaactagctttcattgactattacaagaactacaaacaggtgattcatctataaaaagctgggtaggtacaacaaggatctcgtatctattcctgactttaaggattaagcattttctgaaccatatcctattaaaattataggtttatataaacaatgtgagttcatagctaccaacacaattaacattaatcttcatcttctttgaaaaagcaattatgattcttcaatttctgataaataattacttcaagtaaacaaaatcggtacgcctcactttcctagataatttaaacagttgttttatagaaacaataaaccatctcagaggaacctctttagaatttatccttagaattacagaattgagagcccttttattccaggatagatgacaagcctttagccattcatttaggcaaaacaataaaagtattcagtttttagatctgattaaactaaaaaaaacccacatatacccgccagaaacaaggtaataggtaagttactggtaataactttataacaaagagaaattcgaaactactcttattttataaaataacctcttgaacattttgttttcccagctgtcagtatgtaaaatgaccaagaaaatgatgagttcctccttgcatccccaacatttgcccttccagcaaacaattagtacttatccttcatgtaccagctcaaatatcttctgttgtatctttcacaacatgccttctttctccacaaagatttagggggtctttttccaaaacatatttgtataaatattcattgcagcaattgttatatttatctgaatgttgttccccactaacctctaaagctacttcagagaatggattgtcttgtcttgtttgtattcccagtactcctagtcagtacagagtagacactcaagtaataccaaatgatgaatttcttaaatgaacagtgggaagaatgttaacatagaatccaaaaccccccaaaagagtaaaacctgaaacacataggagctataaaatcattgcgtaggtcaataatgaccgaaagacgattattctttttcttcttattttaatctttcaatatttccttgtttgttttgagacagggtctcactctgttacccaggctggagtacagtggcatgaccatggctcactgcagcctcccacctcagcctcccaggctgctgggactatagggatatgccaccacactcagctaattttaaaaatttttctgtagagatgaggtctccctatattgacgatcagtcttcctgcctcggcctcccaaagtgttgggattataggtgtgcgccactgtgcccagccctgctatttccatgttttatttcagggagggcttgcattacaattggttgtcttctagaggcatgctgtctaatacaggagccacaggccacaagtggctatttagcttaaaattaaagttaaattaaattaaaaattgagtttctcagtcgtattagccacactccaaataatcaaaagtgactagtggccgctgtattggagagtggagatatagactgttttctgtattgcataaaattctactggatagtgctgtttagattgggtatctctctcaactacaggcagactaaggctctgccagttccacctatactaaaatagcagacgaagcattttctgggcaaaagtaatttgcatgacaaatgtgtccttgaataataactaacagatgatatcaatctattttctgtatcattagtgtattaaacatttactgacaaccagaaactatgctgcttctttttggaataaaaaattgtcactcaattaactctctgggaaagttacttttctaggagactgttactgccttgaagtagatttctctagagtaatttttaaattatctgcagaggggaaactgaaaggaccttcataaaataggcgggggaaaggtataagacctggggccatggtcctgtccttcctttcaaacagcttttatctgttctttatattccctattctatgaggcttaattggaaaaagtgtttcaaaccacaacaacatattcagaaaaccatcactttagatcatagatgctatagaagccaaatgtactgacacaccggcatgccttcagggatcactagccaaagatcttccaaacccagtaggtctgaaaagtcttttccattctcaacaccaagaaagatgccacagctagttagataaactggtttctaattaatcattgtgaactgccaaaccatcagcagagcttaaaaatgatcatttattaggcaacccaagttacaattttctttatcacttctgaaaccctccaatatttttgggactattcaaatcacaaaaaactggattcctcccatctccaagttgggaaacttagttgctttatgtaaagggaaggtttctcccagggtcagaactatctttataagctctaaagtgagaatgcacaaaattatagatatggtataaattcataatccttatactgaatcataagtgtatctgagttttgtttgggttaccttttatatattctcagcaactgaatttaaatgaaaggctaagtattttaaatttcataagagatatatcatgagatattttaaaaataaaactaaaaattaaaagagtgggaaaaagtgacaatcatttcataaaggtaaaaagttatttccaagtactattcattccctaatttattactaatgctatatttactgtcaaccaaaagaacggctagataaatacagagagataattttatatagtaccaaacttcacacttcgagatctggacccttgttctgaaaataatgaaatagaccttgattgatacatcccttgtggaaaaaggtgactatctaaagaatcacctgacaagaattttgcaacagtcaaatatttaatttttaattttcttccaacatggatgatatgtaaacagcgagaaataaatgagaaggttagaaatgtaatggcttctgtacactaaaagagtaattttgaataggtgaatagggtaattgctggctacttttttttttttttctcttgagacagggtttcaccttgttgcccatgctggagtgcagtgtgtgtgatcatgacttactgcactcttaacctcccgggttcaagagatctcccacctcagcctcccaagtagctgaaactacaagcacgtgccaccacacccagctaattttgctattttttgtcgagatggggtttcgccatgttgcccaggctagtctccaattcctgggcttaagggatcctgcgtgccttggcctcccaaagtgctgggattatgggtgtgggccattgcgcccagccactagctactttttattaaaccaaaaaagaacatgggacactgaaaaagaggatgatagtaaaaagaagctgcagtatagatggcagtcataccaaagaactcataggaaaaattatatactctcagattaagtctaatacgaaagtctggagctagcaagtatttaaaataaagctgtataacttctgaccttgtaaaaagtttccttttgtttcttctcactttaaacactaatctacatttgctgtgagtgctgagtttaagatctaatccagaaaaggaataaatgcagtgctgtatattgaagtttcacactaggtgagagaaaaataatttaatattactcacactgttgacttggatctgagtctgtcgtcatcttaacgtagtttgaaggaaagagaccagtcaccccgttgatctctccttgccaccaatcaggatcatctttgttcataacattaatgagttgtcccttggagaaactgagctcatcttcattatttgctgcatagtcatacatagcaatcacctgacatactatcacaagaataacaaaataacacattaaacaaattaattattcctgcaagggtcaatcatttgtaatctccctaggatttaaattattttaatattaaatattaaaattaggctaaaatttcccttgaactgctctttctcaccctccttcccctattcctggtcttacaaaaacaagaatttcccaactgcagttaacaatccaagtgaagtacttcactttaagtatgatggtgtaacaatttcacattgaaagatttcaaagagtcgaagtggttcaagtatcagtgaataagctggctgttcctacactgaacttttcagaaaggaaattctcagtggcatgtcccttttaagcagacataaggaaagaacacatttttaatgttttccaaagattgagctaatctaagaagttgctgagttttaacaaactcctctaaaatgaaatacaaattaacccacttccataccaggatgaaaggcaggtgtggctctttcactacttggacccaaaagtttaacatgactggcaggaaaccatcctttctgtcgcttttttcctctggcctaaaaattagcaaaagaaatacataattgaaagatgagattaaaaacaatcattgagacataacttaaaaattagaaaaaccataaatgtgtagtaaataatttaattttgcctaaagagaggtctggtttttgccctcagctcctggaaagtaatctctaaatccttggactatcctgactggtcagagtgtcttagtttacctgtgggtactgggtcatgccaaatctaacaatgtgatgtgctttgggtcatgcagtatcagctctaccttggtaggggatggagactgagttcagaaaaacgggcaatcaactgtatctatgtgaggaaccccagtcaaaactgcacaccaaggctttgctgactggcaatactctgtgtgtattgtcacacatcattgccaggaggagttaatactgttcatgactctgccaggagaggacaactggaagctctgtttttggaactctactgcactctgccccatgtgtctcttcccttggctgactttaatctgtatcctttcattgcaataaactgcaacatgagtgtaatagctgtagtgagttctgtaaagtccttctagtgacttacagaacttgagagtagtcttgaagacccccaaatttggaattggtttcaaatatgagcatgatcttgggggcctcgaactcagcattagcctttcaagtaaacattaaacaactggaagacacactaaaacatgcatctcaaactactgctgaaaacagcatctgaagaagtctatgtggaggtctttcaggctcagagttctcggaatatttcacaaaaatatttatattctaaaaagacatttctagagttctcctaacccttaaaatggtgcagccgactacaaatacttcttggagctttgttaatcattaatcaggaggtcagaagtaaaatttgtaaagagtcatgtttcccacttagttcggtccatcttcaaagtaaatcagaaggtggaatttcagggggttattcaagaaggtattaaatttgaacccccatttttcttcaggaatcctaagactcctgatttgcaagaatgaagctatgtttatcctccatactacaattatatatcactcatataaaaatatagctattatatctcttgtcatcttttaatccctaaaatgctttttagttttaactagtaaggaaataatagaagtgagagaagaacccttttcctgtatcaaaacatatgcaataaccatctattaacgttttagggaaaaaaaaaaggttcatctatgtctgtattgtctttaattgcactgctgtttcaaaaacctaagaccactagcggacagcccaattagtagtattttctcagcacaccatctagattatgtctttctcctagaggctatactgcaagcctgggactatcccagggaaagatgatgctgtttctttaagaacatgatctgtgaattataaaggaatgcattattggaaaacaattatgtctttggagaaaattattccttaaattgttacttataacatcaactcaactgtgctaaaaatgtacacacaagagactaaaggaaatataatgcagtaaaatattgatattgattacctctaagtggaatgattatgggtgatctaaaaatttttattaattttatcttttttatggagcatgcagtacttttataataaaatttatagatgctatttaaagaatattacctgtaactctccttgccaccacccacttgtatttttctttagaattaatattaactgtcctggtgcaaggctaagttgttcagaaccagaagcaacatatgctgaagttacctgagcaatctctgaaaagacaaagaagaaactatgaattcaagattgcgacagagcaaacacgttagtaattttttaagatcactactatacgtaccaggttttttatttgatgctccagacttgctagcactcccaaaactctacaaggaaaagataccgtgttgttttattatttccaacaatccaaatgtaaaagtataaaggttaatgggaattagagatttcaaattcccaggattcttttctctttaaatgaagatgaaaatgacaatgaacctcatgcagtattaacaaataagtgaaaaatccaacacttatgaggagatctggtctgctaatgtaatacattatatacgagtggctgtcatcgtcaaccattgactcaacaggaagagctcgttttctgaaacctaaatattaaacatgaccctccaggccaaatgcactccatttatcaatggcgttagcaccaatgcccactatgcacaacatatgtgtcctggatatgtcaaggtatacgttattttgctcctgctttctctaagggatcctgacttatctatggatcttgatgaacaggagacaatgtttttatttttatttattttaccatcctccccccaaactgactgaatctgacctaagaacaaaaaatccctatcctgtgtagcaactattacttctgtttcactttaaaggataaactggcccaaccacatttcctctttataggaatttgaacaacaaaagggatgggattaaaaagaattttgttctgttagtgaacatagctgcagtacaagtattaagcagagtggatggtagttaaaagctaacattttctgagtactgtataacagacactgctctaagaggttccatatattctgctatttaattttcacaataacactattaagtaattatgattatccccattttacagagaaggaaactgaggcacagaaaggtacagtaacttgtccaaggtcacccaggctctaagtgttacagctaagagtcaacccaggcagtctgattctactacaccaatggctctcagcatgtggtttgtagaacctggaaatagtccttgagcctctttcaggggtctgtgggataaaaactatcttcataaaaatactaagacattatttgtcttcttcactgtgttgacatttacagtggtgggtaaaatcattggtgctttagtgtgaatcatggcagtggcaccaaatgacactgaagtatggtagtgttcttcaccgccatgcactcacagtaaaacaaagccagtttcacttaataatgtctttaatgaaacagcaaaaattttattaaatcttaatcttcaagtccataccttttaaaagttctgtgtgactaaacagaagtgtgcctaaaacatttgtgctgcatactaaagtatgacggttgtcttaaggaaagtatttgtgtgactaaattgtccactcaactaggtttttcatggaacaacatttttacttcaaagaaccaacagaaaaactatttagacttgggatttagcgaacattttcttaaaaatgaagtaagcctgtcccttcaaggaaaacagctggcaggattttttgccaatgataaaattcaagatttccagggaaaattaaaattttagaaaatttgtacctaccactatgagtctgacagtttcctagtattgaaaaacttttctgatgagtggtggtattaacacatacgatttttcagatactgtgtaatgaaatgtgtccacacagggaatatctgcataactcagtgattcaatattttccaaataaacaacaaataatgttatcacatcatgcacgggtaaaagatccactcaacatgcaaaacagactagtgaattttaatgtaacagtaagaactgttcaccgatagggcttcagattccatgttgcaactaacctataacgattcagcatttgtcaagttttagtgtggtagaataaaaaagaacattggtagatatctgcaaatgctattaaaatacttcttcattttctctcatgtatgtgtgaggatgaatttttttatacttcaaccgaaaaaaaaaatgtcaccgactgaatacagaaacagacatgagaaagtagctgacttaattaagtcagactaaagagatttgcaaaaatataaaacagcctgtaatcccagcactttgggaggccaaggcaggtggatcactggaggtcaggagttcaagaccagcctggccaatatggtgaaaccccgtctctactgaaaatacaaaaattagctgggtgtggtggctcatgcctgtaatcccagcactttgggaggctgaggcaggcagatcacttgaggttgggagttcaagaccagcctgaccaacatggtaaaaccccgcctccactaaaaatacaaaaattagccaggcatggtagcggatggctgtaatcccagctattcaaggggctaaggcacgagaattgcttgaacctgggaggcggagctgtagtgagccgagatccagcttgggcaacagaactaaactccatctcaaaaaaaaaaaaaaataaaatatatatatatatatatatgtgtgtgtgtgtgtgtgtgtgtgtatatatgtatgtgtatatatatgtgtatatatatatgtgtgtatatatatgtgtatatatatgtgtgtatatatatgtgtatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatatacacacacacatatacatatacacatacatatgtatgtatacgtatatatacgtgtgtgtgtcttgctaaactttgttttcatgataaatacggctgtttttcataaaagcacgttatttatgttaccatgtaatggatttaattattgttattttaaaatgaataaatatataatttcgcttttcaaatttctgatacggtaaatatcattagctatactgaacatactttaaaaaagcctatggggttcctcaataatttttaagactgtaaagttcctgaaaccaaaaagagaacttctgcactataccatactggtggtggatgaaatgaggcaggagctcatgtaagctgagtcacattaatgttacagtcttaaagtgaaaattggcgaactacttcaaggtggtcctttttgtgtttctctgaatccagatctacttcctagcagttatcatgaagctcaaccctaccctacaactcttgttcttagaatttcatgaaatcttgccccctttatctaactggagccatataataaaccctattttaccggagctactgtgaacagtttctttgtaaccaaagcaacctgatcaaaaccataaacatgatctctaagtataaatcttgattaacaagaatgggttgattttatttttaataccaaaataatttaagtataaacctgattaaccagaatgggttgattttaatatcaaaatacctcttgatcctttggtttgacatagtttgatggaaaaattccacttctatctccaatacttcctgtccaccactctccatctttctgggtcaccaatatttcttcaccttctgtgaaagtcaaatctccaggttccacacttgaatatggataaagtgcaatatattctgtagggaacaaagcaaaaagaagtagattctggttttaagattacagaagtgaaaaagaaattaggttattctccaagacattgtataagtttgctgtaaaagaccttgtgccttcaggaaacctaacataaaaagatctaaaggtagaaaaaggaacgaagcaattatttaataattccttagaaaaaagttatttgacttaacataaaactttagagtttcttttattcccaattgtttatttttttatcacaaagaattacccaaaactacaaacagataatagtatctctatagataaatacactgaggcttagtgagattaagtcactcagttattcagataatggagtcaagataggaaaatatattttttaacttttttataccagaaatagtttaatctgctatattattttctctttaattcttttaagtacacagttatggaaacactcaatacccagaagacagcagcactagaagccaagctccatcctgatgacccagctcctagcacagtgcttgacttggagtagacgctcgataaatagttgttaacaaatgacctcaagggaaatatctaaatttttatatcgcctttgatttttgtttctgtgattgtcactgcttagaagaaacagttggtgacttggttttctaagtctttttctttctttctagttttatttatatttggccaacatggaatttgatcttaatatcataaacttgagacgatgagaaacaccacctacaacctatttactattcgcattcccagtattactcaattaatttaacaaaattcaaagtgattacaaggtttaggtacgctgcaataaaagtcgggtcctttccaacatgctcctcactactttcctaggctcagctcagagcactcattccacagtacacctatgattcagcttcactggtgacatgacgttcccccgttccttggctcatgccattccctctgtctagaagtgcattctcatcctttgtcactctgctagatcctactcattgtttaggatgatgcaacactgccatctctgtggattcatatgtcctactctaaattggttttgttcgctcattaaagaatttatcacaactgtatgctccattctattgtgagcactttggaaacttttattcatccttgtattttccaggctctagcatagaatcttcaacgtaacagatactgaataaattgtttaacattaaactgatatttttagcaaaacataaaatgtacctcaactattcaactaactttataatggacttatacatttcatttataaatgtatgtaactattaaataaaaatatcctctgaaattagggtaatctttcatttttcaacacattaacaaaatcaaaataatttactaatcaaacaacccaaagggatatagaaaaaaattctttgcaatacttatgataaagtataccttggtcctccttaatgattcatatggtacattgtaattaaaatgtataagcaatgaaatgtattgaaatttccttacctcctaaacatctataatcaataattgcaacactttttatttatgatgttattcatcaaaccagtctatgctgaattttcatagcactgcctttctaaagtgccaagtattttcacccatattttttctatattctcaatattcatgtgaaatagataggggcaggttttcctaatctcactttaatactgcagacacagaaatggggagaatatgcaactatgtgaagaacagcaactatgtgaagtcaggtagttagtcaagagctaaattgattaccatctaatttacaaattgccaaaagcttaccttctccaactgaataggctgccgaggtaggtttcttatttacagctgcatacaaagcttctggtctaccaaatatataaacaaacaaacaaacaaacaaacaaatacaagcaaaaataagaaaggtgatttgatgcacagcaggttttagtagtgcattttttagggctttctcaaattaaatatagtcttagtacacagaactgggaagacttatacacaacatcctgcaggattaagaacagcctaattataaacttctacatttttaaatatatttttaaaatttcaatatgatttacaaatagtttttcaaatgtgagatatttcgcctttctaaagaaacttaaaagacacccacaaattgttaagtggtaagcacatatagggcttagtttagtgtaggaaaaaataaaggcaatatatacattttattatttgtttagaatgcactacattaaaaaaataaaaataataaaactttgtttttattatctcagaacagctataacattaatttccattttaacccaggaatctgttttcaaaaatctagaagactgtcctgtttaactagacacctgtgggatgcaccaggcctccctaggacctgtgagtaaattacactgtgaggcagtttttaaataaacagaaggggaaccttattacaactactggtcacaactgaatggactgtcttgtttaatgctaaattctccattactgcaggttttcaagttatatgccttatctgttagaaaacactagtaactgaatgcatagttagaagaaatgccctctaaaacactgaaacaatctgtttttgcttaagttttcttctctgtaaatgttatggacataaaataagacaatttctataaaggaattgtctataaagggcctagcacagtgcatgcatacaaatgccagctatatatggttgttgttactgttattatattcttctaaatccaaaattcggccaggtgtggtggcaaacacctgtaatcccagcactttgggagaccgaggcgggcagatcaactgaggtcaggagtttgagaccagcctggccaacatggcaaaaccttgtctctactaaaatacaaaaattagcccggtgtggtggtgcattcctgtaatcccagttacttgggaggttgaagcaggagaatcgcttgaacacaggaggtagaagttgcagtgagctgagattgtgccactgcattccagcctgggctacagagtgagactctgtcttgaaaaataaataaaaagggctgggcatggtggctcacgcctgtaatcctagcactttgggaggccaaggcaggcagatcacctgaggtcaggagttcgagaccagcctggccaacgtagtgaaaccctgtctctactaaaaatacaaaaattaggctcatgcctgtaatcccagcactttgggaggccaaggcaggcagatcacctgaggtcgggagtttgagaccagcctgaccaacatggagaaaccccgtctctgctaaaaatacaaaaaaatttagccgggcatggttgcacatgccagtaatcccagctactcaggaggctgaggcaggagaatcgcttgaacccgggaggtggaggttgtggtgagctgagatcgggccattgcactccagcctgggcaacaaaagcgaaattccatctcaaaaacaaaaaaaaacaaaaattagccgggcatggtggtggatgcctgtaatcccagctacttgggaggctgaggcaggagaattgcttaaacccaggaggtggaggttgcagtgagccatgattgcgccactgcgctccagcctggccgaaagagcgagactccatctcaaaatcaatcaatcaatcaatccaaaattccatgtcaggctgaaaagcaaatttttagaaacagcactaccttccagaaacacagaaactcagcagtgaaagggtctttaaagattatttggcttaaccttttcattcagtcaattagaaaactgaagattaagtaggttattccttacagcctggcaaaaatagcagagccaaaactcaagcctcttgattgcaaaagaccagcatcttttcatcaaatcagactgcttttctaccaacttccatataaaacacaagagacagttacccatagctatattatagtacttatttccttgtattattatattcgacaacttgactccctacagagtaggaaataaaggtcagagacctatctagtttttagcttttttcatttgaaaattcattcaattgttcattcattcacgcctctcttcattcactcagctaatatgattgagcagctactatgcatgaggattagaacaggcatgaagaaactgaaaaatgaacaaataaaaaaaaagacatgcatcccagcctcattgagcttatgatctaataagggacattggtttaaaaaaatcagtaactataatgcagagtgctataagcaataagagaagttatattcagggaatcttggagactcagaaatgggaatgccccaatttggcaaagaggaggccctcagtaaagagttacttaaatattgacaatttatagtaaacaggggagaaatgcttgaaagaaaatgaaaagtaacttttctaactgatttatggtacaaagaagtggccaggtgaggtggctcacacctgtaattccagcactttgggaggtggaggcaggaagatcgcttgagcccaggagtttgagaacacagcctggggtaacacagcaaaaccccacctctacaaataatttaaaaataagccaggcatggtagcgtgcacctgtggtcccagctagccgggaagctgaggtgggaggatcgcttaaggctgggtggtcgaggctgcagtgagccatgatccaccactgcactctagcctaggcaacagagtgagaccctgtctcaaaaacaaaaaaagcaacagatctataattttgagtagcttgaaaattttatgaaatctgaaataactagaatgaaagatattctaaactgaaacaaatacctgaggtatgcttttttcatcctaagaattacctttcttttttctttttttttttaatacggggtatcactctgtcacccaggctagagtgcaatggcgtcatcttggctcactgcaacctctgcctcctgggctcaagagattctcctgccttagcctcccaagtagctgggactacaggcatgtaccaccatgcccggctaatttttgtattttttgtagagacagggtttcaccacgtcacccaggctggtctcaaacccctgggctcaagtgatctgcctgccttggcttcccaaaatgctgggattacaggtgtgagccaccacggccggccagaattacctttctgatattcaaactcaagtataaaattgttattttattatacactcaatcagaccatggctgactcattagtgaaaataccaacatccacatctcatgaaaacacataaagatgcttactcttcccgttttacttcactcccaggaatgatcttgacataagatttgggaaaccatcctcttcctccatgcacctccccaaaccaccaattttcttgctgctccaagacagtaataatgtcatgttttgagaagttcaagtggttatctttctttgcagtccaggaacaaagggcctgtgcttttaagttttctaccacttgtccctatgaatacaaaaccaccaaaaatttttaaaaggcaatggtaactatgatttctgtttctgtgtatataacatacttactgttcaaacagcagaccagttttgtgtcgtggtgacttaagataaccttagtctactaactgactttaaattatacatgatagacaactatgtgactagccttctgttaagacagactgaaaacccaccattcaaagaaacctcatcacatcactggtagagaaggtaaataatgtgtactcaagaaatgtattcacacatccatgaaatacatatcatggaacaaatgaaaaaggaatgttactgtaaatcttttttctcttccagcttgcaatgtaattctgtttactccactagggaaggaaattggcatgcttggctccctctgtttctctgcttttctcttaacttcctcctattctattctattcattcttctttctttccctcctctctcaaaggaaggagtgttttgttcctttaataaggctaaactcttcacttattctccaagtcttctattataccctttcattttctaaaaatatttaagtccttctcttcaatctacttctctacttgcttctacttctgaattccttaaatgatagtcttaaactttttttccaatttcactccttgatcacttctaatttaggttcagcactcatcacactactgaacctcttccagacaaggttattaataataacatcaaagccaaatgcttcttccaaacccttattcctcttgatctctaaacagctaacatcaagccttgtagttcctgaagctgactctctggtgattgatggctcctcttttgtccaacccttttcccttactgttccacaggacttccctaaatactcttaattatgcctatgacttctcaaacctatattttcagtgtaattttatctcctgatctccagacttgtatatcaaactgcctactgggtgtttctaccaagctgtccctaatacacatagcttaaacttagcatggctgaaacataatcatttttagaacctaccaaacccattcctcctgcactgtctaccaaagacaaggatactactatccttttggttgctcacgctaaagactgaagaattatctttaactcctatttcttcctcactctccacattcaatggattatctatttaatatcatttcctaataatcttctaaatctatctcctctttcttatatcttaattaccatagcacttgttcaaaccatcatctcttgttatttagctattgtaatatccttccttaactggttgttttcttctgctaatccagactttatgttagtgccagaattatctttctaaaacatacacaataactccactcttaaaaatcctcagggactttccactaccaagttgcctagcacggtattaaatgcttcccaaataaacctcaacctctctctccaacttcgcttaaccctttctccatgaatcctgtattccagccatattattaacaatgcttgtttcctgcaaatatcttgtgttaacatgccttggtgactttccccaaattgttctttcatgggaataactttccttctttgttgggtgaaatcttatctttgaagaccctactcaaataccttgccctttgtgaaggctgctccaattctcaccaattgagtaagatgatctcttctatatataccccctacagaccttgtagatatctttaatacagcatttctcatgctttacagttatttatatgtctgtcatgttcattagattatgatctactgaatggtgagtttctggtttttaaaaattgttttagagacggggctcactctattgcccaggctggagtacagtgatatgatcataattaattgtgcctcaaactcctggtctaaagtgatcctcccacctcaacctcccaagtagctagtactacaggcacatgccactatgcccggctaatttttaaattttttgtagagatgaggtcttgctgtattgcccaggttgatcttgaactcctggcctcaagcaatcctcccatcttggactcccaaagagctgggattataggcactgagtcactgtgcctggtgtcaatgtcaggtattttttgacttattttttccttaaatttctagcacataataaaatgcctggaacctatggccatggcattttttgagtgaaggtgaaatctggaggactttggactttattctgatgaagtctgcaatttaaaaaaataatgttaatgtaaccctattgcaatagttatatctaaatcagaggctaaatatacgttaaaaagttctaacgttcccaaataactttaagaaaaaaaaaaaaaaaccgtcaagcccaagtctctcatcttcttattataataactacaaatcaagaacaatatatcatgagatttgtaaaaataacattttgagcttagaaaccttagctgctagcaacttggtattatggaaaagaattgttgagaaacctaggccgggcgcagtggctcacgcctgtaatcccaacattttgggacgccaaggcaggtggatcacctgaggtcaggagttcgaggccagcctggctaacatggtgaaaccccgtctctactaaaaatacaaaaattaggcatggtggcaggcacctgtaatcccagctactcaggaggctgagtcaggagaatctcttcaaccagggagccggaggttgcagtgagccgagactgcaccattgcactccagcctgggcaacagagtgaggctccgtctcaaaaaaaaaaaaaaaaaaattgttgagaaacctctaagtaatagtcatttcttcaacttcacatcacatgtgaataagaaagaaactgaatgctacaaactctggttaaatgagtgaatggtcctttgtatataattttcattctattttaatcaggagcaaattcaaagaataaagcccacaaaaataacagacaacatacctgtccatgaataggtgatacagatccaggggacacagttcgagtgaaggctgattttttctgccatgatgtatttacagttaggtttgaaaaagatacattttgataatcagtcactgatgctggttgatttgaagaaagtggtctgcaaatataacactttgatataagtatatttatttgtttagaacttaatgaagtactaccaatttatcaacttacatattatatacactgtgcttacacacaatttgtgggaaaagaaataattattaacaaactactgacccatgttttcacttactaaatttcagtattaaatctggaacaaaaagtagtcttgaagagtacaacccggattacactatgatgaagtagtaggctgacaccattatatattaggtatttacacatttgcagatctatataaactttactgttagctaaaaacttactcagaggaagttgaggtagcagataaagaaactgtaggaggaagtaaggccttctttggagatacagctttttcattttcacttgatggcattttttctacataattgcatggaaaccagccaaaatttccttgaaaactaccataaagccaaccaggttctcctacggttttttcatcaacctacggaaataaaaagaaggattaacagtgcttagaaattcacacatttacaatggaaagagatgaaaactattgtatagtattctcattttcagaattaagcccatctaactaaacagctaaggcattttctacaaattaacagctactatttccagtgactggcaagttgtctttttaattttaattttatccaagttacatgaaaatattttacaaagacaaatagcattcattatatatggctaatgagggaaaacaatcctcccctatctcatggctccttatgccctgattttcactcctgacctgccattcttcctggtttcttctatatcaccatttatatttctgaataacatatttatactgctttttcttgaattttttcaattttagacattactggcttttggctatgggaaatgaagattgacctctctttcactgtagcctcttactctaccaatactgttatagcttaatctttatttaaatttatttaatgtttataatattatgattatgtttaaatatttcacatctgagtcatgcagcatgctgctgattaaatttccttttttgtaaactttttattctcctataatcattactttttttgtttttggcttacttttttctgttcctgttacacagtttttttgaactctctaacagaacaataagatcttctctgaatactattttccaactggtaaacatgtcaggtgatttatcaatttcattgcttctcccagacattttcatcctacagtgtgacatcctccatcctcacagtgtttctccctctgcttcttggtccttgttccttaaacactaaggacagcctcaagtttcatcactggctttctttcctcattctatacccttcctgaataagcccacttactcctatagtttgatcagtcctctgtgcaataatgaatccaagagctatgatctcagtgctgacttcttcccgaagcaacatgcctatactttcaactacttgcaagatatcttcaagtggatgtcccatgggaacttccaagtcaactttaaaactgaacttttctcctccatcccctccttctcctaaattcctctattattcacaccaccaaaaatttagtcattctaaataaaaaatctttggctcttacctcttttacacttccacatccaaactactgaatttgtcattaaagactcttctaatttgtcaacccaccctcactgccctacttcaggctttttttcatttcacactcaagattattatgatttttactcatccttcaagattctaacttcccccaacccaagccagagttatttcatacataactgtcataattagcattatatacattatatatgcataatgacacttaattatgtagctaatacataagtatatgtacttactacagataaattatttatatgtaaataatgacttatttacatatctctcttccatttgtccgtgagctttattgacccccactgtctagcatagtagaaatcacttaactcactgaataaatgaatatggtagttgtgtctctgttctccaatccattttccatacctttctaaaacacagacttgacagtgttatatatctattaaaatcatgttgaatccattcatatttttaaaaactgctttctcagatatcattaatataaatttcatgtttaaggtgttaaatttgatgttttgacatatgtatatacctgtgaaaaatcaccacaatcaagatagccaacacttccatcacccccaaaagtttcctcttgttccaccataagtcctccagcttgcccctccccatgaccttccctgccatctctacgaaaacactggcctgttttctgtcctatatattagtttacattttctaaaattgtatataaataaaatcatactatatgtatcctttttgtctgcctttttccactcaaggcatccatacagtaagaacagtttgttctttttttattgctaagtaatattatatcatatgaatataccacaatttgtttatcctttcaaatgttggtagacattaaagttttttctagtttttggctattacaaataaagctgctatgaacatttgtcttcatacggacatatgttttcaattctcttgtgtaaatacctaagagtggaatggctgagtcacatggtaggtacatgttttaacttttttaacaatggcttatggagatataattcacattccacataatccttccatttacagtacacaattaaatgcattttagaatattcaaagagttacagaatcattaccacaataacttacagaactgttttcctcaaaaagaaacactaggctgggcacggtggctcatgcctgtaatctcagcactttggaaggccgaggggggcagatcacctgaggtcgggagtttgagaccagtctgaccaacatggaaaaaccctgtctctagtaaaaatacaaaattagccaggcatggtggcacatgcctgtggtcccagctactcgggaggtggaggcaggagaatcgcttgaaccaggaaggaggttgcagtgagccaagatcacgccattgcactccagcctgggcaacaagagcgaaactctgtctcaaaaaaaaaaaagaaagaaagaaagaaacactatttattagattgtcatagctaagaaactgaaaaactttgagtaacccgaagttgttaagattttctctgttttcttctagaaattctacagttataggttcacatttgacatcatattttacctattttgagttaatctgtgtatatgttgcaaggaacaaattgaaattcatttttttgcatatgaatatccattgttccaataccatttgctgaaaagactgttctttttccactgagttgcttttgcacctctgtcgaaaatctgttgtttatacacacacacacacacacacacacacaaacacacgtagcatgaatctatttacctactctgttccattgatctattttcctgtctagatgctaatatcacaactgttttgactgctgtaacttttataataagccttaaattcaggtactaaaagatttccaactttgttcccttttcaaagttgttttgcttttgaatcatctcgtcatttgctacaaaaacaaaaagaaacaaaaaaaaaaaacaaagcctgctgagatttttgttgttgttgtagagatgaggtcttgctttgctgcccgggttgatctcgaactcctggtctcacgcaatcttcccattttggtctcccaaagtgttagggttacagatgtggatcacagcacctggctgcctgttaaagttttgatgtaaattgctttgagtctgtgtaagaatttgagaagaacagacttcttatctttttctaaaaaatttgtttacacaggacttaagagaagaactgacttcttatcaatactgaatcttccaatccatgaacactatatatctttccatttatttcggacttcaatttttctcaataaaactttgtaactttcaataaacaggtcttgcaaatcttttatcagttttatctgtatttcatatttttatgcaattgtaaatggtattttaaatttcaatttctgaatagtcatcgtttctatacagaactacaactgattttgttatattgatcttgtattctgcaaccttgctaaactcatttaaatagttctagtagcttaatagattctatgggactttttacatagattatcatgtcttctgcaaatcaatacagtctgtcttctccttttccaatcttgatgccttttactctatggtaagccactttagacccattaggatttttctcctagcagatgttgtctctctagtttaaagctcttaaaagttcaaacttcttagtgtagaatttgaatactctgaaattacagtttctttgtcaggtttcaacttacctttctagcttcatctcttaccatttgttcgatattctaggcaaatagttatatgacattctttaaaaacacctggcacatgcaagcctcaatgtttttatttaaggtattctcttctgcccagaatattacatggtttagaggaaatactacagacttgagagttaaaagaaccacatttcagtcttagccatgctacctggttatccttcgttaagataatgaatgctatcttgtgtgctttgtcatctacaaatttggggggaaatacctgtgctgccctcctctagggtatctttcagaattaaattgagtatatttatgaaggcgctttggaaactgtaaagcactaagcaaatataaggcataatccttcaaggccttcctccatcctatccttgggaaaaatgttccccaattctatttggttgtttttccttcattctctgggttcccacagtacttactcatataaattagtattgaaatttatcatgttatattttgtacagtaatacacatttcttttttttcctagactgtggtctccttattcatttttgtatgtcaccagaggcacatggttacaaactcaacaaatgttaacttgaatggattattctaaatttgattaacaatagacttaaagcttaattagtaataaatggattattagggcaacttcatttatgtttatggtaaataattctcattttaatgttatatgtctggctatttattacatcatgaatgaaatatttagaaaactcctaaaccagagctgctatggctaaactgtatgatgtcacagtaatgtagctcccataaaatggtgttctaaaatagttagaatgaaagcaaacacttatgaaatattatcctgtaaatctagtttaagactagtttaaaatagttaagtctgccaggcacggtggttcatgcctgtaatcacagcactttgggaagccaaggtaagagggttgcttgaggccaggagtttgagacaagcgtaggcaacatagtgagaaactccatctccacaaaaaaaaaaaaaaaaaaaaatagccaggtgtggtggtgtgtgcctgtagtctccactactcaagaggttgaggtgggaggatggcgtgagctcgggtggtcgaggctgtagtgagccatgatcccgccactgcactccagcctgggtaacagattgagacccagtttcaaaaataaataaataaataaaataaaatagctaagccagagcaatataaattcagacaagaatacaataaaccctgaggaattacacaaaccaaagtatttcaatgctgcaaaatgctcagcattgtacctgatttaaatgtattgtcttggacatggatgacgctgaaaaccatcattcccagcaaactaacacagaaacagaaaaccaaacaccacatgttctcactcacaagtgggagttgaacaatgagaacacatggacacagggaggggaacatcacacagcgggacctgtcagggggtgggggactaggggaggaaagcattaggagaaatacctaacgtagatgacaggttgatgggtgcagcaaaccaccatggcacatgtatacctatgtaacaaacctgcacgttctgcacatgtatcccagaacttaaagtataaaaaaaaaaaaaaagtatggtcttaaggaaaggaatcaccgtaagctatgagtattggctatatataggtacacatatgtacatacatacatacacacacacacatttaccacatttacttacatgcccttcctactttcctttctacctcccttcactgacggacttggctggctggctgacttttcagacagggtcttactctgtcacccaggctactagagtgcagtggtgcaatcacagctcactgtagccttgacctcctgggctcaagtgattctgccacctcagtctccacagcaggtgggactacaggtgcacaccaccaagccccgctaatttttttttactttttgtagaaacagggtcttcctatgttgcccaggctggtctctaacgccagtacctacgtgatactcctgcctcggcctctcaaagtgctgggattatgggtgtgcacctgcacctggccaaaagcttttaaaagtattaatttctagatacactttttcctagtgttttcaacctaatcaagaagaaaaatctcgttcatttattctgtagttaggccaagttgttttagtaagaggtcaattttaatctctttcacatctgtcatttatagttgtaattaatttttagttgttaatttacatactgagttaaactgaacattttatataaattctcacaggcctagcaaaactacttattacttcttcttaactacttattaattaatgttagcaaaatagcattaacagattagaaggctagaaaaacatttcagcttgtcatcgaaaatgtggccaagactcagtggaatttctaatccttttcactttcaatgaaacctccggtaacaccctcatccattaagttgatcagaccttgcctcctatcttaccgggaatttggaagtcctgggacctgacttcatcttctacttcagcaaaatttactttaatccctcccaccctttcttcctgccctctaatgacaaaggataaggtattcaatccttctaccactctcttccagggctccagattccagccttctagccttttcaagaatcttcctcatctccatctattagtcagaacagggaggtttgacaaggaacatgaagtgccttcctgatgctgtacgttctacacactgatctgaggggggcttcacagatacacagatgtgtacacattctttgagctgtatacttatggttgtacactttgctatatataaattatactttaataagaaaaaacaatctttatcagttatttatactctttccattatcattaacctgtttcctctctgcagatcctttctactattatttaaacttgctcaagcttcagccaactttaaaaaaaaaaaaaacttccctcaacccacatttctcattatttactaccttctctccttctccctttcaaagccaagctcattcaaagagttttatatattcactgtctcctcttcctctcttccaatttattccaactcactgaaatctggcttctcgctctactagtccacttaactgatactgctgtcctcaagttaacaacacctgtgctattgctaatctaataatttttttagtccttgttttatttcacttgcagatcactcttctcaaagttccctaacattaaactctcctgtttttttttttttcctactactagtcactccttttaaggctccacttcctctaataattccttcagtgtccatgtttctcaggaactgcatcctcaatcctcttctctctcacgttactactcccctggatgagctccattactctcatgtcttccaacaccatcacatcacactggcgacatccagatttacatcctcagcccagaccgctgcctgacatctctctaggtactctggagatccaactactactgcctggacatctgaaactcatacaaaactgaactcataattctacttatatattccccctctgattttccctcttaggaaatgacaccatcattaaccaatttgttcaaatcaggcaactcatgactgacagtagtaactcatgactaatacttcatgttaatgattcagcagagtacacaagcacccaagacacacagctaactttatgtttctgttgtcactgccaccagaatggctctctgaccatgggagaggtctgtgctaaagctggtagcagtctacaaccttttccttaccttccttcctctactgctttaggttgtcacgctttttcattagcctacaagcgtgttaagagcagagataatgtcttattcactaaatccctagtctaacatagtcagccctcaaaaaatatttgttgaaataaataaaaaatataaccaaaaatataagtaaactcttgaccaaacacgcccagagattggttgtatctcttcatccagacaccatcaccaacaaggagaggaggaatggtaggaagagcagacagtggacttgggctggttgtagaacaaacctctccccctgctcgggcacagctccggtactactaatagcggcaatggcaagagcaggaatgtgtgtttagggtttatcttgggtgctagcgttttggtaaatttttttccctagtatcattaaacatttgccacctaactgataaatcacactaactggtgacagtgcagggggagcgggggaaagaggcactggctagatactctggctagatactctggttaacattagtttaacaagaagaaaacagaagcagagactaaaatccaagtttgtgtgcttctaaagcctgtactctttccattatgtcctactggctctatcaaacactactcctgggatcttctcttattcatgtattttatatggattgtgataacacaataaagactttcgttccaaggaacaaattgcctgtatccagttagggctgtggaatctaactccttcaattcttttaacagttgctgtatggcatagcagaaacaacgctggatttggaaataaaaaaacacataactgcatcccattctggcactgcaatgctgacagttacaacttgtgtgagtttaagcttccttggctagaacttagttagtaataataactgtcctatgcagctctgaagtatgttgtaaagtccaaatgaggtaatgtttaagaaacattttacaaaggtaaatatatgaaattaatggtcaacattactacagaaactaatatattacaatgtatttaggttattcatgattaaaaaaaaaattcatttcctacctgaattatatctccagaattaaaactcatctcatcatggttccttgcttcaaaggggtataatgctctataattcaccaaaacactagctgtctcacctaaagagaagacaattgtcattatttgcaacttacatgtatacatctttgctatgactcaataaagagctctaaaacctaaaagaaaaaatcaagcaccaaatactacaatgaaaatccacttgatacagacttgctaggatttcagtatcttgactagtcatctaataaaaaagcaaacaaggatgctcatcttaagtaaggtaggaggcagcaaaacaaagagatgacttgcgggatgaagcacacacatgggtagaaaggaaagtgcaggagtgggggccaggctgagctgtacaaagtggaaggagaccaagcaaagagaggcttggtttgatctgtggaggtctgaatataacagggaagtaaaggacaaaaaggggggtctcaaaagataagaatagcaagttaacagggatggctgaagaaaaatctatacatctatcagaatggttctaaaaggaaaacagtggaagagtacacaaatatactgaatttgataagaataaaattgtttactttgttcatctttagaatgttttaacttataaaatttcaacaaactgtatcattaataatgattcaaagggttcatgtatctaaaagagatacaatactactaaaagtattgtggaaatggactgaggtgtatcaaaattttactgttgtttcattaaaataaatagcttagttatagtggttgaataaaatatttaaaactattttacttcaattatgaaaaccatgtctgagtcttttcacaatcagtagtaactatcttcttttctcctgctgtgctaagatttctactgctgtgttaagatttcagtctgttttaataagcctactgctttttatccaagtttaatttataaaaaggttttttctgactctacaattagtatctttctaattttcttccctttttttgtctcttatcaggtcatttttttcttgttgcatttgttctactgtctcaaagtatccttatccttacgttttttctcctcagctttcaaagtatccttatccttacgttgtttctcctcagctttccgttcctcttcttgaattttttcttgtgttttttcttcctggagtcgcttttgtttttcttcttcctcctttctaagattttctttccataagttttcttttccttgctttgctttcctttacataaaagaaaaagagtttgtataatgtcctagaaattttttacactaaataaaaacatactaagatctggttcctgtcaaggtgaagaactagcaatgaagtattagtacaggggtggggagaaactgctgagatcagaggtgaaaggaaaacaaatcaatcaatcaatcaagaaaagctttggaagctttggattgattagtggatgcactggggtgtatgactgacaatttcccacacccaaaaattccctcctgctaaccaacctccaaactcaagaaaaaaagaaaaaggttgaaatggaaccattcagcaaataaatctaaaaattacatctaagtttccttcctttctctccagatatttgacaagaactgtcttccagctgttattcccactgtcctatctaatctttgtttcaggggtttagtcattgttgctgtggaaataggaaatgcttctagaaaaacaacctacttttttttttttttttttttttaaagagagagggtcttactctatggcccaggctagagtacagtggttcaatcacaggtcactgcagcctggatctcctgggctcaagtgatcctcctgcctcagcctccaaagtagctagcactacaggcacatgccactatacctagccaactttttaatttcttttttataaagacagggtcttgctatgttgcccagtctggtctggaactcctggcctcaagtaatcttccctccttggcctccaaagtgctgagattacgggcatgagccactgcgcccagtctactttttatattattacttcaaaaagtcttttttgtttgcttagataatagagcatttctcctctctaggtccacgtgctttggtaaacatttcaatgaaatctaacacagctacagtttggtttccagccagtcaaggtgatctgtgatcaattattttagtattagaactcatgcatcttatagttctcctttgcatgtattttcacaaccttactcagaggtagagctgccaccacttaaatttagcaccttctccaagcctcagcactatcagggcagtgaagattacagctggaaacattcctgagatttgtcagcatatatacccttccaaagtgggaaccttggcataattccacatctctattccttaattcctgaaggaatctcgaaatcctggataattcaaaatattgtaggcccttagtcatcaatgctttctccttatctctcaactgtttcagacttcatactgctggttcactagcccatttactagattccttccaacaatttccaaacctccttcatcctctatcatgtcatagaatgcttcctccggcaactttcaaaacggacttctggttctcctgtgaggaaaatgcttctcttgcagtcctcacttaatttcaactaatatcccctttctcagttcctctgtaactttccgggacacttttccaagcctagtaattaatacccaattagctttcatttgaatttttatagcattataaatatcactatcagagtacttagcacatatttagcacaacaaaaaaaccagagggctcattaaattaaaattttctatatattttttaagctcttcattctttccatcaactcctcctgccaggtaatcatggccacataagtatgagactaggacaacctggataaggctccttgtttaatttaaggaaaggatgtcaggcccctctactctaggcttactgaggggtggtacttggctgagctcaacctgcaggaaatcatgccagaattctggtaaactttatgtaagagttagtagttgagaaaccggtccagtgccacaggatgcctcagaagctgggcaaagggcaaagaggccacaactaaaatgtgaaaacctattaccaataccttggggaaaagaagggaatatacctgggcaaatggccaatcaatccaagatgtggtactaagacccagcttcagactgagtaggtcctatatgcacttccgctctctttgatttctcttctctactacctaatgtgcaaggatgatgaatgaaattaaacgcatataactagtataatcttttggcctgaaaggaattgtgaacacgatgaagaaagattaaggtaactgcatatgtcaatagaaagttctgacataaggattagctgtggaaccactgcacagctcccttatgtaattaagtggtacaagttaagcagtaaataagagctgtaagagctacttcgtttgaactttactttctctacttctatattattctattatctcgttaggaggccacaaaaacaggggtctagatcaccaggcgcagtggctcatgcctataatcccagcactttagaaggccaaggtgggcagatcgcttgagcccaggagtttgagaccggcctgagcaacacagagaggcctcatccctattaaaattcaaaaaaaattagcagggagtggtggtacatgcctatattcccagttactcagtgggagcttaggcaggaggattgcttgagcccgggaggtcgaggctgcagtgatccctgatcataccactgcaatccagcctcggtggcagagcaaggaccctgtctcaaaataaagaaatgggggtctaggagtaaacaatattatagttattcgtttaactgtctgaatctcctattagaattatgaggagtaatccaaagtctaccagcatcacagccaacaatagccactcaaaaaaatgtgttggaggtggctactttgaaaccattaagaatagaggcctgccaaatggtaatgtgtcttccttgcctccctagtaactattagctttttcatagaaattactcatctactctttaccaaggcaaaaaaatactggttcatccatatttgttaactaattatactactttctgatactagaaaacttggaagaaagagaagaatgtattagaaaaagaatctcaatggcagaaaaataccatgcaaagtttctaaatgaataattctaggcttcagataccacaaatgtcttacttctccttactataaatggaggcaattaatatatctcaagtgataaaaagagaaatgcatcaatgtggcattctacattcagtattactatatacaattaagtattctgcttttatgatctttcaggaaactaatagatttaccaaggaaagatggaatgaatgagtgtttactatgtgcaacaaattatacttggctctttagctacattattttattttttaacttaagagacaaggtcttgctatgttgcccaggctggccttgaactcctgggctcaactcatcatcctgcctcagcctcccaaatagcttgggactacaggcgtgtgtcaccacgcccagttccagctgtattattttatttaatacatttacctatgagatatgcattattgtctctattttcagatggagtaactgaggttcagaaagataaaaataacttaaccaaggtcacccaggtagtaagtggaagagcaagaattctaatacaggtttgactccaaagtctgttatttttcactagtagaaaataaaatcagttactgcaaacttgatccctaaaaggactgaacttatgagatccagaatctgattaggataatccctttattttccttaaattttcataaactaaagatatgagcaacaaaattacaattctaatggcaatatagcacaataaatatatcagctatattaccttgcagcctcatcttctagtttctttttctgcattagttctaatcttttcctttcaatttccttcaacttgtcacgtttgatcttataaagctgttcaagggctaactgctgtgtgttgtaggtttctctcagttcctaaggagaaaaagaaaataagtcaatacgtgaatgatttaaatatgcttgtcatatgtattaatgtggcatttgcattaaaagataaaaatcctatagcaagttgaactaaatttaaaatatttaaagttttaaaaaatatctagatgataaaaaaaaccttaagtatttaaaccatatagctcctgagataaacacattaaaataatctacttttccatcagttcatttctacggaacacagaatctttaacaagccgatgctttgatttggtacatcattttcaattaaaaaaagcaatccattaaaaatatgggggaataatttgcttgttataacatctgaagagaaattttgttcagtcatgtttttgacatatgtaatttaaccaagttatttttatccaatatcatcttgaactaaacacagaattattaaataatttagttcaaaactaaaaatggaaaagatgtctgcctaaaatcatgaccaccatgagccaaaataatgaaaagcattccaaacaggagttgaaataaacaactgcttattgaacatctagttgtatgctaagtgctataaagcgttccaagaggatccaatacaaggctgactcccacgtctacagactttgtctttaaagagttcacaatctcaatgtagaggcaagtgtcaacatgcagggcagaggtaaattccttagcaggaacttgtgattatctgttcagcattttctcttcctcttcttcaacagcaccctgccttcctctaggaaactgatctttccaccttcctcccaacatcttacgtggttttaaaaggtctgccaaactcagagctcctcccattcccatcaggcacaattgtttactcctgacctaaacaatcacagcaccttacttccctgctcagaaacgactggtccaaaggacataagcataatccaagctggcccagaatattttcctgggattcacatatgttgaagtggggagaaagaaacctttctgcagctcattaaactgggataaagtaaacctggagctgcctcacaaccaaataagacctggggataggaataaaatcaactcagaaaaaagagaagtacagattagagactgagctggagagaaagggtactatagaagctgaatgttcaatatcatggctcggagacctaggaactgcccctgtccagcagcccttccatggattcagttagtggtcctaggatgcttctaataatcactcattagcttaactattttgaactagatttctttcatttggaatctacagaatcctgaacgagagagtagaaaaaggaggctggaggaaagaagtgggggcggggggacttaagagtaatcaaaagaaacttcatggcaaaggtgagagctggacaatatttgggtagaatgttttggtaaaaaatgttttttggtatcaacctatacacaataacacaactccaaactccatttcttttcagagataactattttataagtgaaccttttacttgattgaaatagtagatttgatctaagtacagcatgctgtccagagactatgtccaacatgtctgagcaaaacatttacaacttaagccaatagtaatgcatactgcttttatagcagaatttccacagctctcagcttctagggttttatttgttgtacctttctctaaattctattgaaaagcagaagaatatagtggttacaatatatagagaagcaaggtggtttagtgatgaggagcatgggtctggaataagactaacaaggcttgactcaggctctgtatactagctgtataaccttaggaaagttattttatagtttcctcatcagtaaaatgaggttaattatggtacaagggtgtccaatcttttagcttccctgggccacatggaaagagggaaaattgtcttgtgccacatgtaaaatacactaacaatagctgatgagctaaaaataaatacataaataaataaaattgcaaaaacaaatctcataatgttttaagaaagtttacaaatttgtgtagggctgcattcaaagctgtcctgggccgcatgtggcctgtggaccacgggttggggaagcctgttatgatacgtgcctcacagagttgttgtgaggataaaatgagttaatacatataaagtgcttattatagtgcagagcacctaggttctcagtaaatcttagttattattattggatgaagtcaaaaatgaggagagtactcagtctaaaaggagagtaaaaaggagccaaattaatgtctgatctcaacaaggctgcaggcttagccctccaacttgtcctttaaaatagagctctaagtattcctttactaaccctattccctgcagtgtcagagttaatgagcttccttgtgccattctgtatattcctctatcatagtgtcttctcttccaactatatgattgcctcctccactgaagtgagtttcttgacaagactgtctttcatcaaggtgtctccagccaacagagagtctagtacaacatggatatttaataaatatttattggacaaatgaaaaatgcataaacaatagtctatgcaaattagtaagatttaaagagcaccacaaagcttgccaagtatttcctctatttgactatggtgatgtaaaaattcctatccttagacctattcctctgggttaagtcactacttccaggaggtccttgctacacataatagttaagcaagaaaaaaataaaccaatcagaattcattaagagttgttctcaatcttttttttttttttttttttttttgagatggagcctcgctctgtcgcccaggctggagtgcagtggcgcgatctcagctcactgcaacctccgcctcccgggttcaagcaattctcctgcctcagcctcttgagtagctgggattacaggctcatgccaccacgcccggctaatttttgcatttttagtagagacggggttttaccatgttggccaggctggtcgtgaattgttgagctcaggcaatccacctgcctcggcctcccaaagggctgggattgcaggtgtgagccactgcacccagccaagttgttctcaatcttaacagaatgatagattatctcttttacgttaaggaacttctattactagtttgctaataagttttacttttaaaatcataaatggatattaaattttatcaaaaacctttcctgtatctaatgagatgagcataatctttttctcctttagtctgtttatatagtaaattacattaaacttttctgtatgttaaatcatctttgtatggctgaggtaaatccaacttggtcatggcaggttatgccacctgcaggggtattactaacgtagattactccagatccttggaagcatagggttaagacctaactccttgaaggaaaccacaattctaccattaacagattctactttccctctatggacaagcatttccccaatcattatctcaagtcaacactggttgactttccaaaatactaaagatattttggagattctgacaacccctttcttaagaagagtgagggaaagtaattttgttttttcacaaataacaaaaatatttgtatattcgtatataagagtttacaaagcatttccatctatatgcgatctcatttaatcacaagactttgcaaagaagacaggcagataatgtcagcatgttttgtaaaggaagaaagcaaatttggagggtaaatgacagatcgttacacaactggcaagtggcatggataagactagagttcacttttttagattcctaggccaggagttttcgttgcacttcactgctaaagatgtgtgaattttcttttttttttttttttttttttttgagacggagtctcgctctgttgctcaggctggagtgcagtggcccaatctcacctcactacaacctccgcctcccgggttcaggtgattcacctgcctcagcctcccaagtagctgggactataggcgtctgccaccatgcccggctaattttttgtatttttagtagagatgaggtttcactatgttggccaggctggtctcgaactcctgatctcatgatccacccgcctcagcctcccaaagtgctgggattacaggcgtgagccacagtacctggccagatgtgtgaattttcttaatggtataatggcctgtcaaatgtctcacttttgaatccactggctttgtcttagtataacttgaccaaaagagtaaaaatcattaattctgtacatgcatattgcaggttccagtaaaacataacattctaaattaaataattgaaatattttacttctgttgtcactacaagtagcctaaaggagtggtggttaaccccggtgctctactatcacaaaggaccacagcatcagaactaagtgcctgtcctgctccaacactaccaggaccagttccatctcacctactgataagacacagcctttcttctcattccttatcacctgaattcttatctctacagtgctgtttatcccttaatctgacccaatcccctactcattctctcctcaaacctctccactctcctggaacttcctctatgtgatcaggaaactatcatacagctaccaatcttctctgaacgaaaattctcttccctcgtcactttcttggctgatccctccggatactacttttctgctagtcctctctcagtttattatcatatactccatttacatcagggtcagaggataactacagtattttccttgctcttcactgccactttcagatggttatttccccctcactcttagcaactccatgcttttctggggctcctaccatccagcaataccattctctccttcctttttattgttatctattagtcacctggtcattcactcacctcactattctctaagtctttgacatccacataaatgatgcaatccaaacctcaagtctcaggctgatctcttcatcaatgacctttttaactctacttaatccatcactcccattattacaccctgagtcttactaatcagaaacagaactaccattgaccaaatatcccattcttcaaacgtaagttcttacccttcgaacttttcttatacctggtacatctatatcaatagggtttgtttgtttgttttttctgagacagagttttgctcttgttgccctggttggagtgcagtggtgtaaccttgcctcactgcaacctccacctcccagattcaagcaattctcctgcctcagcctcccgagtagctgggattaaaggcgcgtgccaccacacccagctaattttttgtatttttagtagagacggggtttcatcatgttggccaggctggtctcaaactactgacctcaggtgatcaacccgcctcagcctcccaaagtgcagggattataggcgtgagacaccacgcccagccatcaataggttttcaacctcactgagaccattctgttgactcccatcattctctttctttattaacaccccttcctctcttcacatccttcatgtctagttcatgtttcagagctcatcttgatcatagtgcttttgtcaagatctgtaactcttctgtccctctctctttgtgcatgtctattaaaacctcaaacctgtatgaaccatgaacctatttcatcagctttctctgtgcttatacctaaacagctgaacattggtgaggcaaaatcacacaattaggcatactgttttcaatttaaatacatcacctccaacttcaaaaagacattcaacattgctcagcacacttaggttttcctctactaagcttgcatatctgcactgagatgtctatttcatgcctatttctctcctgaaacttcctaatcttccatccattctcctcactaccagctataaaccttgcctcattaggccatcagactgcagccctctcaactttccatctcaaaaaaccaatagcactttctgcatctccacccctcttcttctggcctaggctgagttatatcatgtcctcctctacccaggaagattctttctgatggtccaacttacctctgattttaagtcttgaagctgtcgatatgggagtgggccagggaagtactgggtagagaaaggcgggtccctggctagggcttcagcctcgggcctatgcccatgaacctaggtgaggacaggcactcctgcctttgcacccaaatgttgcatcttccaagaccaccctggcctgccacgccaccatcctgtgcctacaaaaacccgagatcctaaaaaggcagaggcataagtggctggacgtcatgaggaccacatcggcagaagacgacacaagcagctggtcatcaagagcacgccggtggaagagcatgtcaacaggcaccagcaggccagcaggccactgaccagaggaacaatgcggagtttggccagagcagtgagaaatcaggttgcggcccgactccagggtaaaaccgtctcccttctggctcccccatctgctgagagctacttctactcaataaaaccttgcattcattctccaagcccacgtgtgatccaattcttccagtacaccaaggcaagaaaccctgggatacagaaatccctctgttctgtccttgtgataaggaagggggtctaactgagctgggtaacacgaaccgcctatagacggcaaactaaaagagcactctgtaacacacccccactggggcttcagctgtaaacattcacccctagacactgccgtggggtcagagccccacagcctgcccatctgtatgctcccctagaggtttgagcaggggagcactgaagaagtgagccacatccccatcacctgcccttcaagggggacaagggaacctttcccgttttactgtcaacttcctactctctaccaacaaatttaactgcattcataaccatcttctccccgtatgttacactgaaagtattctttttatctaatcctttaatctgtgctctccattccatcttaatctgcttcttcagggactttgctccatcaattaccacaatctcaatctttctctctttccccctgcctcctcctttcttttctctttactatttccttcaagtctttcttaaaccaaaaaaaaaaaaaaaaaagattttcctttgacccccatgcttttttcttttcattctaagagttgttgctactcacttaacccttcctcaactcttactcattcctgatccactgcaatccagcttctgcttatcactcaagtgaaatggcacttttagcaaggtcttcaaaagttttctttttgacaaattcaatggatatttttctttttctttttttttttgagacagagttttgctcttgttgaccaggctggagtgcaatggtgcgacctcggctcactgcaacctccgcctcccgggttcaagcgattctcccgtctcagcttcctgagtagctgggattacaggcatccgccactatgcctagataattttttgtatttttagtagagacggggtttcaccatgttggccacgctggtctcaaactcctgacctcaggtgatccgcccgcctcggcctcccaaagtgttgggattacaggcgtgagccactgcgcctggccaatattttttagcactatgttaactaataactctgtatcattttctagtaactacagaagacctcttttcttgctttctgtgacaacacagtctcctgactgctctgacagtatagatttcatatctctttagtttcctaaattgctctgatgaaagtatcaataagcagtgtaagtctggaaggcaggaagcagaaggaacaaagtaaaacaagggacaagaataactgctggcctgtggagaatcaaatgctaactcaaagaatcagactctgtgagggagaacagtccacaaatcatcattaaacttcactttacagatgaggaaacttagtttagtttctatgcaatccgtagcaaaagttctaaaaaccatataatctggccattcatgccataaccataaaggctaaaatatgggtcccctgctgctaccatctttccaatttgccctacttcgctcaggtaacaaatgaactctacttatcatgtttctgtcttcactgtggaatatatatgcatataggcaactgccctattgctatccattttagtactgagtaaaatgtgtagtcaaaatctactagagtcagcaagcagtaaacataaagcacatttctttaagctctattaaaatatttttaataatctacgttatacatggcaaagagaaatatttatataatttaaacatttttatctgatgtgcaagcatgtctaaatatgagcctggtaactagacctgactaaagttgcccctgcattattggttctttaaaattgtccttacaacagtattaggaagcagcttggtgcatatatgacataaacttgccctagatttcataaagtattaagttttattttaaacactgattttcagtgatatgggtaagtgatttaatctcacattttcctttgaattgagttagtaatcatctttatcagttaacccactcccagggatgttgtaaaggaaccaggttatatttctaagtgtcctggacttcttttgagaaaggttactgtgacaggcaaccttactgacttctggcattagactcaaacaggcagtcagatagcagaaggatattcaagcaagcagaaagaaaaaggcttatattgtatatgttatttcaaacaaagatactcagataaaggcaaagaatagtctagttttaaaaaaataaaacagcaaagtaactcaaagaaaagaagctagatattagaaaataaccttaagtaagaggaagaggttgttgagacagcttagcagagacaaaaggcactgaagaacagagtcatccatattcccacactgtaagataaggcagataaaaagccaattaaactacgtacagaatttttttttttttttttttttttttttgagatggagtctcactctgtcgccaggctggactgcagtggcgcaatctcagctcactgcaacctccacctcccgggttcaagcgattctcctgcctcagcctcccgagtagctgggactacaggcgcatgccactacgcccagctaatttttgtatttttagtagagatggggtttcaccatgttgcccaggctggtctcgatctcttgacctcgtgatccgcccgcctcagcctctcaaagtgctgggattacaggcatgagccaccatgcccagttatgtagattttttaaagaaataatatagggaagataagttggctggcttgtctaaccagcaatgacaaatgatttggttttctataaaatttttttctactgaacatatgcttgtgtaaagtgtattattaacattgttcacctcaaattccctttccttacctgaagccaccatgttgtcctttctttagcatgctgtttactctatatttgctgttaatgttattctaaataagtcagcatgataaaagccatatgaagagagagatttcttatacaaaagctttatgaaaagctttatttcttacagagaatagcttatgctctggaaactttatattgttagcaaaggaataactgagactattcccaaatttacattctatgccatgagcctgggtttttagtttctttcataggtatggcttcagtgtacaatgaatactgtggtgaatgatatgcagacagtctatgttttggacatctgctctgccactgcggcaaacaatgaatcattaacttgctttttgtgcaaagtttatagtgccagattctgttctagatttcactgattattgcattatttaacaaaggttaattaaattacacttcacaaggaaacaaaataaaaactgtgttaaaagagccactaacacctaaactatttcaaattttccatatttctcatttttgaaaattgcctaggataacgctggctgagatcagttctgtaatactgacaaaggcaattgttctggaaatgtatagatgccaagacaaacagcacatagtcatcaaaaattggaaactgtgataaagtatatgtttagttatatgacactatgtcatataactagaacattaaaaacaatcttgaaattcttgtatagttgaaattataaaataaattatgaaaatgtaatacatataatagctttagctatttattctattaaatcaaaataatgaaggtaagaaggcagttacctaaaaataaatagtatcaaaaataaatacctttagttgattgttaaaagaatccatttctgacagcttagatgcagtttctttttcaagagcatctaactgttctttaagtctttggcataattcttccttttctaatgattttttatgaagtaaactgacccctgaatctgaaaaacaaacatcagacagtttacattttgcagaagttcgtatgtcattaccagcatgtcatttactgtttggtcagattgatgtaactagaccaatacgaaggatgtatacacaatgcagaccagtacaagagaaaacattcagttgttatttccacttcccagattatatgctggaaagagcatcagaggaaatggttgtaagccttggttctgcattcaaaaggactaggacctgaagtgaaattctactttaggaaagatgcttcaccaatcgaatcctcaggcttttcatctatacaatgagcatcatgctacattaaatgaggtgatggatataaagccattgtacactctggtccacagttaatactcaattaatagaaactatagttaaagtagctttccatttattcttagtgctcccaagaacagggaaatattcacagcaaagattcagtaagtattactaactggattatttagtaacattattttaggaggtaagaacagaaggtttcattttatattatctttttttacatattcatgcagggatgaagaaaccagatggaaatatataatgcagaatacattacaataaattaaaatagcaatattatctgtttaaatgtctgtttttaactttatcatatttttgaagtacagaagtacaaaatttaaataaaatgaaacatacagagtaaaaaattaaaacacctccatttcaactgcaagttcatcccccttttaggcatttacatttagatgtgtacatactcaacttttatttccatgggttttaacagaatcatattgtctacattgctatgcaacttgttttcaatttagtaagatatcttatcaatcaggacaaacagatctagttcattcttttaaattgctccatagtagtttacattatggctactgcataatttatataactacctttctgactggtatgggtagatgttggtctgaacccactgatcaacatctacccattttcccctccctctaacccctggtaaccactcttctactctcagtttctgtacaggagttcaacttttttagattttatatgaaactgaggtcatgcagtatttgtctttctgtaactgacttactgcatttagcataagggagcgcaaatatctctttgagacagtaattttgtttcctttgaatatatattcagaagtgagattgctggatcatacaagagttctatcttattttttttagaaaccttcatactgttttccttaacaactataccaatttacattcctccaacagtgtacatgggttcccttgttcccacatgctcactaccactcgttatctctgatctttttgataacagccatcctaccaggtgtgaggtgatattatatttcaatgtggtttagatttgcatttccctgatgattaataatgttgagtccctttttaaatatctctttaccatttttaggtcttctttggagaaatgtccactcaggtcctttgcccattttgaaattgggttgttttttggtattgagttatatatattccttgtattttggatataaaccacttatcagatacatggctcacaagtattttctcccattccacagactgccttttcatcttgattgtttcctttactgtgcagaaactttttagtttgatgaagtcccacttgtttatttttgtttcctgagcttttggtgtaatatccaaaaaatcactgccaaggccaatgtcaaagagcttttgtcaatgttttcttctaggagttttacggtttcatgtcttatgtttaatccattttgagctgatttttgagtatggtataaggctccaatttcattcttttgcaggtggatatccagttttcccaataccatttatcgaagaggctaccttttcccattgtgtcttcttgatacccttgtcaaaaattagttgaccatatacacttgggtttatttttgggctctctattctatttcataagtctgtatgtcttgtaattgacaaaaaattgtatatatattgtatgcatgttgttttaaaatatgtatacattgtaaattggctaaggagctaattaacatatgcataatttagctaattaacataatgtgtatgttaattagctaggctctctattctgtaaatctatgtcttttgtaatcaacaaataaaaacttgtatttatagtacgcatgttgttttgaaatatgtatacattgtaaaatggctaaattcagctaattaacctcacatacttacctcacatacttaccatttttgtggtgaaaacacttaaaatctattctcttagcaactttaaagaatacaatgcactattattaactatagtcaccaggttgtacaatagatttcttgaacttattcctcctatctaactgaaatgttgatttcctttgagcaaactctcagtgatccccttttctctcaccagccctggtagccaccattttattctctacttttatggataaatatatacactccacaaataaatgaaatcataccgtatttgtctttctgcgcttggcttacttcacttaatgtaacatcttgcaggttcatgttgtccctatgtctgtttttatgccagtaccacactgttctgattactatagcttcataatatttgcaaacaggcagtgtgatgcttccaactttgtttttctttctcaagattgctttggctatttgaagtcttctgtgattccatatacgttttaaaattgctttttctatttctgtgaaaatgctatttgaattctgatattgtgttgaatctgtatattgctttgggtagtacagataatttttaaaatattaattcttccaatacatgaacatggagtatctttccatttatttatgtctttttcaatttctcccatcaattagttttcagttacagatctttcccctccttggtcaaatttattcctaagtatttaattatttttgatgctgtcatgaataatattgtttacttgatctcttttttgaatagttattggtgtaaaaaatgcaactgatttttgtatgctgattttgtgtcctacaactttactcaattcatgtattagttctaagttttattgcagtctttagggttttcaacatataggatcatgtcatctgcagacagggataattttactactacttttacaatttgaatgtattttattcctttttcttgtctgagtagtcctgctagtacttccagcattacgttgaacagaagtggtaaaaagtgcgtatccctacctcataccagatcttagatcaagcttatccaacctgcaggccatgggccacatgcggcccaggatggctttcaatgtggcccaacacaaattcataaactttcttaaaacattatgagattttttttagcactcatcagctatcatcagtgttagtggattttatgtgtggcccaagacaactcttcttccaatgtgacccagggaagccataagattagacaccccgatcttagatgaaaagtcttcagtttacccccattgattatgatagctgtgagcttttcataaatggcctttattatgttgaagaaaattccttctatatctattttttttgagagtttttatcatgaaaagatgttaaaccttgtcaaatactcgttctgttatttatggagatgatcacgtggctcgtagatttttgtctttcattctgttaatgcacactttaaattctgacagaaattgccaaactactattccaaaaaagctgttatcaacttatgccaccaacaatacctgtttctgcaaaccctcatctatattggatattatcaatcttttttcatttttgctaattggcaaaaaagaaacctgattgttattttaatttgtattttcttgataaccagtgatgtcaaagaaacatctatttatgtttctggccagagtcttgaattgttaggtcttatcctttgccgtatttttctattgggctgtcttaatttttgatttgtagaagctctaaattcttgtattacatgtacttcaaattttttagtgtttatgctgtctttcattatgatgttttcatttttaatcatcaaatctgtaagtattttcttcatgactctatgtattgtttaaagagaccttcctcataccaagattataaaatattttcctgttttataatagtttttaagttgtttttatgtttagcctcctaatttatctagaatttatttctgtacatagagagcggtaaagagctcctctgcaactctttcagataatccactgtccctcaaatcacttactgaaagcccatcctttccccactgatgttaagtgccaactttatcttatcctacgttgccatacatgcatgggctttcttctagactctattcaattccattgttctacttttctatttctgatcaataacacactattttaggcactctaactttcatatcttatgtttcgatatctgatagggttagtctcctcccccctaccaaagtttttctttttcaagttttgcctaatcttgtacaatttattttctagatgaatttgtcagttatcttcccaagtttcattttaagaaacccaaaaagaactgaatatataaattaggagagaactgacatagtattgatgtatagtatagtataatattaagctagttcatttaggaacataaaatgtctctaattattcaggaatcttttttttttattttgttttgagacagagtctcactctattacccaggctggagtgcagtggcaccatctcggcccactgcaacctctgcctcccacgttcaagcaattctcatgcttcaaccttccgagtagctgagaccacagatgcgtgccactacccctactgatttttgtatttttagcagtgatggggtttcaccgcattggccaggctggtctcaaactcctggcttcaagtgatctgcccacctcagcaccctaaagtgctgggattacaggcatgagccacagtgtccagcctattcaggaatctttcacgtctattagcgaagtgttatagctgcatatttcttcttcttcctttttttttttttttttttgagacggagtctcgctctgtcaccaggctggagggcagcggtgcgatctcagctcactgcagcctctgcctcccaggttcaagtgattctcctgcctcagcctcctgagtagctgggactacaggcgtgcgccaccatgcccagctaatttttgtatttttagtagagatggcgtatcaccatgttggccaggatgatctcgatctcttgacctcgtgatccgcctgccttggcctcccaaagtgctaggattgcaggcatgagccactgcacccggcccatatttctgctttattcataacaatgtatattactaataatgcatgttttaataccaaatttgatgacatatatgagcactatgttgggtaactggaaaataagacaaagaaacaacatggtagtacagtgggctttacagttagacatgaatttgagtactatgattgtaccatcctgggtaactacttaatctctctgaacctcagttttcctgagctcacaatgggaataataactataccaaagggttattgtaaagattaaaggaaagaatgcatcaaaactgactcacacagtgcttggcacatggctggtaatcttaaatggcaattgttatacagagaggcatctaagggatacagggtacttttcaaagcccaaacaaaagcttcctattttgaattggactatggctaaataaataaataggtaacagctgcactgaattacattccacagagaaagaatagccccatcacgtcctcaataagacatattctacattttattcacaattcaaataggaacaatgacaacaatgatgacaataataaagatatatttctgccactgtgcatatcaggtgggttagctcaccctgactctggaatgcctgtgtaggggtgaggtgggggctaatatactttgaacaggaaagaaccaagtataaggaacactgtctgagcagggacatggatagaccacatcaatggaaggcaggagacacaataaaaatagttcacaagagtgaacttcatttctgatatttcttccacgtgaagggccctgcactagcccaacaatcccagcttctttccttcctttcactaactagtgagctcaagttaaagacctaggaatgtacagcctaggctcctcctaagccctcactctctagagacttaactgcccacaggaaacctgcattctactttgttcatgcatccagtgctttataggtgcaactataccacccacagataaaccacactgcctagaatcagcttcatcaataatgaggcagtgatttggtttctcatttgtcttgctcctttgccttatttcttaatttgttcagaacttgcgcaaagaaggggatactatttattgaactttgtaaacagccaaaactataataaagagacctacaatggaataattgacttgatagagactcaatgagtgacattttaggatactttagtcagttgtaacacaacatctgcagatttacttttctttaaataaaccttgtttctgctatgcttttattggtatagtatccaatacagagaatttttttcagttttctcattgggacctgagcaaaaacaaaaacagttactatcccataaattatcctggaatgttttgttccacaggtgtcagagggccaagatggtaaaattctttgtatgaagcacagagttagataatataaagggtctgggcagagcataccatcctgcttaagcctatgactgctgcacgctaacaccctagaatcccaggtgcggccccaccataaagcctcctcctgaacagttctttaaaatcagtgcaggacttttcaaaatgcacatgtagtcttgtgttagagccaaatttatatcttatagtctaacactttatttgatgtttcaattatatacataaaaatatcatcaagatatgaagtcataccacaatcattactattttatttttatctactttttatcactaaaaatgctctaacatctgggatatttttcactttattttgaaactttaaacttacaggcaaaaagtgttatttataacagaatactttttttaattttaaaaaagtaacaatgtgactgatacagtcattcagaaaaggataaaagtaatcagacaaaccttagagacttaccaggtgtgttactgaactgcatgtttttaattctttcatttaataattgcttctcaggtaccagatagataagcttattctgatattccttataaaaagaaaaaatagtacctgattacaatgttataatattgtccaagagttttttttgaaaactttaaaacaggatttactcatctttgaaacttattttagaaataatacatagttgtaaactgcttacaacttatgaatcaactagaatggaattatgccaagaaatatttaagccaaaatcaattttgagtgactggctgaaattaaaaggcagtgaagaaagcctttgtaaatggggtgtgtctagaagcctacaattttcagcttactgatgaatgacagcagacctgcgctagatggtatgtgtaagcatgccatgatacttcaggatgaatatgtgtatatcaaagagggactaaaagctgggtgcggtggctcacacctgtaatctcagcactttgggaggccaaggcaggtggatcacttgaggtcaggagttcaagaccagcctggtcaacatggtgaaaccccgtctccacgaaaaacacaaaaattagccaggcgtggtggtgggtgcctgtaatcccagctactcagaaggctgaagcaggagaattgcttgagcctgggaggcagaagttgcagtgagctgaggtcatgccactgcactccagcctgggtgacagagggaggaaaaaataaaaaggactaaaaactaggaaagcaggtttaaatcagacagaaaatatttttggcttttgtttatctctcctgtaacaaagcaaaaagactgattaattgccagtccatgcagtaagagaaattgggtaagagaactctagagatgcagaatgcttccacagccccattctgcaaatagtaattattgaaccagaccctactgcacaagtaaggaagagaattaccaggaccccaagggacatattcaagttctcatcataattttaaaaagaataactttaagtcaaaatttcctaaaattagtagcaataaccttattttaatgtatgatatggtctgaatgttggtatgtccccaacattcatatgttggaacctaactcccaatgcagtactattaagaagtagggctttaggaggctccacactcatgaatgagatgactgtccttataaaggaagttgaagggactgccttaccctttctgcatgtgaagacgcagcaagaaggcactagttttaaaggagacagcaagccctcatcggacactgaatctgctaacaccttgatcttggacttctcagtctctagaactatgagtaataaatttctgttgtttataaattacccagtctaaggtcgtttgttatagcaagtaatgaattaagaatgcataaacattgttaaagagttaaaactcaaagtgataaatgtccacttacgtatatatattaagcaaaacttaaccagacgtctagcagagttttagtaggtctatggacttcctgatattgtatacaggattgcgtgtatttagatcacaagcctatcaaagactcaaggttattgacccccaaaacaaaactctattagaagaactgtttcgttttgttttgttttgagatggaatctcgctctatcatccatgctggagtacagtggtgcgatctgggttcactgcaacctctgcctcccggaatcaagcgattctcctgcctcagcctcccgagttgctgggattacaggcatgcgccaccatacccagctaatttttttgtatttttagtagagacggggttttgccctgctgactgggctggtctcgaactcctgacctcaggggatccacccgcctcagcctcccaaagtgctagcattacagccgtgagccaccgtgcccagcccagaagaactattaattgtacatgtttaagaacaatttagcagtgaaggacttacctgaagttcctgttgaagttgcttgatttccataatttccaagtcacactgcttatccagaacttccagctcagtcttttgagtttgctttttgagtcggacatcctgaagtctgcctgagatctgctgatgtttgccattctataggaagatcatataaatatatagtaacataaaatgctaatagaaaatgtttctacaaggagaataatatttttagttaaattttaaaatctcagttatcattcatattcatcctgaaacaaatgcctaaaaccaagtggaatgtgtttcagagttgtgtctgttaactcgagttattagtgggaaacacatcattctcagagtgcaagagcccatatgttagtatgggaaagcagaaacataacacattgaatttttttctgaattcagcattagacaatattaattaacaatattaatatcagagacactctcaaagaatgatgaagaggaataaatgtttgcatgtgatgctcggcattaccttctctgaacttctatttctaccctaaatatggccatctaatttcctctaattaaaacagtgcccaggaggaacgttttggcaacagttctgttctatactaatattcttctccttttttcctcttcttctgtgaagaaatcaaacaaatagcagagattctcaatgggacctaagaagaagggtgacatggggggttatgggctgaactgtgtcccccaaaattcatatgttaaagtcccaagccccagtacctcagaatgtgacaatatttggagacagggcctttaaagaggtgattaaggttaaacaaagtcatacaggtggaccctaatccaatctaactggtgtccttattagaggtggaaatctgaacacaaaaggcaccagagataaaatacactcagagaaaacaccatataaggacacaatgaaagatggccacctgcaagccaccaaaagaggcctcacaagaaactaagcctaactaaccttggtcttagatcttaggagctgtgaaaaaattaatttctgttgtttaagccacctagcctatcgtattttgttacagcagccctaccaaactaatacagtggagtgaggggaaatgacatcctgggttaaaacttactgatgatgaaaagttttactgaagactgtttcatatttgaaatacatacactgaaaggaacatgtgtatctctgctggagctcacattcttatcctcaacatgggatacgtataggctctggacctttccagactctgcacattcacctgtgttactgtgcttcatgtgttgcaccagttcttgagggaaaaacaatcaatcttaaggtctcttcccattatatatagtcaagatgatatatatatataaaaatagtgcaagagagttaaaagttttttacaactgttttgtagtactctggcatgattaatacttgtggtatgtatgtctatccatttgaaggaataaaataatatatttctgactaaagatattgtgatgattaaaaaaataatttttaatgtaattcaagtcatcaaccaaataaaatgttagactatgatcacacaagatctaaatctggctctactacatgactaggtatgcatttttgtaaaaccctactatatgatcagggtaggctcatgggattctagggttgtggcagaatagtgccagatcttttataccttctcaccacacatttcaaacaaagtcttttaacaacttgaccctctaacatctgattggtaaaaactgcttagtggccagtattagctaagaactacaatcctgcagaactggaactgtaagagatcatttaggtcagcagtttcaaatcagttgtctttttaatagtagaatctttttttttccaagcaaatcttgagtgaaaccccaagaaacataaagcacataaatgtcaagcttctctgttgtgaagcgtgggaagaattagggagagaaaatcactgttctgctgcccgagcttcccctctcctgcctctgcttagtcctcctcagaccatcttacagagaccaatctgaaaactgaaaatcactcaactaacacaactctttatttcagacaagggaaaagtgaggcacagagaagggaaatgtcttgcccaggagtacatggttcatcagtgtctgaactgatgctacaacataattctcagcattttgagtcattatccttttctcagtaaaccatattgtacagtctgtttatatgaaaatgtgactaatgacattaagacataactaattcacgagagattttaaaacacaattacatttttcttttttttttttttgagatggcgtctcactctgttacctaggctggagtgcagtggtgcgatcttggctcactgcaacctccacctcctgggttcaagtgattctcctgcctcagcctcccaagtagctaggattacaggcacccaccaccacccaccacggccagctaatttttgtttgtttgtttgagacggagtctcactctgttgcccaggctcgagtgcagtggcgcgatctcagctcactgcaacctccgcctcccaggttcaagcaattcttctgcctcagtgtcccaagtagctgggactacaggcgcacaccaccactcctggctaatttttgtatttttagtagagatggggtttcactatattggccaggctggtcttgaactcctgacctcgtgatccacccacctcagcctcccaaagcgttgggattacagtgagccaccatgcccagcccacagctggctaatttttttttttagtagagatggggtttcaccatgttggccaggctggtttcaaactcctgccccagttgatctgcctgccttggcctcccaaagtgctaggataacaggtgtgagccaccacgcctggcccacaattacatttttcaacaggtagctccatcatcattcagataaatttcacttaaacttcagccataccagtgcttccaactcaagatgaagattcttctttttagagtttaacctgacaatttcttcttgttctctattcttttgattgagaagctcctgtcgccgaattctctcccattctaagcgacgttgtcgttcaagttcctgttttgctgcctgaaaaaaaaaaggaattatacttaatttttaaatcaaaaattttgcacgattcaaaaactgggaagacaacaataaaagtcaggcagagtttagcacttagtggctttagtgcctaagggtagctaggcaaatctagttttattaatgggcttaaagacttccaagaaagtggcttcatctatcatattttctcatttcttcacgagatcttttttttttttttttttttccagacagcatcttgctctgtcacccaggctggagtgcagtggcaccaccttggctcactgcaacctccaccacctgggctcaagcgattctcctgcctcagccccaccaagtagctgggattacaggcacacaccaccacacacctggctaatttttgtactttttgtagagagagggtttcaccatgttgcccaggttggaagaccatccttttgttacagtcatttttctcttaataagttacagaatgacttcataaatataaatgttaacaggaataattttccctctattctggtatctgggggaaaaattctatttatattatttcagtgtgcaataacttcctgtgctccatccctggccctttaaaacacagccagtcctcctaaggacccttctttcccagcaacactatcccaaaggcctgtgcaagcccatcctcttgattcctctctagagagactttcaatgcccagctctcatctttctgtctctccaattccttggactcttaatctggatcttaaacttgctttcgtctaatgacttgctcagttgcctaactaaccttagctcctcactcaacttagctctgcagtcgatcctcctttgattgagatatcacctgcagaggatgctttctctaccacgtaccagttctgaaaactccttataagcaagaagcctctttccctcctcaagggaaggaatgatcagatttgtatagggtaagaatgaaatgatgcagagcaaaaggcaaaacaaaaattcaaaaataagcattttttaatcaaatgaaatatagtcacttattaaatgtaatgattttcttaagaagtaaaaaacttaaaaataacctctcgtctttctatgtcttttctcctttcttcctctcgttgtctctccaattcccgttgcttctctaagcgtttttctaattcaagttgtttcttccattcttgttcttgtaattctctctgttttcgttcccactcttccttttctttctgggctttacgttctgcctccctttgttgctgctccatcaaggcttggcgtcgcttttccagctccatgttccctcgctcatagttggctttccgtttgtcctcaaaagtaactgaacaaggtatgcctatcagcatccacacacattaacagcctacagaacctgtaatctagtttctatatacttatgccttgtgatcatttgagtgctatcagtatttgaatacttctcctaaggataattttaactcaaatctaagtggaaaaatatctactttcttcaaggatattcaattttagaaaaacaaatttttaagtttgaatccaatcaagagagaaataatttttataaacttgccaataaaaatactttttcggttgggtgtggtggctcatgcctgtaatcccaacactttgggaggccaaggtgggcggatcacctgaggtcagcagttcaagaccggcctggccaacacggtgaaaccccatctctactaaaaataccaaaaattagccaggcatagtggcaggcacctgtaatcccagctactcaggaggctgagacaggagaatcgcttgaacccaggaggcggaagttgcagtgagccgggattgtgctgttgcactccagcctgggcaacaaggaaaaaaaaaaaaaactttttcaacttttttctcttcttcaaggacaatcaaagctgtgtggttatacatttgttttgatgtcattaacatcctaatatattaaaacagctacaaatgtattctttcaaccaatatttaaatgtttttaaaggtaaagatttcattacaaagtttcctctaataactcagcctaaattaggagaaatactttaactcagatgtctataatcctgtcaaatacatctaactgtctcttcttccttcacactcttctcattttgaccatcttaattttatcaataccaaaatacatcccatctatcaaatagttttttctcatatagcacatcaaatattaaaaatataaaaattctaaatattccattacatttaaaggtagaatttaaaagaactcagtataaatatacaactttgacactcagtgatacctggtaatttcttctgaggctcctcttcttgcattttctgatatgaaggcagagttccattaatggaatcaatttgctttcctcctctaaaaaaatcaaacaacaaagttagcatcatgtagtctggacattttcagactagattacacagactaccagtgattatggcaatttgatattgggaatacagtattaaagatatttaaaacagtttggtatgtcgttacaaaatacagtagtatatggatattcaagacagagaaatctggattcaaatcacagttcagctaattttggttcttgggcaagtttttctttatctctttagtcattagcctccttatgtataacataatgaaaacacatccacttctttttttttttttttttgaggcagggtcttgctctgctgcccaggctagagtgctgtggcataatcacaacttactgtagccttgaacttctatgctccagtgatcctcctgccccagcttccagagtacctaggactacaggcgcacaccaccacacctggctaattatttttatttttgtagatacggggtctcactatgttgtccacgctggtcctgaactcccggcctcatgtgatcctcccaccttggctcccagtgttatgattacaggcgtaagctgccacgcctggcccacacctacttctaatatgtacccttttcaagtataacttgttgaatactaaaatcaatggcagtgcaaatatttaactctcttctaaatcacatctgccaagttatcaaaaccatagttctccacctccaggcacactcacctgaaagatggaggaacaagctcaggaggtaaagtcagtggtaatggctgtccagctttggccatgtcagtaaggtgcattgcaagaataaactcttctgcttttagctgtccatcaccatcaacgtcagccagagtcctaaagaaaatgttaaaattcacaacttaataaagtctatttggagtaaaatattgccttaaaagttcaatttttattttacttttatttatttatttatttatttatttatttgagatggagtctagctctgtcgctcaacctggagtgcagtggcgcgatctcagctcactgcaagctccgcctcccgggttcacgccattctcctgcctcagtctcccgagtagctgggactacaggcgcccgccaccacgcctggctaattttttgtatttttagtagagacggggtttcaccgtgttagccaggatggtctcgatctcctgacctcgtgatccgcccgcctcagcctcccaaagtgctgagattacaggcgtgagccacctgggcccggccaattttttatttttaaaagaaggataatgatggtaaaactgctgggtacacttattttagtgaaatgtaaatacgtacatttacgtaactcactattgaatgtaagtatgtaagtatgtacttcaatagtgaattaattttttaccgttgattttcaagacataaaagagagggaagaaactttgaaacagaaagagaagtaactaccccttctgagaaagtggcttgtcttactccatggttaattcacctaccaaatcacatttacctatattaaaaacaagatattctctgattctccatagaagggattagatgaaagaaaacaacagtttttctagtaaaatatagtcatgaactgcataatgacatatcagtcaacaatggactgcatttataatggtggtcccataagattataatggagctgaaaaattcctaccacctaaggacactgtagctgtcataaagcaacgcattacctatgtgtctgtggtgatgctagtctgaacaaacatactgcactgccagctgtagaaaagtacagcatatacaattatctacagtacatacactcaataacaataaacatctgttaatatattactggattatgtatttactatactttatttttattgttattttagagtatactccttctacttacagaaaaaaaaaagttaactgtaagacagcctcaggcaggtcagtcaggagaaattccagaaggcattgttatcataggagacaatggctccatgcgtgttattgccccgaacaccttccagtgagacaagatgtggaggtagaagatagtgatactgatgatcttgaccctctacaggcctaagctaatgggtgtctttgtgtctcagtttttaccgaaagtttaaatagtaaaaataaattttaaaaacaagaaagagcttaaagaataggatataaatatctttctgtacaatgtgtttgtgttttaagctaagtgttattacaagagtcaaaaagttttaaaaaattaaaaggtttacaaagttaaaaagttattgtatgccaagattaatctattgttgaagaaaatattttttgtaaatttggtgtagcttaagggtacaacaacattctgcacaattacatttgcctccaagcttaatactaactttcaaatggctgcttttatagagcatctctgagtcacaaacttttacagaaacagtatctttcttgtaataggggagagagagtttaattaattaatgcatagttaaattaatcaaatgtaattaagggacaaacttaccaaatagtagccagctgagtttgagaaagatttgactgaagaagggcatttctagcttgaaaacctgattaagtggggaaaatcataaaggaattctttagcatctttaaagttatgcataacaaattagctgtatctgtaaaataacaatgctaccagggtatcctgggaacttttaacatcaaaatgtttttaccacgtgctaggtgctaagcattcagtagcaattaaacccagtcactgccccaaggaattttaaatctagaattagcagtatcaagtgctgtcccctgtcttttcagcaagataataatacacacaagtggctaacgtgaaagaacaagatatcaggcacacagagtatcagaggccaagactgtgggccctcttgtactcccagcaggtgcagcacttcccactcctacgtgactgagccgtgagtagcagaagagtcaggcgctactctgggttcagcctgagtcaaggcctgtccaaaacaactcttacacaagagattacatctgccaacactgcctcagcaacagctccaactacaacaaaagccagccaaatgcagctagatttattgtcccactaggctttcaacataggacttgataatcaaagcaaccatgtattacaacatgcagctaaatgtttatattttataacttttaaaatattttcattctatttttttaatctggacatttaacataaatcacataaaaacactggaaattaaactcacagcctcgccctattaattactcctcagatttcacttaggaaatttgatttgaggaggtctttgtgttaaaaggaagattcttctaaataagagagatggaaggctatttcaaacctgaaaaaaagttcaaaactactatttcagcttttggaccgaaaaaagatccttttggactgaaagaagatcccttagcatcaggcaatagagcaaacagaagagagaaggaggaggaatgtaaatggttaaaaatcatactcgtggagggctttatatgtgtgaggcaaagtctgagtaatacaaagggccatagagagccaacagagtatcttacttactaagtaaaactcatttgaacatgtatgtacactcttagtcggccaagcctctggatatcctatatcctctgcttagaatgccagaccctcaattctttactttgtagtctatcctctgaaatctggctctaatctcttttcttctgtgaaacattctctcttatatccttggagttagtcactttctcatctatattaatcacagcacttttaaacaagtaaccaaacaccttgattacatgagctcttcattatatgggctcttcaaagatatgaaccatgtcttgcccctgtctgtattcctgtgcctaagagagtgcccagaaagtatgtgattcaggaaacagttacatcaatgacttgatctaaataaatttttaaaaactatgtttagggggaggagaagagaagtaaaaaagggaaaaacagaccagtggacaggcgcggtagctcacgtctgtaatcccagaactttgggagaccaaggcgggcggatcacctgaggttgggagttcgagaccagcctggccaacatggcaaaacctgtctctactaagaaaaattagctgggcgtggtggcgtgtgcctgtaggaggcaggagaatcgctggaacccggggaggcagaggctgcagtgggccaagatcgcaccactgcactccagcctgggcaacagagcaagactctgtctcaaaaaaaaaaaaaaaaaaaaaaaaaggatcaccaactcctacacttattgaacaaaacaaacatataagtccaggttagcctcatcctcatgttcttggggctcatgctcagcttaaggacaccagcagcaactactctttttatagaaaaccttgtctttacctacagatatatagctttacccttgtaggtctcagaataataatgacattccctaaaaaacaccataatacacaaccttcgtacaatgtgacatatactaatgaagtaacattagggatcacttccccacagttggctccccattcactgcccttcatattccaatgcaaaatcacctctgtttatactgttatagttacagtacttatacaaagcgtactactcttaagtgtgctgcctaataattttttcttttttgagacgtagtctagttctgtcacccaggctggagtgcagtggcatgatctcagctcactgcaacctctgcctcccaggcacaaataattctgttgcctcagactccagagtagctaggattacaggcgtccaccaccacgcctggttaatttttatatttttagtagcgatggggtttcaccatgttgaccaggctggtctcaaactcctgacctcaagtgatccgcccgcctcagcctcccaaaatgttggaattacaggtgtgagccactgcacccggcctgcctaatgaatttttacacaggtatgcacatacacacctgtatcaagatgcagaatgtttccagcaactcagaaggtttgcacatggccccttccccacacagtaaccacattattctgatttctatcaccattaattaggtttcctgttcttcagcctcatataaatgggttaaatggtatggtccttttgggctgctttcattcaataccatacctgtgaaagtcattcatgttgttgcaggtatcagcagttcatttggttttatcgctttaaagtattctgttatgtaaatatactgtcatttatctattctcctgtcgatgaacatttaggttgtgaacatttttgtaaatgtctttttcatcaacttttgttcagttgaaaacaaataacttctttttattagagagatggggtctcactatgttgcccaggctggactcttgggctcaagcaatcctcttgccacatcctcccaagtagttgggactataggcacatgccgctatgcctagcaaagataaactttttttttttttttgagacagagtctcgttctgttgccaggctggagtgcactggcgcaatctcggctcactgcaacctccgcctcctaggttcaagcaattctcctgcctcagcctccagagtagctgggactacaggtgtgcaccaccatgcccagctaatttttgtatttttagtagagacggggtttcaccatgttggccaggatggtctcgatctcttgacctcatgatctgtctgccccagcctcccaaagtgctgggattacaggcgtgagccaccgcacctggccaaaattaactttttaaatgcaaaatgtagggtacaaagaagttaattttttcaaagaataggaattatgactttatattaatctccagtatggttcaataccatatttcacagaatctaaaattccactggctataagacatactattattttatgaataagaaagaaagcactgctaataaaactatgacacagtgctaagacatcactaattgtagcacacatcctaattttagagacattaaaatgtaaaaaaaaaaaagtgtcaaaaaagcataccttgtttcatgcaatttgataaaattacagaaaatcttagttatgtaatatgaaatacatgtaaaaatacaaagtatatatgtaagctaagaagtataataggtcacccgtgaacctaccacccatcttaagaactagattactactaaatgccttgaatctatccgtgttccttgacttatccccatgcttccacaagaggtaaccactatcctgaattttgtatgcataattcccttgctttaaaaaatagttatcacataggtatgtatctttaaataaaatactgtatatttttgcttgtccaatcgattccaaaagtcttactgctcgttcccttgcctctctgcataactacagaccctggactcctatttcacagactacttttcattctccaaataggccatgtattttttgctcttaatttctcctttgtcaccatcaaatgcccccacgttcaatctctgtcgaaatcctaactttttcatggagcttaaatgctcccttcctaaaagatacctcatctgaactcttcagcttcaatatatctcattctatgttccttagcacttaaagctctattatttttaaacacttattttactcggtcctaaatcataatttcttgctgagtgaagagggagtgggaaagttagaaggtgggaactctacttgcctattaccctctgtttatgtctcctttgctgttctcaattagtacagttcagatgatgttctggcctggactcaaatgttttacagtgaactaaggccaagttttacagtcacatttgggttagagcattaaagggtgagcaatgctcacttgaggttatataaacagagaaaaagcccaatgcagaggaggattctcaggaaaagtgagctgaggctaagttccacacactctctcttgtgacccgtggctctccattcactgcaaagcttagaggatgaggtctgatcttaagggacaggtcttttgccaaaaagttgggggtatatctggtgcccgacttgacagtaagaactttgaagaaagcaatcaagttgaatccatctttgaatccttatacaacttcaggtatttgtatttatcaaatgcctgctaaattttttggatgttaaaatgtcagatgagctacacaatacaaattcaaatgacagttcttcagtggaagtccacataaaagaccctttttcatgctcttcagcactgtatgctgcttacctgagagatatccactcatacttttgtcaagagtattaaatttttgccgatattttaatcttgtaggctgaggaactgcccactctgaggtcccagtcttgggtgagttccctgagagtgaagcagtcgaggaagttgagctataaaaaaatttatttaaaatttttatgttactaaataaaatatatttaattaaattttataagaccaaggcattaagaatcttatataccaggggtcctgaacccccgggccaccgacctgttaggaaccgggctggacagcggggctcggtgagtggcaggtgagtgagcactactacctgagctccagctcctgtccagtgagcagtggcattagattctcataagagtgcaaaccctattgtgaatggcacatgtgagggacctaggttggatgctccctttgagaatctaatgcctgatgatctgagatgtaacagtttcatcctaaaaccattgcttcaagtctgtgaaaaaactgtcttctatgaaaccagtccctggtaccaaaaaggttgaggatcgctgttacatactataatggtgactgccttttctctttttctggggaggagacagagtctcgctctgttgccagcctggagtgcagtggcacaatcctggatcactgcaacctccacctcccgggttcaagcaattctcctgcctcagcctctcaagtagctgggactacagtcacatgccaccacgcccggctaatttttttgtgcgcatttttagtagagacagggtttcaccatgttgccccaggctggtctcgaactcctgagctcaggcaatccgcccacctcagcctcccaaagtgctgggattacaggcgtgagccactgtgcctggccaatggtgactgcttttgcattttacatttttttaaattttaagcaattatcactattcttagtaaagcaaagaccataagaagtatagaactccatgagactaccgcatataaagaacctgctctgtgccagaccttatattgtactaaggcctttacaaatatttctaatcctcccaacaaacttaaaaaatactacagtccccatcttttagatgggtaaactatggctcagcgatgttaagaaaaaacaaggccacagaatcagtgagtgttcaagctaggatatgaatgttgttcttctgggtcaaatctaacactctccgtacactaccctgaagagtataatagtgatttatatgaagggtgattaatgtaatgaatactgatgcatttgtgctttgtaaaatttaaaagatatccaattagtagaatctgctcaagaaagaaattaacaatgtacaatgagtatgagacatcttgggaaatatacacattttttaaaggaaaagtacacagctttaggcaaagaaaaaattaaaatatagaatatttttagtttacatgaattattttttcaaaagtaaaatgccacagacacttaataattctaaaaataaaaaatttattttatgtgagttgtaagtagtaaatttaccttaagtatttgtacttggccattataaagtaaaacttaggtaagctcaaagctttaaaaaaatcatttgttaaataaagacttcttactgaaagcataaaaagttgtcagagttagctattcatacctactagatcctaaatcaatcagagactgcgctttctgtatactagcacctccaaatcctcccatcatcagactataagatgacccatgaggcaatgctaaaaaagaaaaagaaggaaaagtatgaaagaaatttgtatctgttcaaacacaaatagtttctttctttacatgaaataatgactctttagaaacaaagtactcacttgaagaagaataaggaatgggtaaaggctgaatgagactggcggttccatttggtaatgatgatgtgctaacagaaggcactaggggagtgggcatcattaagggaggaaggttggtccctgaagtcgcagaagacaatgatgttataggtgcagctggaggcaatggctgaggaatggacagattgggcatgcttcccattcctaaagtcaaaagaaaacattttttccagtgctagaaaatcaattataaaacacatgcaaaaaacaagtttacagtacagtgggcagactctatgtttaccaaaacacacagatgaattatccttaaaaaactcactactttgacccagcagtgagggaggtaaactgctgctcttaatactaatactctgatctgtatgaactaagaaaacacctagcaaagagttaaatattctcctctctcatcatgaataaaactaagcagccttttccaattgaatatgagtctcctcaaggaaagaatacattaccagatcaaatgaggtttttgtgaaaggataatacagtgctactaagttacttgactaatacacacacacacacacacacacacattcttcttctctctctctctcacatactccccccaaacaaaaaggttctaagtagtagatactttatgagatccatttatgcatatgcattatttgcaagaaagtgtgtcacatattttacttttcttgtaagtaacattcctatgaattcaaggacgagttcttaaaaggaacaaagtgatgacttttattcatttattaactgcagaatacttataaatatggtcacacaatgatttagtatttatctttagaattcactaaaatagtgaaataattttgtggagtctgttgtttgtttgagatgggggtctcactatgttgccccgactagaatgaagtggctattcacaggtgcgatcatagcacagtacaacctcaaactcctggactcaagcaatcctacccatagcctcccaagcagccagaactacaggcacacacccctataaccagctctagaattctatattctaagatctgtagtgaaggaacatgtttcagatacatagacatacctaattgaatgttccattcaaaatgagtgcttctcacatataattataagaaattgcctgatcaaaattaacagaaaacataccaaccggttatcgctgatgaatacgtgaacttattagcccaaagtctgcaacttttggccctaaatttagctggctaattaacctttaaaaaaattcaacttacataaaattttaaattatctcccaaatcgaaccatttcaagtgagtttaaaactgctcaaaattttttctgtattactcacatatatatagagagagaggaaactaagaatagtatttgggattggctatacctagggagaccatataattcatcacgcaactaggagttgtaaaaggagacactaactggaccagatgccaggacaaaaggcataaatcagaactgtccctagaaaaccagaacacatggatcccctacctgtgacagtgaatttaatatttattatctctaacatgaaaattaacttggaatctggggactgtcattttgtgctaacaaatccttttctaatactcaaatatgcctagggataaagtttaagtagcaaatacaggtatttaaattaatacatacttaccaaaacgagcagaaattaatggagaaaacatagggggttgcttcataataggagggagaaccacaggcaactgttggccttgaagcttcagtttgatgagtttcatagctatggagaactcttgctgatccatcttcccatccttgtttaggtctgataaagccctaaaaggagcatgaggtaggtagattgctatgtggtgtggtggtgggaaaactaacgttattttggggattgacaaagtaaaaatgatgatatggcattcacgtgtacatcatcactaaatttaaaatatctaacatgtaaaatatataataacaaaaagataaaacctacactttaagaaatactgaccagagataataactaataaaacactgcctgtcaaaacagaatctagagacctttgggctgaattccaccagtttaggtagaaaaaaattcaagattataatacttctaaatttaatttattcatctgtccaaatatttactgaatacttgctatgtgcctcgtactctaccaggcatgagaatattccaagtggaaagatgggacaggggttgttacttattgtaaacgtttttaaaaaaacagatattatagagaatagtttctttaaagaaggagcaggggaagcgaggactaatttggggtttatagattatgaaataaatgaaactacaaaataacagaaagaggattttgagattctgccaaattataaggaaatttttctcaatgataatgtatatatctttccttagaaaattctaatgaaattagaaatttgtcctagagaactaaacctgaattattttcaataatttgctcaataaaatttattttccaaaaaactgaagaaataccttttttttttttttttttctaaagagagtctcattctgtcatccaggctagggtgcagtgacacaatcatagttcactgcagcactgaattcctgggctcaagcaatccttccatcttggcctccctgagtagctgggactagaggtgtggccaccacacccagctaattttttttttaattttctgtagagacagggttctcactatgttgcccagcctggcctcaagcaatcctcctacctcagactcccaaagtgctggcagaaatattcttaataaccaatagaatgcaactaaaaacaattttatgttaacactatattacaaaaaaacaaaatactatcagaaaattaggttcatctacaaaacactttaccatatttcagctaaaacaggggccggcagacctgattgtaggaaaaaattacgtgcttgatcacctggaggtaataaaaacaaaacccaagcagcacattagtaaatgaaattattccaatgcttctgaataataatgggtatatgttaatgatttattataattttaataccaatcattaaagaataagtgaaatagaaacacataaaaattatttacataactttaataagacagatattttaaaacaaaagtcacatctgcacttctattgtatattaatcagtgatgaaagatgattcatctcagtttttccacaattggggtcttccttaaaaatacttccacttagtaaaatttatatttaaaaacactattccctaaaagagtttcaatataaaaagtaccaggtgttaggagagagagtcctccatgagtttcttcacactcctatgtgtcttgctctgtataccaataatgtaagaccctaattgctctctgcctgggtcacttctcagaattgggtttgtaatgagcaatcttaacgaatccggtaacgtttcccactgagacaagggacaaacttgctttactgcttgctacaaaagggtgggttccccaaattcagtgttcctctcctgtaacacaatcatagcatgtgtactattctcctgggctctctgcattgtctctgtgggacttagggaacactaaaggaaacagaaagatagatgccaatgctcattttgctagttatgctgttagtcataaggttctttgtctctgactcaggaatcttgggtcttccacccgtaatggacaaagttattaacctgtaagcagggtaatcaaatcctgataccaggtaaggtaattactatcatagcagtacaaataacatggttaagtagatggattccaaaatcagcccaaatggtttcaaagcccagattaacactaaccatctttgtaaccttaggcagttacataacgtctcttagtctcagtttcactatttgtaaatatagacaacaacagtgcctactttacagggttgttgtaaaggttaaataaaataatgcacttagcatagcatctggtatatagtaaaaattcaataaatatcattgttctcatagttactattattgtatgtaaagcactaagctactttggcacagaaaaaagtttaattaatagaaaaaaatttcaaaggcacacctaaattaatcccattttggctctggtggtctttctgcaaaacaagggctagcatcaacaatcagtgcttggtgtagcctcaaagacagagggctagcattaggaaaacagattccagaaaaaaaaagtctagattttccatgaaatgaatctaagaaataaactgaaaactttctagatataatgttaaaatgtgaaaccagacaattacacagaaattcttgactatcatttaggattcaggaaaaatcttccatatcccaaatttaaaacaacaaattaagacagttccaggaaaaataaagttagcatttctttaatttctagaattctgattgatatgaattttatcgtttattaacacaaatttgatggcagtcaaattaaaactaattcttagatatcacataaggaccataattcactaataaaactaattataaatacaaacctgttatgtaacctcctgaaggtttgaggttatcaaactgcctgtcatgcttagtacgttcttcagaggtaatagcccacatgtttggccctcctgaaacataagtggaagaaactatagtgtatacatgagaatgcttaaaatacaattctaaaatgtaaatagaaatcacaagtgttcattgtatgacagtatttaatatttgagtgacacaaagagtagagctctatcataaccatacatagcacagccctaaggcttttcactcattggctcaattaacgtctattgaacaagtgctatatcacactcactggaaatgggcatcaagctaaatactggcaataaaaagatgaagaaaatattcccaccctcaaggaattcatgctctagaaaacaacagtacttacagtattcacctgtgaaaaatcctaagcagaactatatactgccatagtttagccctgtgtccccaccagaacctcatttcgaactgtaatccccacgtgtcagaggaggggcctggtgggagatgactggatcatgggagttgatttctcccttgttgtttttgtgataatgagtgagttcctcacaatagctgatggttttaaagtgtggcacttccccccttgctgcttctctctctcctgctgccacgttaagatgtgctttgcatccccttcgccttacaccttaagtttcctgaggcctctccagccatgtggaactgtgagtcaattaaaccctttttttcataaattactcagtctcagctagttctttatagcagtgtgaaaacagactaatacagataccaaaacagctgtgccaattctgagttagaagcaccaaggatgagataacaggaaaggtaacactgaggcagagccttgaagcttggtttgaattttgccacgtgaagaggagggataagaacatttcacaccataagggcacagcatgagaagtcaaggcatgtgcaaggtgctgttaagtgcactgagcagactaataactagagttagtaataataaacaggtagggtggaattaactgtaaaaaggtcttaaataccatcctcaagagcctgaccccataccctggaagttatagagagccatctagtagtttttattattttattatttatttatttatttattttgagacaaagtcttgctctgtcaccaggctggagagcagcagagtgatctcggctcactgcagcctccgcctcctgggttcaagcaattctcctgcctcagcctcccaagtagctgggactacaggcatgcgccaccacacacccggctaatttttgtattattagtagagacagggtttcaccatgttggccaggatggtcttgatctcctgacctcatgatccacccacctcggcctcccaaagtgctgggattacaggcgtaagccaccacgcccagacagtttttaaataagcttttaatttggaataattttagatttacagaaaattcacaaagatagtacatggctcctatatacctttcacccaatttctactatgttaacaactgacacaaccatagtacatttgtcaaaacaaagacattaacagtctggtatataactactggctaaattaatacctccacctgcagtggtggctggtaaactccaacagaattaaactctgggtagtgaagacagcacaaggcactgtgactgatgattctgcccatcggagcctctagcaaaaggaagtagccttcacctagagataatccttgggatcagaaagcttgacccacgaaggcctagtgattctctagcctgatagtcccattttggggagggtcaacttgaattccacaaggtgggaataacctgaaaagccttgtttgtcaaatagaaatggtatatcaaagaagatatagacactggccccaacagtattttggctttacgttaaaaagtggcagtggccgggcgcggtggctcacgcctgtaatcccagcactttgggaggccgaggcgggcggatcacctgaggtcaggagttcaagaccaacctggtcaacatggcgaaacctcatctctactaaaaatacaaaacaaattagctgggtgtgatggtgggtgcctgtagtcccagctactcaggaggctgaggcaagaggatcatttgaacccgggaggtggaggttgcagtgagctgagatcacgccatagcactccagcctgcgccgacaagggcaagacgcaatctcaaaaaaaaaaaaaaagcggcaactatccctctgagggaaacctttatgcacattccactgcttatagtaaagctactggatcaatgaaggctcagatcagagaagctgcaagttgctggtgttcactgggctgcagtggctattcagcctcagaggcagctatgctgaactgaaaggagacatgggcagaacctggattcttgggctgctgccaatgacccagctgtttggtttgccacttggaaaattacagattgacagattaaagacaccctcctggggctacaaattgaaaacaaatctcaactgctaattgaattgtctgtgtcacctatgtagacacctacagtatgggcccagcctctgatttagactgaaatcaagtatgactaatgtgcagaggataccactgcatgccaaactgtgacttggggatggtgggggaggtctcattgcaggtggcattgttccctttgactcctggcagactgactatattggacctttgttccctctctcaggctatcagtggtgcctcaaactattgacagtatttttttgtttttcacatagactttttagagcagttttaggttcacggcaagattgagcagaaggtacaaacatttctcctataccttccaccccactgacacatagtccctcccattaaaacattcccctgttgacacttttttaggttaccaatcagcccacgatgcccacactgtcatggcccttgaaactaatctgtgtcatgtttcttttttaaaaaatttagagacagggtctcactctgttgcccaggctggagtacagagtgacccttggctcactgcagccttgacatcccaggctcaagtgattctcccacctcagccgcctgagtagctgggactacaggtacgtgcgactacagctggctaatttttgtattttttgtagagacggggtctcactatgctgccaaggctggtctcgaactcctgggctcaagtgatcctcctgccttgacctcccataatctgtgtcatgtttttggttttctggaccatatgcattctgacatggatgcacttttatcataaaagccattcaacaatgcactgacagcctgactctatttccatcacctcctcctggtccacatactttaaagtaagatagtgtggtcactgactgtagctgtctccagaaaggattcattgcttattagctgcttcctccctaatgatcagggctaaagggtggggtatcacaggagatatacagacctattgtgaaaattcaggattctactctgaccactcctggacatgatgcatctttctagcccctaacagcaactgtaggcaggcttggttcataaaccctccagctgggccactgaggtaaaaggggatctagagcaggaattcccaacccccaggccacggactggcactggtctgtggcctgttaggaacctggccgcacagaaggtgagcggtgggcaagtgagcactaccacctgagcggcacctcctgtcagatcagtggcagcattagattctcataggagcacaaaccctattgtgaactgtgtgtgtgagggatctgggttgcatgctccttatgagaatctaatgcctgatgatctgcagtggagcagtttcatcctaaaaccaaccccctcccaccaccctaccacaaatctgtggaaaaattgtcttccatgaaactggtccctggtgccaaaaaggttggggaccagtgatctagaggattcaaagttaattctggttagggtttatgaaaatgtccctcttacatctaactcttctggatcactaggaaatggtaaagttatggctctgaaatgagaaacccaggtttaatggcagtagagcaacaagaaggcacctgaggaagaaacgccttagaccccaggaggtatggtattaagagaggaattaatgatattttctcttgtagaactgcccctgtagccttcttctgcaagaaaaatgccttggtatggctctcctaaattgttggaagcaccttatgagtctgccatcccccatcaggagccttatcaagagtctatcaggaacatcaggaatgaccccagaaaatgtatctcctgtccatatcacttccagaggtcttcccccacccccaatctcagtaatggatgaattccacccagctggtggcgaggacaaacaaaacaagtgggactaatttgggcaatccctccaaaaacaaggactagactcaattactcaaactccactggaaaccctcagacttgccagtcatccaggaggctatgttagaggcactatcaacctgtgcccctcttctgatgtaggtcccacggcagtaggggttgcagggggaataactgtaaacattttctttccaagcataacccatgcacacccttgatcttctacttcttctgtggaaaccatgcattaacttgcctccctccaaaaacacagtaatgtacatgaagagatcttcaagtgtttaaaaaaacacttcctcagtcctggaaggcattcaggtcagcctcaactcactggctagggttgtcagagatttatcctagattttctttttttgcaggctaagataaagtgtgtgcaattatgaatacactctgctgtacccagattactgattcaggccaggtagaaaagttaaaataaaacttaaggagaggccggacatggtggtgcacacctaatcccagtattttgggaggctgaggcaggaggatcccttgagctcaggagtttgagaccagcctgggcaacatagtgagaccccatctctacaaaaaaacttaaaaaaattagccaggctgggcgcggtggctcacgcctgtaatcccagcactttgggaggccgaggagggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaattagccagtggtggtggctcacacctgtaatcccagctacttgggaggctgaggtagaaggattgcttgagcccaggagatcaaggctgcagggagcactgatcacaccactgtctgggttacagaacaagaccctgtctcaacaaaaaacaaacaacaacaacaaccaccaaaaaaaaaaaaaacaaaaaaacattgttttttaaggagaaagccacctggctttctaagggagacactgatgatttataggatttgtttagctgggaccctgcagagcacagctgagaacactgcaagctgagaccaacctgctgcttggagtcctgttgattagtcttaatcaaatgctgcataaaataaatcagacttagtcccagcccgttttgtcagattaatcggagtggccaacttagtggtatgtacactcatgagaaaatttgctagaagtcaagacaatggagaaacaagggagaggaacccttgggagacaattctccatgagtttctcatgtttctgtacatcttctaaagcaaaggattgatagcttttgttccagactatctctgaggatgtctgcattgcaaatacaggggtttcttcccgagcttgggattagctttttgttgtccgccagctctctgaggtttttgtaaagctctgcacattcaacatgactaatcaccatctatacttctgactacctttacaatttattccatttctgccaataaggaatcaaatacgtttaggtatataaactcatacataattcctgcttgtattgtataaaaatctgccttacaaagacaattttccaggaacgtatatcattgaaaagtaggtgctcactgtaatttttaacactaatatggatttaacaaattattcttagtcctaaatgactggattaaaaaatctataaatatcctctcttaaagagaagttttaagattatagttaaaaataaagaaacagatgtactgaagaactaaggacctaaaatagctaaacctacacactttctaaataaagaaataccacatatgtagtaaaaatcctacttgggttatcagtttatcagaaaataaataaataaacctgtcaggattcctgtcactaggaaggcaagtagtatagccacagaactgattttctattatatgacttcagaaaaattatgatgctgattttaaaaacaacaaaaatgacaacaacaaaggatgacaaagatggaagcagctcacctttattgaaccctgactattgtcagggactttatatgcagcaactcactgagcccccagcattaacctataaattaaagtactattattattctcattttataggtaaggaaactgaaaacccatggtaataaagtaacttgctcaaggtcatacagtaagtgacagagctgagattagaacctgggtagcctgactccaaagcctccatattgaactcagcactaactatgtaccaacatatatgggtaagatgctcatgttccttctaattcagatgccacctctataaactaggaatattatataactccacaggcctgttgtaaagattacatgtaatatacctccattatagctaacacttaatgaaactcaccctgtgtcaggtacttttctaagagctttacatgtattgcttcaagtaagtctcataagaatcccatgaggtaactattgctatcactgtttatcagagaaggaaacagtggtacagagatattaaataatttgcccaaggtaataaaattggtaagtgttgaaggcaagactagcgtctactcaggcttaattaagagtcttaaactatctgtcttgttggtaattaaacataaatacactcacaaatatattgtccattgatttccaacaacatgtggagataattcaaggtggaaaacagtcctttcatcaaatggtgctgaaagaactggatatccatatgaaaaaacaacaaaagaacctcaaccttccagcatatacatgaattaactctcaatgaatcacagaactagatataagataaaacttcctgaagaaaatatggaagaaaatgtttgtgattttggattatgcaatgactttttggaacacaaaaggcaaaaatcattaaaatattttgacaaactggactttataaaaatctaaaatttccactctcttaaaggacactcttaagaaaaggaaaagacaaactacaggctgagagaaaacatttgcaaaacatattcaataaatataggtcagcatatatacagaactattcaactcaaaaattagaaaataatcccccccctcaaaaaaaaggaacaaaagatttgaacagacacatcaaagatatacagatggcaaataagcacgtgacaagatgctcaatatcactatcatcagggaaatgtaaattaaaatcacaaaaaggtatcactgcatgtctattagcatgtctgaaaattaaaaaaaaaaacaacacggagtgctgataaagatgccaaacaaccgcaactcatatatgctggtgggaaagcaaatgtgacagtcactttggaaaacagtttgggaatttcttatgaagttaaatatatatttccacatgacccaacaatagactgagtattaacaaaagactcttgggtaaatacccaagagaaacgaagacctatttccacataaaaacctgttctctgatggttatagcagatttagtcataatcactaaaacctggaaataacccaaatgttctgcacctgaacggctgaatggataaataaattgtggtacacatttatacaatggactactattcagcagtaaacaggagaaatgcatgcaacattatgactgaatcacaaagatattttgctaagtcacagaagccagacaccaaaggctacatattgtgtattccatttatatgacattctggaaaaggcagaactgtaaggacagaaatctgattagtggttgccaataatacatggctaaaggtggaggtataagggtacagagaactttttaggtgatgcaaatgttttatatcctaatttatatgactatatatagttttagaaactcatcgaaccgtatactttaaaagggtgaattatacccccaataaacccaactttaaaataaactaaaacaaaaatataaagcatctaatacatgcctgccatattaggagtcctcaataaattagtttccttattcaacccaatcccagggaacaatataattaaaaagaagtcagagcattcaaatctttctcagggaatagcctgaaactaaggctctttagttagaaaccttaagactattttaagtctgaagagtttggttaagaaggcttaaaagctgctcggccaggcatggtggctcacacctgtaatcccagcactttgggaggccaaggcgggtggatcacgaggtcaggagatggagaccatcctggctaacgtggtgaaaccccatctctactaaaaatacaaaaacttagctaggcgtggtggtgagcgcctgtagtcccagctactcgggaggctgaggcaggagaacggcgtgaacccagtaggcggagcttgcagtgagcagagatcatgccactgcactccagcctgggagacagagcgagactccgtctcaaaaaaattaaattaaattaaattaaattaaattttttttaaaaagctgctctaacatacatgggtatatatacccccgggcagtgatggactctactgctatcctaagacaaaagagagttctgctgcatcaagattgatgcaccaatgctcatcacagtatgatgctttcttatatatattactatctcctgacatttccttggctatgtgttttcacaggggctaaactcaacccatctgtttgtttactgcttagttcctcatgtctccaatcagtaatcttgacaccttcatattcattcattcagtaaatgtttatggggtacaaagatgaataaaatgaaccacttgcctgggcacagcccagcacttcagaaggctagggcaggaggatcacttgagcccaggagttgagaccagcctggtcaacatagtgagacccctatctctaaaaaaaaaattcttttaagtagctggtcttggtggcacatgtctgtagtcccagttactctggaggctgaggcagaaggaattgcttgagcctggaggttgagattgcagtgagcaatgttcatgccactgtactccaggctgggttgacagagtaagaccctgtctcaaaaaaaaaaaaaaaaaaaaaaaaaatgaacaccttaaaagaactcacagactctaatattttaaagagactctaccagccaagaaaatcacacacaacaatcacggttacatattatcatgattaatgtaaccaagagaataaaaatgttctaaggcattttaacaaggaataatttttaagtagtgttcaaataaccttttaaaaaattaatcatattaaaacataaagtattaatgcaccaagaattttctaggaacaaaaagataacactggtcaggtgtgatggctcatgcctgtaatccaagcactttgggaggctaaggtggaggacttcttgagcccaagagttcaagaccagcttggacaagatagtgagacccccatgtctacaaaaaatctaaaaattagctgggtgtggtggctcacacctgtggtcccagctactcaggaagcagaggcaggaggattgcttgaatctagcaagtcgaggctgcagtgagctgtgttcataccactacactccaacctgggcaacagagtggagaccctgtctcaaaaaacaaaacactgcaataagaaaactgggcaatacgtgtaattcaaagccaattttaaaatagttaattcagtcctggctttcttatttaaatatatcaactaacagaaccctttgaaaaggcaaaagtttgttactttgaacttcaagtaaaaatctcccaatcttagtctatatttatctgtaagccttatcgaagaggcagaaaaatctaagtttaggggttgatgtctaatatttccctaaaaagctaacaaacttttacaatatgtaataatcgtgttagaaatacattaaaattctatccgcttcccctaactcatcactgatattgaaaatatgggattttcataaacatttctgttgcttattctcatctcacttgctggctctttcaaacaagttcttatagtcagtgaagaaaaaaattttcacatttacagaacatctactataggctagatctcattcagtaagtagtctcatctcggtttttacacacacacgtatatacatacacacacacacatacacacacacatacacattcacacacaggcatacttacagacaagtcccaatagcaatgggcatcaaaacaatttaacaatctatgtcaggattactagaggagcaaagttttgtactatacatgaatgctgctctcagtaacatcttaaaccctgaattgaacttaaattagatatgtctaagttatcgtcaatcttctaagtaggaaggtaccacagtctacatatgcaattaattcttcagaagtttaaaaaaaattactatctgtatgcctatatagcacttctaaatgcattttccaacattttagatgattattcacataatcattcttttgttattgaatagtccatttgttctcaatgttatattttatatataatgcaatgaactgcaaagtagatatataaatgtttatggaatggaagaagcagaataaagaaggaccgggactgtactgctttatgttcattttgcttataaaactgattaacatgttggctgaagtttacaattcaactgtttaatgcaaattcctttgtatggggcataaaaatcctcaaacttgagtagagcatgttactactacaatcactgccctaattttaaacttacatgtatcactcattatggaaaaattatttaattattaaaaattgtctgtggcatcaatgtttataatcccacaccattttcccaataggagcaatactcacattaatccttaaataataggttctgaaaaggtaaaacacgaaacaacaaaatctttacttcaagtctatccttaaatgacacatgacctcaccacacagaatttgattttactttttatacaaataattcacttctccaagattttcctaaatcctgagacataaaactttagatatacaacatgtattttcgttattaacaatgtaatgatttggtcctatgtctgaaaacaagtttaaaaaacaactgattaacactagacggtaatatcaaaacagaattgctttgtgaagatggtagaatggtgattcttccctcctttttttaaatgctctttaatattactgttttcaatttaaataataaagaattattgagtttattctctatttcctgatatttatctacaattagctaatacaatttaacataaaattaagaattcagaatctagatttctttagcgatttaaaaatataatgcatgtttttcaattaattataaatgacaaacacagtaacttaatacctactaagggtagttaattagtatttgggaaaagaattaaagctacaatcagaacaaaactttaaaaacttttcattattcaaattacctaagcattttctttttctttttctttttcttttttttttaaatggagtctcactctttcccaggctggagtgtagtggccctatctcggtacactgcaaccaccacctcccgggtagttcaagtgattctcctgcctcaacctcccaagcagctgggattacaggtgcccatgaccacactcggctagtttttgtatttttagtagagattgggtttcaccatgttgaccaggctggtctcgaactcctgacctcaagtgatctccctcctcagcctcacaaagtgctgtaattacaggcatgagccaccacacccggccagcactttcttttaaaatgtttgatattaaacaattatgtatgcaggcatacataatcttatctaaagggaaaacataatcttacataaatattactaaattaatctttattggcttcatcggtttacaatcatgttatgttatcaaaatacctttaatagtcaccttatagcactctgctatttgtcatccagttttatgcatcaaacacaatataccttttggttattcctaactgctcaatggcaaacacacgttccagaatatagtcatgggatttacaacataatattcttacagaagacatatgcagtgttccaaaatattttccaagaatacttcaagttttgtatttatacacttaaggaaaattatctacatgaatattttaaacctctaccaaaaaaaaaaaaaatccataacctcatcttgccacaagcacaaagctgcttaccattcatagctgtgggaaactgagccatcatggtcctgagttttccttgctagctctcagccatctgcaacataaaaatattgtgccgttgataatacaacaagggcaaatcacagtttagtgcacccgctaagcagtaggaatgtctgtccccttcagctcacacttccaacagaaaacaatgcagagcttctgctgctgctgaacaggcagaatttacatttgaggaagggtaagagattttgttgggtaatcgtgctgccttaatacagaaaaacagtcacatatttaatagtagatactgaataaagaaacccttggcatgaaccaacattcttgtagaaattaatttggaagagaaaaaaataaatcaactgtataaattaagtatataagaataacatggaaatccatacttttttttttttttaaatagagtctcactctgtcacccaggctggagtgcagtggtgcaatctcagctcactgcaacctctgcctcctgggttcaagcaattctcataccttggccacctgagtagctgggactacaggaatgctccaccacacctggctaatttttgtgtttttagtagggacagggttttgccatgttgaccagaatggtctcaaattcctggcctcaagtgacctgcccacgtcagcctcccaaagtgctgagattacaggcgttagccactgcacccagcccatagtatcattttttaaaaactcccaaacaagaaaaatattcaaaataaatgtagcgcagctgtttaaatgagctcaaggggtttataaaatagtctaaaagtaattattaaaacacacaaaattattaaaatacatatataacataactaaatgtgctgggcaagcactctaagagaagggactttggaaattcacagctctgggttcaaacccagctctgctattctcccagctgtgaccatggaaaagttatttaaccttttttgagactcagattactcatctataaaaaatactttgcagaagtattttttaaagtgttaaacataatccagtaaactgcctgccacatagggtgttcaacaaatggctgctattttgcaaacaaccagaaaaggagagtgcagtatcattttgaaccctgaattcattattcagctgtcaataaattcaaaaattgttccatgaatctttttgtgggtctgtttttttttttgtttgttttgttttcttgagacggagtctcgctctgtcgcccaggctggagtgcagtggcgcagtcttggctcactgcaacctcacctcccgggttcaagcgattctccagcctcagcctcctgagtagctgggtctacaggcgcacatcaccatgcccggctaatttttgtttgtttgtttgtttgttttagtagagacgaggttttaccatgttggccaggctagtcttgaactcctgagctcaagtgatttgcttccctcagccacccaaagtgctgggattacaggccactgtgtcctgcccgttccatgaattttgagagtaggaccagttaggaagtgaaggcctagcaaatttatagcaatgcacttagtaattaaaaccatggatcataatattgcaggaaaacactactatattaaaagatcatgccgtatctcatctatttacccaaatcatttaaatattaatatttttagaagcctaagaaaaatatttgcacagccattttaaacaaagaaggcattaagtagtacatacatcgtggtcaacgtttctcaccattttatagctagcttaaaaaatgaacacagaaggaagtcccatcaatcaagttatgactgcaacttcctcaaatacagaaatactgcaaacaaatataacatttttacttcttcaattttaaatcataagtaatgttaacccaaaataagctacatggctaaaaacaaactatctacttaacagatatgcagtagcaagggcccttattcattagttttctgtggctgagaccattttaaaacatgggagaaaacccactattgcaaataatgcattttctaactctgcataatagcatgtgaattataaagatggctctaacaacagaaaaaccaacgaggaatgggatcccatggacacaaggccttaatcagttgggatctaggtctaaaacttacaaatcatctgtctagaaccatttgttcgtcatcacgtattctgtgaatacaaaagaatgccaaatagagagcaacgtgaagaagaagacgcgagaacgaaccccggactgaccaaagcctgcatgccactgcatcctgtgccaagtgcttacctcctgccaccgttgccaccaccatgcccaagagaaagggtgaaggggatgctaaaggagataaagccaaggtgaagaacgaaccacagagaagacccatgaggttgtctgctaaacctgctcctccaacgccagagcccaagcctgaaaaggcccctgcaaagaagggagagaaggtacccaaagggaaaaagggaaaagcttatgctggcaaggaggggaataaccttgcagaaaatggagatgctaaaacagacggggcacagaaagctgaaagtgctggagatgccaagtgaagtgtgtgtattttttataactgtgtacttctggtgacagtagtttgaaatactattttttatcaagttttataaaaaatgcagaatttcattttacttttttttttttttagatgaattctcgctctatcgcccaggctggagtgcagtggcgtgatcttggctcactgcaacctccacctcgtgggttcacgcgattctcctgcctcagcctcctgagtagctgggattacaggcaggcgccaccacacctggctaatttttgtatttttagcagagatggcgtttcaccatgttggtcaggcttgtctcgaactcctgacctcaggtgatccacctgcctcagcctcccaaagtgctgagattataggcatgagccactgcacccggccacttttttttttttttttttttaaggcagagtttcgctcttgttgctcaagctggaatgcaatggcgcgatcttggctgactgcaacctccgcctcccaggttcaagcaattctcctgcctcagcttcccaagtagctgggattacagttgcgcatcatcacgcccggctaattttttgtatttttagtagaaatggggtttcactatgttagccaggctggtcttgaactcctgacctcaggtgatccacctgcctcagcctcccaaagtgctgggattacaggcatgagccactgtgcccagcctactttttttttttttaagctatgttgttagcacacagaacacttcattgttgtttttgggggaagggccatatgtcactaatagaatgtctccgaagctggactaatgtggaggaaacacctttcccttctagttttgagagagttcctcttggctcccaggaggagggattccctgactttaacacacatggccaccttggcacaaaagccttgtggtatggaaaacaaatttgtttttatgtcctcttctccctttccgtccttcagcagagacttaactcccttaaacccagacatctgttgagacctgaccccccaatcattagttaccagtgtgtcaggcaatctggactttccagtgatgccactgagacggcacctgtcaaaagagcagtggttcttcagataaattctgccattttcatttcacttcctgaaagtcagggtcggctgggaaaagttgttaaacaatatgctaaatgtgaaatgtcaaccctcactctaaactttccctgttcacagcatcagatgaagacttcattgggttttagagtggctttcaagaagggagtttgaaagttgttgtggccaggcgcagtggttcatgcctgtaatcccagcactttgggaggccaaggcaggcagatcacctgaagtcaggagttcaagaccagcctgaccaacatggtgaaaccccatctctactaaaaatacaaaattagccaggcgtggggcacatgcctgtaatcccagctacttgggtggctgcggcaggagaatcgcttgaacccaggaggtggaggttgcagtgagccaagatcaggccattgcactccagcatgggcaacaagggcaaaactccgtctcaaaaaaaaaggaaaattgttgtatactcaatgattgtctgcccatgtcctgcctgaaataccatgattgtttacggaaagtatctttaataaagctggatacagtttggcttgggaaaaaaaaaaagaatgccaaatagtagatgctcagtaatcacaggcataattctgaaataaaacctgagaatgaactaaatattaataatattactggcaataagggcaaatcccttgggtaaagctgaaggtactagtattacagaatctttatcatctggtatgtggaatttagccacccatgcacataggtaccatattatatgtaacatttatattgtatgtaacatctgattaactgtggtaacatctaaatatgggagtatattttgttggaaccaataagcttttaaaacatatcatttcatatctattacatttctattctctctgccccactgtggaataattacctaatgcttaacaattctactagtctatttgcagagtagtacttaacaattataattgaaattttgaaaatgcaacagataccaaaaactttgttttacatttttcaaaaagcaattaataaattaacatttactgtttaccattaattcaatacacttctgttgatcacagtagatgtactgtgtcatgctgagtattcattgagaatccaatgtttcaggttctgcagaaggagcttcagacactgacaagcttgtagacttatctaccaggtgccagatactgctaggcacctttgataatatggatactcctctcacaatatccccacaaggcagatgatactgtactcatttcacagaagaaactgaagaggttaaattacttgcccaaattcagtatgtcatgaagccagaatgcaatcccaagcctgtctaattcttaagcccatgaacttcccatgggctttatctgcctcttcctctcttaaatggagataatgcgtcacaggttcctacaaacagcaggagaacttactgttagcacatttgtccaggagaagaaaaacaagccagagatgactcccaacacactggacagcatcaatcacatacataaattagggagtgctaattgtttcttatctcttggtataactctctgaaaggaagaaaagggtaaccagcatctccccaggtacatgactggcgcctgtttcaggcaagtgcaactgaagtcagcatccaacaaacacccctttctactcttcacaggggatgaaatgtagtgacaggcaattttggcaaatttgcagtcatcatgtattttgaatactgttagttatgtatggtttttagaatgttcatatgattttcctgctcattaaaaattaatgcagaactggcattgttccctttgtagaaaccaagaaaatatattgggtaaatagtaggcataaggcaaagaacactgcttcaatttaatataattcagttgccatttggagtaattgccaaacgtactttagacaatgtagaaaatatactcacactaagacagaaaaaagtagaaatgctagaacaaaagcaggaaatcctgcttttacaaacggtcagtaagactcagaaaaagtcacagccattataagtgaaaagtcgcttaattaaggtttaggggtttttttgttttgttttttgagacagagtctcattctgtcactcagactggagtgcagtggcacaatctcggctcactgcaacctccacttcctgggttcaagtgattctcctgcctcagcctcttaagtagcggggactacaagcgcacgccaccacacctggctaatttttttttttcttttttttgagatggagtctccctctgtcacccaggctggagtgcaattgtgcgatctcagctcactgcaacctccgcctcccaggttcaagcaattttcctgcctcagcctcccaagtagctgggattacaggtgcccagcaccgcgcccagctaatttttgtattattagtagagaggaggtttcgccatgttggccaggctggttttgaactcctgacctcacgtgatccgcccgcctcggcttcccaaagtgttgcgattacaggcatcagccactgtgcccagcctgatttttgtatttttagtagagatggggtttcaccatcttggccaaaccccaaaccccttggcccagccaaggttaaagtttttgtttgttaagaagcacagttacagaaagaattacaattactttccgtgccaatagcgctcatgcaaacatggtgaacattcctaaaacccgcaggactttctgtaagaagtgtggcaagcaccaaccctgcaaagtgacacagtacaagaagggcaagaattctctgtatgcccagggaaagtggtgttatacaggaagcagagtggttatggtgggcaaactaagctgattttccagaaaaaggctaaaactacaaagaagattgtgctaaggcttgagtgcgttgagcccaactgcagatctaagagaatgttggctattaaaagatgcaagcattggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagatgcaagcattttgaactgggaagagataagagaaagggccaagtgacccagttctaagtgtcatcttttcttttattataaagacaataaaatcttgagtttatgttaaaaaaataataattacaattatcatttagtccaaaaccctcaattttcaaggtgggaaaactaagaaacttgtaaaagatcacaagttagtagcaaaggtcccagaaactacatctctgatgtacatgtccagtgctctggttttttaagacaaagtatcaccctgccacgcaggctggaatgcagagacatgatctcagctcactgcaacctctgccacctgggcttgagcaatccgcccacctcagcctcctgaggagctaggactacaggcgtgtaccaccatgctcagctaatttttaaatttttttgtagagatgcggcctcactacatttcccaggctggtctccaactcctgggctcaagtgaacctcccaccttggcctcccaaagtgctgggattacaagcgaaagccactgcacccagccttccagggctgtttgtttgtttttgagacagagtctcactctatcccccaggctggagtgcagtgcgccatcttggctcactgcaacctccgcctccctggttcaagtgattctcatgcctcagcctcccgagtagctgggattaaggtgcctgccaccatgcccagctaatttttgtatttttagtagggacggggtttcgccatgttggccaggctggtctcaaactcctgacctcaggtgatctgcccgcctcccaaagtgctgggattacaggcgtgagcaaccacgcccagcccagtgctctgttcttaaaagtttcccttggccgggcatggtggctcaagcctgtaatcccagcactttgggaggccgaggcaggtggatcacgaggtcaggagatcgagaccatcctggctaacatggtggaaccccgtctctactaaaaatacaaaaaaattagccaggcatggtggcgggcacctgtagtcccagctacttgggaggctgaagcaggagaatggcatgaacccaggaggcggagcttgcagtgagccgagatggagccactgcactccagcctgggccacagagcgagactctgtctcaaaaaaaaaaaaaaaaaaaaagtttcccaacttgcccactcatatcacctgggatatttactaactgtacattatgaatagaacctaaataaatgttattggcttgagacccttccacacagctactagttttttcttaaagcactcattaatgcccctttcctgcttagaaaatcttccactgattacaagttaaagtccaaacttcttagtatgaaatacggccctcttcagtatctcactgtatcacatactccaggtactttccatttccatatgtcctaagtataccaatcttttttgaaacagtaacttttgttctctcctctactccttcataaagaggtgctccctttgtcatggtcatcacactttcttctccttctttgattcccaattcaaatgtcatcttgtctttgaaagacttctatcctcccaggtagttagtcactatctcctatgtgtgtccatacacttgtttacaccacaataacctcatttatcacactattttaatttcatgattgcctgtttcacatgtcctggggagagaccatttttatttacctccatatgcctggtttctaaaccagatcttccaaagaaaacactcgataaacatttgctgaacaaatgaattgggtaaataatatggttgagataccaaaaaagatgtgaataaagcaagcagggagaggcaacgatgaactgaatatacagaaaggaaaccagcaggaagcagaacaggctccaacctacttccattaaaccctgcagaaatcagagttgtgcaacatggctctcctgtaacttggcttttctttttttttttttgagtatacttttaaagaaaggtttatttcccattgacttctgaaggttttttatcgagagtgaggaaggcggctcaggttttttaattacttcatgattcaatattttgaatcattttgattaaataaatttgacgaatggtctgacattcaaaagcacaatcatcaatcatcatgttcctgcaggcgtgtgtgtctatatgtatgtatgtgtgtgtgtgtgtgtgtgtgtatacacaaaatatatatatatatatatatatatatatatatatatatgtaatttttttttttaagacagagtctcgctctatcacccaggctggagtgcagtggcatgatctcggctcactgcaacctcagcctcctgggttcaagtgattctcctgcctcagcctcccaagtagctgggattacaggcgcgcaccaccatgcccagctaattttttgtatttttagtaaagacggggtttcaccatgttggccaggctggtcttgaactcctgaccttgtgatctgcctacctcagcctcccagagtgctgggattacaggcgtgagccaccacgcctggcttttttttttttttttttttctagagacatggtcttgctacattacccaggctagactcaaactcctgatctcaagagatcctcctgctgcctcagcctctcgaatagctaggactacaagtgtgcaccactatgcccagcttcctgcaggtatattttataaaactttctctagtgtctctgccactcccagcatgtgctaggtacacacagccaacttccaaactatacttgctgatcagttgagaaaagtgttcctgtctcatttagttcccaaggagatcaaggtcagttctctatgaatgtaaaccaaaaataaaattctaaggccccccaaccttctgaatggacttccttctcatccagggcactgttaaaatttaacctgaggctggttcaggccgtgatgggaagtggggttcagacatactcattaaaccctcactggccttaacatcaacacagacttagtctgataagaagcatttacatctatcctctcagaagcctgccacccagaggcttcatctgcatgataaaactttagtgtttataacctcttatcaacataacccagtcttttcctttctattgatcccaggtctttagataaactcaagctattgtcaaccagaaaatttttaaatctacctataaactggaatcccaccctccccttcgagttgtcccacctttctggatggaaccaatgtatttcttaaatgtatttgattgaagtctcttgtctccctaaaatgtataaaaccaagctgcaccctgaccaccttgggcacatgttctcaggacctcctgaaggctgtgtcatgggccatggtcactcatatttggctcagaataaatctcttcatatattttagagagtttggttcttttcatcgacatgagaagagctggagcaaaattacctgctactttatagtttctgcagtaagatgaaatttacagaatacatatattctccacctatgcattcattcattctttcattctaccattcatttattcatcaaacatgaatggtcattataataaagggacttggccaggtgcagtggctcacacctgtaatcccaacaactcaagagactaaggcaggaggattgatgaggccagaagttcaagaccagcccaggcaacacagcaagaccccaactctacaaaaataataataaataataaagggatttggggaatgccaagagaacccagagaacagaacgaacactacttgagaggtaaatcaaagtaaggtacatgtaatcaaggaggtaatatttgtgtaagaattatctaacatgaggtcggtggcaaactgagtgaactccaagtgtccttggagtgaatgacattgtatagtgtgcagataggctctgttataaagaaaggaagtttctgagcctgagagaaggactagttaaaagaaggaaagcacaagagccagtgtaacaccaaaaccactcctactcgtattcaaaaactgtgcgatttgagagtgatgtaatttcaaagaagtcacttcatcttaagaggtacaagaggccaggtgtggtagctcacacctgtaatcccagcactttaggaggccaaggcaggcagatcatttgagtcctgggctacacaaggaaactccatctctacaaaaaacacaaaaattagccgggtgtggcggtgcatgcctgtagtcccagctactcaggaagctgaggtgggagggtcacttgaacttggaaggcgaaggttgcagtgacctgagattgcgccactgcactccagcctgagcgacagagtgagacgccgtctcaaaaaaaaaaaaaaaaagagttaaacctttagaaacccagtagtcttcaaattacgctccttggagttctaaaagtttcaaggaggtacaacagaggtggggtagggaggaaagagggaaggttggaagggataccaacttcagtgagactagctctgtttttgtgttttatatattgaagcttctctgtaagatttcacctgattttttcttaaagataaatgacaacacactgaattccatcctcttcatttcagaaacaactaaataggtcaggtgtggttcacggctcatgcctgcaatcccagcactttgggaggccacagtgggaggatcacttgagcctaggagctcaagactagcctgggcaacacagggagactctttctctacaaaaaattaaaaacttagttgggcatggtggcacacacctgtagttctagctactcaggaagtagctactcaggaggtgaaaggatcatttgagcccgggagttcaaggttacaatgagctatgattatgtcactgcactccagcttgggtaacaaagtgagacagtgtctctaaaataaaataatgtaaaaaaaaacaagtagaagccaaagagattaagtaaccaagatcacacaatttaagacaaacagtaagtcatgctattgattttggacattgctgtgcaagtcatggagagccagtatttaaaacacagtataaagttgaatgtacttggcagggcgcggtggctcacgcctgaaatcccaacactttgggaggccgaggcggcagattacctgaggtcaggagtttgagaccaccctggccaagatggtataaccccatctctactaaaaatacaaaaattagccaggcatggtggcacacgcttgtagtcccagctacttgggaggctgaggcaggagaatcgcttgaacccggggggtggaggttacagcgaactgagatcacgtcactgcactccagcctgggtgacagaacgaaactccatctcaaaaaaaaaaaaaagttgaatgtacttgtttacccagcatcaagatgaagaaagtcaaaatcgtcgcagtccccaaagtcccctcatgctcccttccagcctctgtcccaccagggaaacatgatcccaacttctaataccatagattcgttctgtctgctaaggtacttcatatgaatggaattatgtagcccgttgtgtctcttttgttcagcatttggtctataagttgtgtcattatagatcctgtgttctcaaaaaaggaaaaaaaacacacacacacacacacatatagtatatgttctagttagagacccacatttggtagttatcagagattgggaatacttgtaatgtcagtgaattacattatccagggaaagtacatataaaaaaatatataagaagactggtcttttaagaggagaggaagacaactctgacaagcagtataggaacaaactggattttgagtcttgagacaaacacaccaattatgaagtgactggcatagtccaggtggtgagaacttgaacttgagcaatggagaagaggtatttcaaaggtagaatagacaggattttctggtcagctaaatgtggaagatgaaagaggagcatcacagatgggtttctatcttgggtgactgtagagcagtaatattaaccaagatagaagctctaagaaagtaggaatctagatattagatttgagggatgaacaacaaaatgttcaattttgagcacacctaatctgatccacctacaaagacatctagatggaagtgtccaagatatagtgaacactctatctagaaacccagatttcgtagtcattagggattgggagtagttgtaatcatgtgggtgaatgacattatccagggaaatcatgtataagaaaaaagagacaagaatagtcagaaacagaggttcagaaacacgagaaatcgggatacagagttaagagtttcaaggagaaaatggtattgtcacagaagttaagactcagctattagtgttggcaatctggagtgagtgtagttctagcacagtgatggctatagaagccaaattgaagtagattaggcaataaatgtttaaaataaggggaagagcctgggtgtggtgcctcacacctataatccaagcactttgggaggctgaggcaggcagatgacatgaagtcaggagaccggtctcacggtcaacatggtgaaaccctgtctctattaaaaatacaaaaatgcgccgggcatggtggtgagtgcctgtgaggcgggagaatagcttgaacctgggaggtggaggttgcagggagccaagatcgcaccactgccctccagcctgggcgacagagcaagatttcctctcaaaaaatacataggaaaaaaggtaagatttaagaaagggaggcagagttattataaggctttagtttttaggtgacagaacaaaactatttttagacaaaaaaaagaaataaagatttaatttacaaaaaggagatgggagagaagttacctaatggaagttagggccagaaaaagaagtagtagacagctctagaacacgaagttagaacctgggacagatatttctgtctctaagaatgaagttcaggaaggggagtaagaatgaacaaaggcatacataagtttagaagcagaagaaagagcgattgagaaggtacagattttcttctaccatttttttttcttttagagatatataatctttttgagacagtcaatgttgccaaggctggagtgcagtggcataatcacggtgcactgcagcctcgacctcccaggctcacgtgattctcccacctcagcttttcaagcggctgggaccacaagagcacgctgccaagcccggctaatttttaaaatttcttatagaggtgcagtctccctatgttgcccaggctggtctcaaactcctaagctcaagtgatcctcccacctcagcctcccaatgcaagctttctttgtctctcttctttaggctcagacaacagtccaaagggcagagctaaggacagactccttgatctcgtaggccctcaagtgtctaagcacaaatttctctcctcttcaagccataaaagagaaagacacatgcaaatcagttcccatgactcaaccagatatgtgcatttcagcttgcattcaaatcagcttaggccctacacatcaaaacatttgttaaaatgaatgaatgtgaaggaaaacattctaggcagaggttactctgcaaaagcagagtaactagtgtggtctggaaaaatagaagattacttactcacatgaaatagtgaagggctggcctggcacagtggctcatgcctgtaatcctagcacttgggaggccgaggcaagtggatcaccttgagctcaggagttcaagaccagcctgggcaacacagtgaaacccctctctaccaaaaataaaaaaaatcagccaggcgaggtggcatgtgcctgtggtcccaagtactcaggaggctgaggagggaggactgcttgagtctgtaagatgggggttgcagtgagtcaagatcgtgccactgtactccagcctgagtaacagagtgagaccccatctcaaaaaaaaaaaaaaaagtgaaaggctaacaacaatgcaaggaaccataacaatagatacaaaaataagtacaatgttaatgcctagctgatacaaatgtcaattagcataagatccttaaaacaacctgaaaaattaaacattaaaaaatatatatataatagaaagtgaaagtccattaccaagaaaacaatcattagcagttttgaatagattgttccagatatttcctatttatacactagcaaataccacttttacacaaatgaagtcatacttcattgttctgcttttttcatgttaccaatttttcacagtgaataagtaatcttctatttttccagaccacactagttactctgcttttgcttgtactgtaaccactgcctagaatgtttcccttcatgttcattttaacaaatgttacaattaatgctacaataaacattcttcatacatgtgtgtaaatataggtctgtggacagatatgtgcttccaaagataaattctagaagtggaagtagcaggttagagagcatgaacattctaattttaatagataataccaaacagcctaaattggactttacctataaagtctctcaatacaggctgatagcataataccaataagatgcggtttagagacacaaccctctaactctgacttaattcaaaagacattttagagtacctataccagtaatatactccatttcctctaagcaattttccacaaacattatttcccttaactaagctttcctctccaaataaatgtaatttataagcacatgctccacaaaaatctcaaacatgaaaaacttactaagcggactccacagacaggggaggaggggtgaacctgaagacccagtcctgattaccacagttaacagtttggtatttgtttttccagatttattttatgcatatataaacaaacatgttatttttcaaacccaaataaaattatgctagccaattaatattctattattttcattacacatattacagatatccttccatagcaatatataatacatcaatcatatccttttaaataggtgtacagcattttattatatggatataccagaaattaagctatcttccactggtggacattaagacggtttccagttttttgcctaacaaaccatactactttgaacatcctcatcctcatatatatactgagtatttaggtaggacaatacttctagaagtagaattaatgggtatcaagttgctttccaaaatttattaatagtaccattttatattcccattggtgtgtaaacatacttgtttctgtataatcttgccaatatttggtatgaacaattattttatgtattgccaacctgagaggcaaattttttctaaattttcatttctctgatcattagggaactcagcatttttcatatatctatcatgtatatttctcctatgaattgcctattcatttattttgcccattttctatagcatgctgttcaatggaaatgcaacacaaactacataatgtaattttaaatgttctagtagccacattttaaaaagtaaaattaggccaggtgcagtggctcacgcctgtaatcccagcactttgggaagctgaggcaggtggatcacctgaggtcaggagttcaagaccagcctgtccaacatggtaaaactccatctctactaaaaatataaaaattagctgggcgtggtggcgggcacctgtaatctcagctacgcaggaagctaaggcaggacaatcgcttgaatctgagaggcagaggttgcagtgagcccagattgcgccagtgcattccagcctggataatagagtgagactacatttcaaaaaaataaataaaaagtaaaaataaacgggtaaaatctgtattaatatattttaattagttcatatctaaatattatcacctcaacatatgatcagtataaaaattcttatgacattttacatttttgtactgtcttcaaactccagcttttacacttattatacacttagagtacttctcaatatagaactagccacatttcaagtgctgattaaccacatattaaaggctactgtatgggatagtgtggttctataggatctttatatgtgagagctcagatttcccccatttcagccttttttcccctatgtttttatttttactgtacaaataatttaaaagcaaaggcttcaaataatgtacaattatgaagagcaaaacatgacagtcattctttattacctcactcacagtaccatctccaagataaccatatcagccactgaagtacattctcacagcctatttttacatattatataaacgtatatatacccatatgtattttacattgtctaaaccttcttctaagataatacccatcagaaataccacattcgattctacataatattcaacaggatgggtagatcaaaatttattttttaatagacacataatacattaatactctcattgtaaaaacttaaaacatacaaataaagccaattcttttgaccatccttccccatcagtctctgaaaatacccagtgctgttaacaacatgacctgtatccacggatctttttctatgcattacaataatagatattatattaatagtaagcttttacctgtaacatatgctataaatgcttttaatctagcttgtttgtcttttaattttagggcatctttcattataccaatttaaatttgttggtctttcttttatgactagtgagtgtcttgtcatacaaagaaaggcctgtctcataccaggtcttataccagaaaattgtcctatattttattctagtacctctatgatttaagggttttatgtatatatttgatctacgtggattttattttggagtgaagaaatggatatgagtccaaattgtttgcgctacccttctaccaccaccacttgcgatgtctagcagtgtctacccttcttatctctatgacctctaagactgtatcccagcccacaaagatggaaaggcagaaggctacgtagagtatagcacagaaaggagggtgggggattaactgtagagaggaaaaacttgacaaacactactttagccagctggtcaaggtcaacatcaacagtcataaagcatgcagacagtatgtgctcttgataagatgaaagtatcattttgcctttgtcatcttcctcctaaaaattcactaacttagtccaagcatgacaaatcatcaaattccaatatacttacaatatatttatatatctcctacaatatctgtccagtaacctctcaaaactgtcaaagtcatcaaaaacaaggaaagtctaaggaactgtcacaactaagaggagcctaaggagacatgacagctaaatgtaatgtggtgacctggaacagaacaaggatattaaataaaaactaaggaaactgaaataatgcatagacttcagttaatcataatacaatcagtattgttcattattcctaacatatgtaccatactgatataagatattaataatagtggaaactatgtgtggggtacatgaagggatatatgggaactctgttctactcgctccatttttctgtaaatttaaaactgtttaaaaaataagcctatcaattttataaaaagcaaatacctcagaagtagaagagtataggtaaatatgtgcctctaattttgaccacattcattaaaaacaaaatacccacttgatccacatggaaatttatcttttttttttttttttttttttgagatggagtctcgctctgtcacctaggctggagtgcagtggcatgatctcggctcactgcgacctccacctcccggtttcaagtgattctcctacctcagcctcccgagtagctgctactacaggcacccgccaccacgcccagctaattttttttgtactagtagagacagggtttcaccatattggccaggctggtcttgaactcctgaccttgtgatctgccgacctcagcctcccaaagtgctaggattacaggcgtgagccaccgcaaccagcagaaatttatcttaagaaaatatctaaagaacaaaaatagattgcaaggatgcatagtacagttttaccaatattagaaaaaatacaaataagctaatttatccaaaaatagagaaagaagcaaaaaattaaagttacattcactcagaatattatttacctattacaaatgacaatttcaaggctataggagataggatatgtttattatataatgtaattaaaaaaaaaatacaaattgtaggccaggcactggggctcacgcccgtaatcccagccctttgggaggctgaagcaggtggatcacctgaggtcgggagttcgagaccagcctgaccaacatggagaaaccccgtccctgctaaaaatacaaaattagccatgcgtggtggcacatgcctgtaatcccagctactcggtaggctgaggcaggaaaatcgcttgaacccagaaggcgtaggttgcggtgagctgagatcgcaccattgcactccaccctgagcaataagagcgaaatgtcatctcaaaaaaaaaattgtagaatatgaatgtaaatttgggttttcttttttttttaatcttacatgaaccacatataccaaaatgttaaacaattaaaaacagataaggctaaacacggtggctaatgtttgtaatcctagcgcttttgggaggccaacgcgggagaatcattcgaggctgggagttcaagaccagcctaggaacatagtgagaccccatctctaccaataattttaaaattagctgggtgtgatgggtggtgtgcatctatagtcctagctactcaggaaactgaggtgggaggatcacttgaacccaagagttcgagattacagtgagctatgaacatgagactgaactccagctggacaacagtgagaccctatatctataaaaataaataaaaattaaaagtgaaaaacaaatactaagatctcagtaaagatcttactcttcagtaaagagaaggctatggtaaacttacaactagtttttcaaatactatgatttttttttttttttttttttttgcccaagctggagtgcagtggcgcgatatcagctcactgcaacctccaccttctgggttcaagcgattctcctgcctcagcctcccaagtagctgggattacaggtgcctgccaccatgcccaactaattttttgtactttttgtagagacattttagtagagacaaagtttcaccatgttggccaggctggtctcgaactcctgacctcaagtgatccacccgcctcagcttcccaaagtgctaggattacaggcatgagccacagcacccggcagcccttgtctatttttcagtctattataaacaataataaataacaagtctcttttactaaaagcatttaactgaaattaccatttcatctcaaatccagtcatgctacatccagtgctaaaaactacagaggaaaagtacactacaacaaacacaccctattgcaggggcagacagagcctggcatctaagctgatgccataccccataagggcctgcatgggaataacttttatctgtgattggtagtttcacatctcaaccaaaaggctaacagaataaaagagtaaagaaattcaaagtagcagctaacgggcagaaaagcattcgtccattttcctatgctatcaagccaatttgaagttttttaaaaaattaccaatatacttcaattactacaaataaagtatactatcgctgcaaaaaaaatagcacttttgaatataatatcaaaagaatcatccaagaaagcaaacataaaataataataaatgtgggccagttgcagtggctcacccctgtaatcccagcactgctggaggccaaggcaggatgacagcttgagctcaggagtttgagaccagtctgagcaacatagtgagattctgtctctacaacaacaataatcatcatcatcatcatcattatcatcatcatcaatatgcaatgagaatttttttaaagcaaactccaaaatctaacagggaaaaaaattaccaggaaaaaataaaatagagatattgtaacatggaatttgttacactaaaaccaatagcatacccagaaaacatccttcactcacaacaccacctaaccaaagcaaggtctcacttcccccaaatatttcaaaccacaaatttacaaattcttttcatcaacctgaattatttaatttgagtggtcatagacttttttattttaatctgataaaacctatggttgttctccctggaaaaacacaaatgtacaaaatatggcacataattctgaaggtttcacacatccaaagccaactgtagactttcagacagttcatgtgttccatagcttaaatgtttaatgataacatacacaaaccctcattcttaaaaaaagataatgaagtgggaaagacccttccaattatgtaatccactcattcccaaactatttttttaaaggaataaaagaatggctactccataggccgagcagcagcctcattcccaaactattctaaccatcacccacctaagtaagacaagagatccagcctacctacctcctcccattttctagtgcaaaaataactccctaaggaagaattgtagcaatgtaacaagtacacaagagcaaaacggtccacaaaaatttaaatgtaacattaattctacaattgtattaatccaaaaataacagcaactggaaccacagccaatttgagacaacaccactgatgtagtgaaaatatcttctgagtgtgggcatgcatagtactaattttctagtgctgccaaagcatggtatagctgacagatttcttagaagaaaactaaactagagccctcggtaagttctagaaaccagctaattttagttgtgaatactaaatttcagtaatccttagtaactcagattattggtaggtagcctattctaatacataaatatcagaggttatgggaatggaataacaatagcccctgagaactgaggagacggcttgtatttctggttcatgatccattaggaaaagcttctgatctagtgagtgtcttggaccatactgaggaagcattaatctaagccaataattttcaacaatttttccactgtgattctgagtaatggctcaccaatagtataaaattaacctcctaaactggaacccacatacattgctggtgggaatataaaatagatcaactgctttggaaaacaattcagaatttcctcaaaatgttaaacataggttaccatgttaagtcagcaattccacccctcagtatgaacccaagataaataaaaacatgtcccaaaacctgtacacaaatgctcacagcagcattattcacaatagccaaaaagtagaagcaaccgagtggaagcaaatgtccatcaactacagatggatgaatgaataaacaataaacaaaatgtggtatatccatataatccataaaatattatttggccataaaaaggaatgaagtactgatctatgctataacattgatgaatcttgaaaacactatggtaagtaaaagaagtgagtcacaaaagaccatatattgtataattccatttatatgaaatgtctaggataggcaatttcatagacacagaaagtagactagtggctacctagagctagcggtgttgagggagatggaaagtgactgccattgggtataggaggttcttttaagaacgacgaaaatgttctaaaattagatagtgatactggttgcacaagtctgtgaatatactaaaaaacactgaactgtaaactttaaaagggtgaattttacaatatgtatctcaataaagctgtttttaaaaaatctattcacgtgacatacaaggtgttttaggctctatcttccgcctaccctaccaggtatttcaacctccccacctccacctccacttgatcttattcccatgcctcctctctttgcacctgtggaactacctgccttctgagtgacacttctactaataatagcttcctttgccacagtcccattttgtcttgtattatctcattaaactacataccagctagtattgttacttttgttttcacgcctgccccgcttctattagactgtgagctcctgaatggctctttaacttcatatacctagtgcccagcagtcactcacatggtaggcactaaaatattctttaataagcacaggttagcattctttcaactgcacagaagacaaacccagcaacttgagtttgaatcccagtgcaagtacttcctagctttgtggacttgcacatgacatagcttcaatttcctaaccaaataatgtggatacagtagacccccttatctgcagtttcactttctgaagtttcagttacctgtggtcaaccatggtctcaaaatacaaaatggataattccagaaataaacaattcataaatttttaattgtgcaccatcctgagtagcatggtaaaatcctgcattgcccgcatctgtcccaaccaggatgaaaaccatccctttgtccagggtgtatccactgtgtctatgctgcctgcccattagtcacttagtagctgtctcagttatcagaccgactgtcacagtatcacagtgcttgtgttcaagtaacccttattttacttaataatgaccccaaagtgcaagagtagtgaggctggcaattcggatatgccaaggagaagccacttccttcaagtgaaaaggtgaaagttctcaacttaatatagaagggaaaaaattgtatgctgaggttgctaagatctacagtaagaacaagtcttatatctgtgaaattgttaacagtatattgttataattgttcaattttattattattaatctcttactgtgcctaatttataaattaaactttatcataggtatgtatatataggaaaaaacatagtgtatataggtttctgtaccatccatggtttcaagcaaccactaggggttttggaatgtattccttgcagacaagcaaagtactactgtaatcgtacctaaatgccaggttattttaaggcttagatgtcatgtctggaaaacatctggcacatagaaggtgtccataaattatgattattacaacaattatttcaacattattttaattataatcactaatcaacttttagttgtaatcacaatcactaatcactaatctaatttgttttactgaaacaaattagagttgtgccaattattaataaaaggacatgtttttctcactttaatcaatatttgagaaaaaagttatcatttctatctagaggcttagggtcccaaatatacaaagcattaagacctaaaagcctcaaagaggataacttctctatacaaacttagttcttaattctagttctgcaatttagcaacctcagtttagatttttaaacacaaattataagctcagatttttataaatattgagtttagccttcaaaaaaatcaaccaataagccaggagacataaaaggacaggaatagcaaactaatactgaagtggttagtactcaaattctattgaagatttaaatcaaaccaatttttgaagaatagtcaacaactctgaacaagacaattcacccacacaaagggggataaaaatacctaagaatagcttgtgactcagcctgcattcctataaggggtcccagggggactgataatatttagcctattgtcatctgtctcatatcagaactaaatattacagcaaaactatttacttgacatgaataaaaagtacagagggaaagaaattcagacagatgcttcactttcaagtaaaacatcacctctttgaaacaaagacaacttttaagttttgaagccatacaagaaaacaaaagaaagaataagcagattctatatcatctatataacaaatatttaaaacttccttgaaaacaaacttaaaaggtaaatggggaaaaatcacaacacatgataagcagttgatatttttaatgtacatagggctattaaaatagataacgaaaacactaagacctcaaataaataatctacgaaagaagaaacagaagaaataaaagtagttaataaatgttaacatcactaataattaagaaaacgaggctacccacagtggctcatgcctgtaatcccagcactttgggaggctgagtgggggcgaatcgtctgaactcaggagtttgaggccagcctgggaaacatggtgtaaacctgcctcaataaaaactacaaaaaaattagttggtcccagcgggaggctgaggtgggaggatggcttgagcccaggagaaggaggttgcagtgagctgagatggcagtgagctgagatcccgccactgcactccagcctgggcaacagagccagaccctgtctcaaagacaaaacaaaacaaaacactggccaatacccagggctagcaaaggtgaattaaatagggtgcttgcaggtacagcccatgggaatacgtattggtatcactcttcagaaggcactgtgaaaacatatatcaagagtcccaccaacattcatatcctataaagcaataatttcatttctgggaatctgtcataaggaaataacagtaaatgtgggaaatgctttaattacaaagatatggcagcattagtaatcattgaaaaaaactaaaaatgaatgtccaaaaataaaggaatatactaagccaagtatcatgcttccacttaaaatcaaattcatatgatatgtgaattaaatctcaataaagctattttgtgatcaagttcagttagaccacataataacatggaaactgcttatgttcttacaatttaaaacttacattttgatataaatgtgcatatttattatgaaaattaaaacagcagccatcaatcatcaatatttactaagtgccaagccctacactacaagttgttacatgttatcatggttacctcattatcactgataccatcaccaggcccatcctggaagggtctcaggcccaaggccatcaccaactgtggggctggcccaagataaaccacactttaaagaaggcttcactaaacattttcataggccccttgagaatgttaaaaacaaatttggaaattgagcccagtgggattgtgggtctgtactaccctacttttcagccttcttatatagattattccgatggtaagattaaaaattaagggcaaaaggctaatttcctttccagtcacggtgtaaaacaaagaccaaaataagaactatgttaggttagtttgaaatttctcactgaaccaagttaaaacaacaggtaacattaggcacttacactaagcagaagtcactgtgctaagcactttatattacatataacaacactaggaactagctaatatttccccatttcacacataaggaaacagaagctgaagagaattaaagtaacttgcccaagattatacagttatttggtgtcagagctggaagcaggtctaacttcagaggctgtactcttatcctctatggttatgatgaaaataaatgaaatttttattaaaatcacatatactttatctaaaatgaatacgcattcgtgaagaaaatgatcttaaaaatatgaaacagttaaataaaacaaatgtttaccgtctggtaatagtcccctaatccactaaatgtctgccataatccactgctgaatagctccacaagtaaataaatcatttaatgtcctgatgtatctatgaaattatattttaagtgaaccttttgaaacaatactatacattctgcaaatgaaatatgctgccctcttggagctgtgaaaatacatatttcttgatctattaactgtcctaattctgttcagtttcctcccttcctctcccacttcctctttgctctcatatcctttaagaccagttcagttcctcctcctcaagaatacctatattcacactttacccaagagaactctaacattagtttctgcgctccacagctgtaggatgttacaaaatccaaaaaatgaactcaagtaaaaaatacagtatttctgatgtaccttcaactttagatctatccacttacagaattaattataaacattcttatttttctacttcacacttggaatcctgtctttaaaatcagcacacagtaaccaaaacagcatggcactggtaccaaaacagacatataagccaatggagcagaacagagacctcagaaataacaccacacatctacaaccatctgatcttcaacaaacaagacaaaaacaagcaatggggaaaggatctcctattctgtaaatggtgctgggaaaattggctagccatatgcagaaaactgaaactggaccacttccttacaccttatacaaaaattaacttgagatgaattaaagacttaaatataaaatccaaaaccataaaaccctagaagaaaacctaggcaataccattcaggacataggcatgggcaaagacttcatgacaaaaatgccaaaagcaattgcaacaaaagccaaaattgacaaataggatctaattaaactaaagagcttctgcacagcaaaagaaactatcatcaggctgggtgcagtggctcatgcctataatcccagcactataggaggccgaggtgggaggatcacctgaggtcaggaattccagaccagcctggcctgcatggtgaaaccctgtctctatttttaaaaaattacaaaaaggccaggcatagtggctcacatctgtaatcccagcactttgggaggccgaggcgggtggatcacctgaggtcaggaatttgagaccagcctggacatggtgaaaccccatctctactaaaaatacaaaaattagctgggcatggtggcaggcgcctgtaatcccagctactcaggaggctgaggcaggagaatcacacttgaaccccggaggctgaggttgcagtgagccaagatcgcaccattgcactccagcctgggggacaagagcgagactccatctcaaaaaaaaaaaaaatagctggacgtggtggcacatgcctataatcccagctacttgggaggtgaacctggtaggcagagattgtggtgagccaagatggcaccacggcactccagcctgggagacagagcaagaccctgtctcaaaaaaaaaaaaaaaaagaaagaaaaaaagaaactatcatcagagtgaacaggcaacccacagaacgggagaaaatttttgcaatctatccatctgacaaaggtctaatatccagaatttacaaggaacttaaacatatctacaagaaaaaaaaaaccccaccaaaaagtgggcaaaggatatgaatagacacttctcaaaagaagacatttttgaggccaacaaacatgaaaaaaggctcaacatcactgatcatcagagaactgcaaatcaaaaccacaatgatggccgggtgcagtggctcaagcctgtaatcccagcactttgggaggccaaggcgggtggctcatctgaggttgggagttctagaccagcctggccaacatgtctctactaaaaagacaaaaattggcagggcgtggtggcaggcgtctgtaatcccagctactcaggaggctgaggcagaagaatcacttgaacccaggaggcggaggttgcagtgagttgggatcgcgccattgcactccagactgggcaacaagagtgagactccgtctcaaaaaaaaaaaaacacaatgagataccatttcatgccagtcagaatggtgattattaaaaagtcaggaaaacaatagatgctggcaagtctgtggcgaaatggaacgcttttacactgttgctgggaatgtaaattggttcaaccatagtggaagatagtatggcaattcctcaaggatctagaaccagaaatatcatttgacccagcaatctcattaatgggtatatacccaaaggaatagaaatcattctactctaaagacacatgcacacgtatgtttactacagcactatttacaatagcaaagacaccaaaccaacccaaatgcccgtcaatgatagactggataaagaaaatgtgatatacatacaccatggaatactatgcagccataaaaaggaatgagatcatgtcctttgcagggacatggacgaaactggaagccatcatcctcagcaaactaacacaggaacagaaaatcaaacaccctatgttctcactcataagtgggagttgaacattgagaacacatggacacagaggggaacaacacacaccaggacctgttgtgggggggcaatgagggaaggggacttagaggacgggtgaataggtgcagcaaaccaccacggtgcacgtatacctatgtaacaaacctgtacgttctgcacatatatcctgttttttttgtaagaaataaaaaaaaatcggcacacaagaaagtctgcctttcttcaaaaacagttttttcacaaattttttccataaataaaaaaggtactaaaaaaacttgaatccaaaaaaagaaaaagaaaatgcaccgttagatggtaataaatatatcacatttttggtaatgtaactcgtttattctgaatcatttctggaacttgttaatataaatgttttacaagtaaatacaatatgtaaaaatgctacttaatggactaatatgtactttcactcattcactaaacacatattttttactgaatgcccatataactttttttttcttttttttgtttgagacggagtctcactctgtcgcctaggctggagtgcagtggtgcgatctcggttcactgcaacctccgcctcccgggttcaacgattctcctgcctcagcctcctgagtacctgggactacaggcgcacgccaccatgccaggctaattttttgtattttttagtagagacaggatttcaccttattggtcagtctcaaactcctgacctggtgatccgccctcctcggcctcccaaagtgctgggattacaggcatgagccagggcacccggcacatagataactcttttttaaatgtatgaaccaagatgactctaccagataaggcacaggtgctgcagttaaaaggatcttggtttgaaacctggctattgtacttactagctcagagacctaaagtagtcaaacttcaggttaacatttcacttacctttttgatgggaagataataattactcctagggccttagtgagctttaaatgattatgtaaaacacttagcatagagtctaacatgcagttacgtgctcgataaatgacaaccatggtaaacatattttatactgaagaaagtatagttgaaggagacagccaatatgtgacccttttgtcttactaaagatggaaatttgtgaaactctacattaaaactaaaaatcctaaggttacatgattttctactttttaaaaaagatatactaactacataaggttaaaggattttttaaaataagaaagaaaaaaagaaaagcttcttgaaagctgctgagtttgggtgatgggtacatgctatttttgtgaaaatacaaattttttaacactattaatccaatccccaaaacatgcctaacacacctcctcatattcaggagagatcaagattttagccttgagatgtaccgaacaatggtaactccctgcttagtaattctgtacaggtcaagttttcttggacgagtttacctttcattacaaaggtgggcacagggaatagttatcaatgcatggaagggtgaaaaaatgcaagcttttcaactgcttattaatattacatcaaaatagcagcaatgcacattttttccacgttttcaaaaacataaaatacatccactttatttacttttgaaattacaagagagtcacaggcacagccaaaaaaagctaaaggaaaacacatcagagttgtcagtatctttaaatttggaaggacgtcattattaattcgcgtaaatgttttatgcgatgtttctaggtagcttttaggttttatcactgattaacaatatagcaaaccagcacagggagagaggcaatttttcgaaacgcttaagaagctttaaactacaagagctatgctacctaaactgagctcactaacaacgtaaaatttcaagtcacaccttgcctatttctgagtaagcaagcaaacactagtgagacaaactagaagcatggagcaaagcaagtcatttctatgctaaccttaattcctatcgtaaaggggttggctccatcaaaaaatattcctatttcagtattaacacaagtttcaaataaagcacacttgccattggtaattctagagcgacaaggcgcataattaataaatccaaacggagcatctttctatagaatacaaagccatctgcagtttcagcctcggtttacccactcactatgcatatgcagacgtctttaaaaataaataaataaatacacaaataaactttatctggcctgagagattacatctctcggtgcttcctgtatattctggaagtcaataacgctgaaggtaaatttaacatttccaactccggaggaacgcgagcggtagacgccaagcatccgcccactgtcctctcgtgactcgggctactttgacgcaccgggatgcggctcacctgacattcggcaccaacccttgccaggaaggaaaaccaactccgcgaaaataaaatgggtccccgaggaggcgtgcgggtgcccccagagctctcttctgctcacaccccgaaagcgagggggccacgccacccccgaccctcgccggcgtccgccacctgccagacgaggccgcggccagggacccgggctcggccgcaaggaaggggcagcccagcccaggccccctcggcgtctgtcccggcccggcagcagaggaaggaacccggggccggaggtttccgccccgcacggccgagcccgccaggggcctagctcgggggccgcccgtactcccgaggacccgtccccatcgtgcggagcgcacagccgcctcagcccgacccgcagagcctccgggcagcgggcgcggcgcccgcacctgccccgcgccttgctgcagccccgctagcggcttcacccacctggcgccctcgccgcgcctcccgctcgtcacagcgcgactccgcgtccctcagcaccggcagcctgggcgcgggcaggcgcggggagaccctgctctgccgccgtcgccgccactgcagctggcttggtcgtcaggccgccgcccgcgaacctgttgcgtagcctgtcacagccgctcagggctccgccggcgccgcctcagccccacaacaacatggcggccg

SEQ ID NO: 1832 - DNA, 157663 bp, Homo sapiens; identical to SEQ ID NO: 1831

SEQ ID NO: 1833 - DNA, 140210 bp, Homo sapiens
tagtagaaatggaaagtcttcttttgttcactcaagcacaaatcattttaaagtgctactcgaataaggatagctgtcatcagcgtagaggtcactggtataaacaaacagtagctatatgatatttgggaactattttacaatatgctcccattgggttttccaaactgatacaaccatgaggtgaacactttcactgtttcacagttcctccagagataccagtttatgaaaatgtcagatgttaaaacagatattaggcaaatatccaaggaagctacggtctgccataggcccttcccatccactctatccccgtccttccttgatggggctcctgccacatccaacgaagccatgcgaatgccctcttgttctcccgcttcactctgagtgacctcatctgggggaaagagctcattagagactttcaatctcaagcattatccggcaggcagagacagcatttggaggatgtgagagcttccgtcactatttgtgaattcacacatcaaaagtgatgccttgctttgactctgcgtggaggcagccctgagtctgatgcccaccatctctcatgagagacagcagataccccgagagctagccagcagcagcctcctcacctcgacgacgagctgaaggtcagccatgtaccgctcttcggtctgaatcagctcatgaatatagccctgtcttttcctctcaattggctgcattgtgtccagggtttgcagatcagcacaccctgtggaaaaaacagggtagtttaaaatattactttagtcaactttgtagaaaatagacatttgtcagcagatgtgctgggtttacaaatgctgctttgaaagaatgacgcagccttaaaaaggacgctgctaacttctgcagagcagcatgcgtacgcggagagttggcattaatgagccggcactcacagctccaaagtggcaaatcagcaatgtctgtaacatttcaatgtgctcctaatttcttttcagaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagaaattaccatgcatatggctttggtaaatattgtgaaatgtttagttatgtatgtattcgaaatgtaaaatgtatttctcactgtgagctactgttaaaaaaatgtttgagaaacagtctctagatttcttaaaggaaagttctaaggttataaaacctgaaattcccagatcccagcaattcccagaagaccactgcctcatctcactagaacaaataactcctggtacactgcagatatccagccacaaatgacaggaaagtcacaagcaaccttgcatcagggtgagaggtactgcattcactatggatcaattcacaggcacatcacagctgaactagatgtcaaactatgaagtgacataattccagagtcacttaacaagtagctgagggcttgcctatacacagtgatgtggcgaaatacctcaggaaacccttcttagaaaaaaaagcaaaagcagccgggcatggtggctcacacctttgggagtaatcccagcactttgggaggccaaggtgggtgtatcacgaggtcaggagatcgagaccatcctggctaacacggtgaaaccccgtctctactaaaattacaaaaaattagccaggcgtggtggtgggcgcctgtagtcccagctactcaggaggctgaggcagcagaatggtgtgaacccaggaggtggaggttgcagtgagccgagatcgcaccactgcactccagcctgggcaaaagagcaagacttcatctccaaaaaaaaaaaaaaaaaaaaaagcaaaagcagtggaagttgtcagaatcaaaatggagtcacttgtgttaaaaatcctgacaaagggccagggaaggccatgaagagagagttctcatccatgaatacttgataactagaactatcacaaaagactgcaaaaccacaaacttacataaaggccatggtgacctgacacaaaaaaatagtcctgcaaggttatctgcccagcaactgcctgtccaacctcggacaagtgccacccttattgattctcacggccaaggataattatatatttaaaaaaattatgtgatcctcttcatttttcctttaaaaacttttgtcctcctttagttctctgaatatgcacctgttggtatgcatattcccattacaataactatttttcttttctttttttttttttttttttttttggagacagagtctccctgtgtcagccaggctggagtgcaatggcgcaaatctcggctcactgcaacctctgccttctgggtgcaagtgattctcctgcctcagcctcctgagtggctgggattacaggcacacaccaccacgcccagctaatttttgtatttttagtagagatggggtttcaccgtattggccaggctggtctcgaactcctgatctcaggtgatccgcccaccttggcctcccaaagtgctgggattacaggcatgagccccatgcccggtgcaataactattcttaaataaatatcactttcttttagagagtctccctctccgttatttaggttgacagcatgtaggtacccagcaagctacaacatgaggcagcaagtggcttgtgtcagaaaactgggaaagagacgaatgaagtagggaagaccttctgtagctaaggcaaccaagaagggcagcagagcgaaggcgcaccctgcacctgccaggacactgtccatccagcagggcgtgttgctctttccaatttcctttgcatttgtatacattttgtatagatctgggcttacagacagttctaaggaagacagcttttctatattctacagatgttgccaacagctttaaagaaattactcccacagagaacaaaaaaataaatgaataaggcaggttatgtttggtgtttctaaaaagaaatcatagactgtggtgcctgtaatcccagcactgtgggaggctgaggcgggaggatcacttgtgcctaggagttgaagaccagcctgggcaacaaagtgagactctcatctctaccaaattaaaaaaaaaaaaattagccaggcgtggtggcatgtgcctgtagtcccagctacttgggaggctaaggctgggaggactgcttgagtctgagagttcaagtttgcagtgagctgtgactgcaccactgtactccaggccagataagagtgagaccctgtttcaaaaaaaaaaaaaaaaggaaaagaaaggaacagggagaaggaaggaaaaagtgaatgtaaggggaaagggaaggggaggggaggggaggggagtgagggaagaaggaaggagtgaaagaaggaagggaagggaaggaagggaaaaaaaggaaagaaacaagaaaaagaaagaaagaaaggaaagaaagaaaaaaaagaaagaagaaaaataaagaaaagaaagaaataaatcataatgccactgtcatgttcaaaattgttacgcttttagggagatagtattttattatcttctgccagggggaactgcagagggtaactgagtgttaaaaaaaatcactgaggctaatccaaatgtctgcttgacgaggcttttgtggagcaaggagaggcttggtgaccagacacctggcgaaatggcactgatcctgatatgatccagtggtgctactcggtgtggccaggtgattgatggagggaactcagaccagtttccaaggttgccccacctcccacaccactgtcttacaaacttcatgttctgctttcaagacttttgccatatccacattccatctctattattatttacttaatatttttctctaaacgtactcgtgtttgaagttaagtgtgctcattatgtttcttctaataatcattaaagcaaatatataatcattcgaatgaaacaggtccattttgtgtaccagtgcgttgagcaccacaaggatacaactatcacaccttgggaaacaatgatttacattaaaaaccacaagtattggccactgtatctggaataataccttggaataatagcaagaacctcagatatttgtttctaaaactagactatacattgcattagctgtagcaggataatgtggggacacccctggcatgccatgcctagctgacccttttgcatttcatcatgacggctcttcaactttttttttttttttgagacggagtctcactgtgtggcccaggctggagtgcagcggcgcgatctcggctcactacaacctccgcctcccgggttcaagcgattctcctgcctcagtctccgagtagctggaactacaggtgcccaccacacccagctaatttttgtatctttagtagagacggggtttcgccatgttggccaggctggtctccaactactggcctcaagtgctctgcccatctcggcctctcgaagtgctgggattacaggcgtgagccaccacgcctggcctgctcttaaatttttaccctctgtttaagtttccaacccagctcctaccctcacttccagatgctcttacctctgatgtcagggaaaaaataaagacacgaggcctctcttcctccccttctgtctgtccatttgtccctgtgtgtccttcctgagttagggaaggaggggtcctgtttctttctaaagccactgtctgtagtcagcctctcctccagggcccctccctttccttcacgcttctatgttcactcttcgccatttccttcttagcccataaacattgctaagtgtccctcctatcccactgtttgaaaccaaccaacaagcacacttctccaaccctgccccctcctcagcaccgcctgcctttggtctcattggcaaatgtcactagaggggtttacacccatggccaactctcgctagctttccctgtcacatctccactcgggattctggtttctgccccactgcccgacactgctctcgggaaggtatcgatgaccttggcattgccaagttcagtgacctcttctgagcttgcaccctcccctgccggcccacagcacaggcgccttggatgggaggcttttttggagacttgagtctgcctttctcagcccttgagcctctcctcttcttggtgtttccttctgtcttctgcctcttgcctgctgcctggctctctgctccccccagtccagcaaatgccaaaataggctcctgatgctcctgtcctgtgcggtcagatgaatccagacaatgctgcaggctgtatatctcactcgcagggccccagtgcacattagcctattaggcagtgagaaactctgtgctacagaaaaatttgatgagctcagggttcccaacacgtatttgaccacagaatcctctttttttgagaggagggagggtaacatcttttttgtcctgagaaaagtcctgatgaactgaggaattcgggttttatggataggatacacccctttgccactctctatacctgcattgtcaatagagtagcccttagcaagctgtgaccgctgaacacatgcagtgtttccatggtactggtttgtatctgtcttttaacattacacatcgtctaactggtgctgttgttaatctgtgtagttacggtgtcagtggctctgactgcagaccagggactgtgtctaacacatttctgtaatagcaagctgagcacagcgtgttggctacctgcagtcagggaatatttgttaggggatagaatattgtgttggtcctaggcctgtttgtgcccaggtccatttctcaccttttccctgttctgctctgggctgcaaaaaagccaatcctgcaggctgttttttctaagcttctgttctatttggcctctgcctgggtttggccaatgagaggaaactctggcaggagactgaatgttacagggtggagtaggaaaaatgtcctctctccagaagagtgacatgattaaaaagttttttgtctgttaagtaatgaatggaaatgctgggcttgcatcttacacaaacttggagttcaagaattcagatgaattaacacaaaaattggccaggtatggtggctcacacctgtaatccaagcactttgggaggccgaggtgggcagatcacttgaggtcaggagttctattagcggtaaatgtgctcagactttgtctgaaaatgtatttatttctctgtcatccatgaattagatttctagctggacagttattttttctctgtgttgtgtgttatgtgcagccagtctaattgctgttcatgtggttattctggtttttcttggtgctcacttgaggtctgagcacaaaggaatcaatattactgtagaaaaatgtttactgaatgtagctggaaaattacacatttaacattattttcagatatttcactttaaagaaaaagaacttcctaatctccccaggtagcctcctctgttattttactggacctattgctaacatttagtagagatgaaaccccatctctattaaaaatacaaaaattagccaggggtggtggcgtctgcctgtagtcccagctacttgggaggctgaggcaggagaatcacttgaacctgggaggcagaggctgcagtgagctgagatcgtgtcactgcactccagcctgggcgatacagcaagactccatctcaaaaaaagaaaaagaaaaacaaaaaacaacacaaaaattggtcactagctggtgatacccttagggtgactggccaaaggaatggtgcaactggcctggagggtcacactcacaactgtggctccatgagattccacagaaaaaccaagtctcattaaagatgagctcaaagtaaaaaaaaaaaaaaaaaaattacaaaaaacgggaaaaatccaccataaattgaaaaatgaggattagaacaccaagaacatatgacagtagaacaaaaatacacatggagatgtaaaatatatatgtttaacattactcaagacacataatgaagggcttgaagccataggtagtctattaaaagaaagaataaggagagttgaaaaagaataaaaatggcaaatattgtcatggaaatgataaattaatagattaaatagcagattaaacacatcctaggaattagtaaacctaaaaacagatgtgaagaattatttagaatgtagcccagaaagaaacagagatggaaggctgggcatggtggctcacacctgtaatctgagcactttgggaggccaaggcgggtggatcacctgaggtcaagagttcaagaccagcctggccaacagggtgaaccgtctctactaaaaatacaaaaaattagcggggcatggtggcgggtgcctgtaatcccagctactcaggaggctgaggcaggagaattgcttgaacctgggaggcagaggttgttgtgagccaagatcgtgccattgcactaaaaaaagaaaaaaaagatggaaaacataaaacggaagttaagagacacagaggacagaatgacaaggcccaacatacatctgacaggtagtccaggagaagggaatagaaagaattgagagaggtaatattgagattataatggctgagacttttctagaattgaagaatgatacaatgcctcaaattcagaacaatggcttctgattaggaaaaaaataaatccataccagaacaccaaggagggaagaaaaaacatgattaaacagtcagaaagaaaaatcagaataaccacatgaacagcaattagactggctgcacataacacacaacacagagaaaaaaataactgtccagctaaaaatctaaatcacagatgacagagaaataaacacattttcagacaaagtctgagcgcatttaccactaatagacatgactggaaaaactattaaaagacgtatttcaggaagaaggaaattacataagaaggaaaaagaaaagagatatgagaaatggtgagccaaaatactagtaaatgtgtaagaaatcaaaataatcattgactgtataaaacaacaataatactaagttggcaggtataaatacaaggtgaagttaaaacacaaaaatgtaataacatgaaagacataagagaatcattagagataaatcatcctccttgcattgatcagcagaaggaagagatattgatcaaaggcaaacaggtatgttaaaaatggaaaggtaaccactcaaagaacagacatagactacataatttcccaaccagtagagggcaataaaagaaacaaagaaacttgatcagtgcgacagaagtccctgtgtcagcagaacaaaaaggggcaaagaaaatgcctggtaaatagaaaatacataataaaatagatacaaataaaagtattaaattgttttaatcaatgtaaatggcttaaatctgtcagtgaaaagagaggctctggattaaaaatcaggtcatagaagtgttggaagtagtgggctagaaaaagctatccaaataaaaattctaaaagcaactggggaggttttattacaacagacaaattaggctttaaggacccgtatgagatggtagaaacattcaccaggaagaagaataattctgatcttatttgcaactaacaggaaagcctcaaagtgtaaaataaaaaaacaactaacaggaaagcctcaaagtgtaaaataaaaaactaagacccataccccacctccctccaaaaaaaagaaaaaactgacatatctataatcgtagtagagtttaatatagttctctcaatgaaaattaatgagaatatgaaagatttgaacactattaacaaggttaacatatgaacacacatacaagagactatacattctttttccatagaaccaggctgggcgtgctggctcactcacgcctgtaatcccagcactttgggaggtcgaggtgggcagatcacttgaggtcaggagttcgagcccagcctggctaacatggcgaaaccccatctctattaaaaacgcaaaaattagctgagtgtggtgacaggcgcctgtaatcccaactactcaggaggctgaggtgcgagaatcacttgaacccaggaggcagaggttgtagtgagccaagattgtgccactgcactctagcctgggtgacagagtaagacactgtctcaacaacaacacaaagaacccacagaaccaatttcaacaaacaccaaggaatcaatattactgtagaaaaatgtttactgaatgtagctggaaaattatacatttaacattattttcagatatttcactttaaagaaaaagaacttcctaatctccccaggtagcctcctccgttattttacttgacctatcgctaacatctgtgattgctgatgactcgatcctcatgagatcctttttcactcgtcttccaggtcaccacctctcctctcctcatatcctcccacctcactggtctgcccttccacggctcctttgctcgttcctcctcaactctccagacttctaatgtcgcagtgccctaagattcagtccttggaactttcctcgacatactcagagccttggtgacccagttcattctcatggcttatttatgtactgataggctcccaaatttacactccagcctgaacatcttccctgaacttcttcacacgttctgctgtatactcagtatccccattcagatgtctaaaaggcacatcaaagtaacatcaaaagccaaacccctaatcatctcccaacctgctcctctataattttccacctcagtggatggcaatatcatctctccagctgctcacgccacctgatacttctcacacttcacattcaatccacctgtgggatccctcttcacaatacatccagaccacttctcacacgtcccccatggctgttctgatccaagttatcatcatcttgtgcttggattactgaagtagctttccaatggatctcctggcttctgatcccttcccctctttaatctggcaaggcagagcagtactgttaaaacacaccagatcatgtcactcctttcattaaaacccttggctgggtgcggtggctcacgcctgtaatcccagcactttgggaggccgaggtgggtggatcacctgaggtcaagagttggagaccagcctggccaacatggtggaaccccgtctctactaaaaatataaaaattagctgggcatggtggtgggcacttgtaatcccatctacttgggaggccgaggctggagaattgcttgaacccaggaggcagaggttgcagtgaccggagatcatgccattgcactccagcctgggcgacaagagtgaaactccatctcaaaaaaaagaaataaaaataaaaataataaaaaccctccaatgggttcttctcactccaaacaaaagccaaagtttataaatagcccacaagaacctaaacaacctccttcatttcctaggtcacacccagaccctcgcttcctccttctctcctgctcttccctcttcccaccgcacaggcctccgcactattcctcaggcaccacaggatgctcctgctgcagggattttgcaggtgcaaaatctgcccagaatgatcttccagatatccgcatggctccctccagatatcctcacacccctccagtctctgcctgccgtcactatctcagagaggttttatctgagtattttattcaaaataaaatccctctggatccacctcccttgcagaactcccattcctcttccctgcttcatttttctaagatgctacacacttcacattctcattttgttcgttttctgttttagcctactcaaacaccagctccaagatggcagaaatttttgtcttataatttgccacatccccagtgtctgacacacaggagggcttcgataagcatttatggaatgtgatgtgaagatacactctgagcttcaggagacagtacagcagtgttgactacaggcagtcagagaaattgatgaaaacttcctggtaggtcctttttggtagacaagaagagtgggcaaagaagaaagatgagagatcatggctactatcaggttgatgttcccagaggaataattagtagtgggctgggccacaagacccacccccacactgtgggaggatgtggagactgagagacaagttatgaatcataggtatgtcgcaccatagttgggaagcactattccaagttacagtgcaagcaagaataagaagcaaacaagagatgcctaagaaaggagaggggaaagatctgggcagattccaggaggtaaaggacaaaagacaatctgtgatgacgaacacagagagtgcttgttcagattatgtcacaagtcccacaaaagtccttgcccatttggaggggagcagtgccggtgaacaatgctattctctgtgtgcccacttatgcggccagagtatcacataatggtttccagttatactgtagttaagctcagtgaaaagatgagatttttaacagtaaatctagatgaataaactgcattttctgaaggctgcctttttattgaagttttatcaggacactagaaagttacaagatattttatgttgtaaaagaatagcttttcatccacttggcaaatatttattgagtaccgggtagcatgcttccaccacaaagatatttgtttttacttttggaaatttaaataattactggacaaatttctaaattcatgtctttttgaggcctgtcaagttctactccattaggagctatgttgctcctgtaagcacaaaaaggaaagaagttgaaatcatattctaatgttgcagaccatcagaaagcaaactatttgcctatcagaaaatagtcatattctagaatttccaaaagcaactatattgacaagtgcaaccagataaagacaaattttattggttttatttttacttttgaatctactgtaaaaggtcataagcctaagacagcaatgacctcctaatgatagacaaaagcgcagacctggccccagagagcagttagttcaggctaaaatctgcattaccttctaacctgccagacttgtaccatgactcaattgagggagttaatgtgagatgcaggatatagactattataaagagatatgaaatagtagtttcatcatgttagaactttcaattctaacaataaaaataactataccaatatgtgtatgatgattttcaaaccctgatcaatcctccgaataactgataacagctctgacccctgctctataagtaaatagataatctgaagcttagtggtgaagagacttaccagataaattagagctactacatatctaaatctaggtaacttgattcaagtcttatactttccaatggcaggccatttaagatgatgcttacactgcaattactggagattccatgtataaacctaccaggtcctatgcttggtgaactgaattctaaaggcaaaaaaggtttaggataaatattctgaatgccaattagcccaaagcaatgaaaaagcaaacaaggcccttactctaactcttttttatgtctaagtgatataattattcccttacacacccttctactctgtcacacacacaattaggaccttgtatctaatagccagttccaaagagactgttccatgcactgtagcactttgtatcagtgcactgattactacagttctgtccttgggcaatacgggtttcatatgcacatatatattttttcttagtattactgaacagcttattacaccattaatctcccccaatggtatgttcatataactcatgttttccacttgtttatgactacatacataattggagactttgccccaaattgctgagtttaggacacacaaattctatagcactggctgactctgacttcaggtggctaatggatgaccaccggtgacacagggatcccagtggcaggttcttcggtaccttggaatgtaacttgaccagcttggattcatttaaagcagttaattttctttaccctccatcttgcaattaactgatgactgttctgcttttgtggttgggagttaagagcagctcccagttaatggaaagcagcatgtgggggtggctaagagaatgagttctgaagtcagatctggacttgagttccaactctactacttactcagacaacccaaagattagttcatgacttggtacacagcaaatatttactaaatgttagctgttatttctagtatctattatgtgtcagacattaaacttgtgctttacaaaccccttaagcctcatgtgcaatgtgggtattattattctcacttatacagaccaggctaaggctcggaggggtgagctagctgagacaggaatcaaagcaatcctcccactatacttcccactacactcatttatcgttctctttgaaagagtaagtgatttttgccttttgacaagcttaaaacatctctcttaagaatgtccttcataatttgttgttctttaaagcaaagtttaaaaagtgattctaaaactgattctaaaagtttatacggagaggcaaaagacccagaatagccaacaaaaaaattaaaggagaagaataaaactgaagaactgacactacctgacctcaagacttactagaaagctgcagtaatcaagccagtgtgatactggccaaagaatacacaaatagatcaatgaaacagaatagagcccagaaatagacccatataaatagagtcaactgacctttgacaaaggagcaaaggcaatacaatggggcaaagatactcttttcaacaaatgatgctggaacaactggccatccaaatgcgaaaaaaaaaaaagaaattgtctttaaaatgaaatatagacacaggtctctactgttcgcaaaaatcaactcaaaatgcatcacaaacctaaatctgaaacacaaaactataaagctcccagaaaatagtgtaagcgaaaatctagataaccttgggtttagtgatgactctttagatatgataccaaagacacaatccatgaaagaaagagttgataagctggacttcattaaatgtaaacactttcattctgcaaaagatgtggtcaagagaatgagaagacaaggcacagactgaaaaaaaatttgcaaaagacgtatctgataaagaactatttttcaaaatatggaaaggactcttttaacagttcaacaataagaaaacaaataaaaaaatgggccaaagaccttaacagatgcctcatggaaaaagatatgcagatggcaaataagcatataaaaagatgctttgcatcatacgttgttgggaaaatgcaaattaaaacaaaaatgagataccactacacacctgttagaatggccagaatctgtaacactgacaccaccaaatgctggcaaggatgtggaacaacaggaactttcattcattgctggagggaatgcaaaatggtacagccactttggaagacagtttgccatttacaaactaaacatactcttaaaccatatgatccagcagcaatcacacaccttggtattgattcaaaggaaatgaaaacttatgtccacaaaaaagcctgcacacagatatttgtaacagcttcattcagaattgccaaaacttggaaggaatcacaatatctttcagtgagtggataactgtggtatacccagacaacggaatattatttagcactaaaacgaaaggatcaagccatgaaaagatatggaggaaacttacatgcctattactaagtaaaagaagccaatctgaaaaggctatgtactgtgtgattccaatcatatgatattctgggaagggcaaaactatggagacagtaaaaagatcagtggttgccaggggatgggagggagggagagctgaacaggtagagcacagaagatttttagggtagtgaaaatactctgtatgatactgtgatggtagctgtatgtcattacccatttgtacaatcccacagaatgcacagcaccaagactgaaccctaatgtaaactacagactttgataatgacatgatgtaggtgcatcaattgtaacaaatgtactgctctggtgggggttgttgttaatgggggaggctatgcctgtgtcggggcaagggacatatgggatatctctgtgtcttcctctcaattttgctgtgaacctaaaactactctaaaaaatgaagtcttttaaaaaagtgattatgaagacaaataattttaaaacgggcaaaggatctgaatagacatatctccaaaggaggtatacaaatggccaacaagcacatgaaaagatgcccaatatcattagtcatcagggaaatgcaaatcaaaaccacagtgagatgtcactttatgtccactggatggctataataaaagtcagataataacaagtgccggtgaggatgtggagtaacagaaagccctgtacactgctggcggaaatagaaaatggtgcagccagtgaggcaggtcctcaacaaattaaacatagatttgccatttgacctgggaattctactcctagatatatatccaaaagaaacatggacatatgttcacacaaaaacttgtagacaaatgttcacagcagtattattcacaatagccaaatggttgaaacaacccaaatgtccactaaataatgaatgaacaaaacgtggcatatccacacaatgggatgttaatttggccataaaaaggaatgatgtacagctacatgctactacatggatgaaccttgaaaacattatgctaagtgaaataagccaatcacaaaatgctacacattttatgattccatacatatgaaatgttcagaatagacaaacatggagacaaaagattagtgcctgctcagggctgaaggctggaggggggcttagggaaatgggggtgatagctaaattgtacagagattcattttgaggtgataaaaatgtcttataagtgactgtggaaatggttggacaactttgttaatacactaaaaaccaccaattgcatggcaagtgaattgtatctcaatgaagctgttaccaaaaaaagtgattacattcagctttatccttctggatactattgtcatagagtcttgtccttgtttattatgttcagtctttgactccttgactcttctctgtgtgtcctttttacatagagaaaagcctgtgcaatctctgatttttcctgtgtttttttttctttttttttttttggacatagggtctcattctgtcactcaggctggagtgcagtggtgtgatctcagctcactgcagcctcgatctcccaggctcaattgaactgcctgcctcagcctcctgagtagctaggactacaggcgtgcagcagcaccactcccagctatctatctatctatctatcttttattttttatttttttttgtagagacaggtttcaccaagttgctcaggctggcctcaaactcctaggctcaggtaatcacccaccttggcctctcaaaagtgctgggattacaggcatgagccaccatcctgtttttgtttcactggtatgagtaacagttgtagtgccgaagttcattattaggagatggtggcaatatcagcacactagtgtagaggctaacagcatggacttgggagccagaccatggaccacctctaccgcttactagcaggttccacttggacaaattatctaatctgttttaatttctgtatctcaaaaaagaaaacaatgaagaggtaatacattcaaggaccttagaaaagtatctaaactaagaagtcctcaaaaaagagcacttttcctcttttatttttactggtgtgagagatggttgcagagccaaaatttcattattttttaaaaatcatgaaaatagcaaaataatctctttctcatataacctgtttcccatctttgtgagttcctttcactatccaacccttaactgctgatcttctaggaggtctgatcttcttcccaagtaatctcatctactttcactggttcaacaactaccaatatgtatgtcattccaccaggtggtgtacatctgatgttgtctatcttatctgaccacctgcttgacaactctatgtggacatcccataggtgctccaaactcctcttcttcccccaactctaattcttcactgcagttggtggcaccattatcccatcctgtccctcaagacacaaatctggaaataactgacttttccaccgacactcatattccatctatctccagttcctgccaattttccctcagaactccgtttcatcattttttgctccaccttgggtgcatatcagaatcatatgggaggctttgaaagatccccacgatcaggccgaacttcaatccatttaaattaggaccctggaaactatagatttttcaagtttcccaagtgattccaacatacagctgagctagagaatttctgacttagcccttggcctgcctctcaagcctcaacttttatagttcctggctctgtatttccattctgacgatactgaaatgcttataattacacttccccaccatgccatttcttgtctttatcatacactccaccatcctacccaccaaatctggcttattgctacttatcttatggacctggcagttgcttcctccagcaagtctctcgttcaccaatctatggctgaatttggtattccttctctgtagtccttaagtgcctggcaaatatctatcactgtgctgaatatgctgttttataattatctgcatatgggcctaatcccctcaaagaactatgtaccacctaagacaatggccacttgacactcagttttgtatccccagcacctgcttagccttatgtaaacacttcatacatgttagttgaataagtttccggagatgaggaaaggctttttggaaagaggttgtttgtgctagatgttgacagatggactggatttagatccatatctttctttccacccaagggcttatacgaccaccaacatgattaactttaacactgcttaactttgatacctccaagcattcactgctgtttcttttacataaactcttattttgtactaaaagtcttactctacatttgcaatgagtattaatttgtaagttccatccaatctttttagaaaaaagttgcagtaaaacttataaaaacacaagtctattaccctagattatgttttccttacttttgtgagcaacaatgtattaaaatcaaactttatttcacttttgagatacatatgattatctccaatcaaattatcttcatcttgaccacttatacatttattttgccccctatgatataaaacaatttgctggcctgttctcatgagactacattaaggaaaaagagacattccaaagacatttaatcatgactaaataaaaacaattaaaagtaagttttaaagaatgtttcaaaagaaatacacaatacaactaatatagtttgtgttcttttaataaacacacttgcatagttatattacaattttgtaaaaataaaaacagattatctcatgccaagcgtgcccagcatttgcacaatctcaatacctttaatactataattttcaagacacacaaaataaaattttaaggcaaaaacagcactttgcaacaatttaataatttattacattacagtagcatcacagcagcattcaataatgccactttaggcaaaagtctttcagtatttccattatagattctgtttacaagaattcataaactggtaaaagtcattctaagaaaacctggcaaataaagctttggactggaattggtatttctttctctacttttctttcccccagtttctttcttttaaactacagtatttatattttaaaatgttttatttcaaaacatttaaatatcagttacatttttaatagttatattattttaaaatgactctttaagataaagttttagagaaactatattatggatagggctgatttacattctcaaattttctaaaaatcagctttggttttagaactgatttttttcatttctggaaaacctaaaaggtttaatcaaataatttaaaagtgattattatacattgcaattgcaatctttaaacaggtattttgattctttacctcctacagaaattcaaatttattcagttgaactcacattttaaaattctatgtttctgatgaactctaaccttctaatgttgccttctaagcaaattgaaagctgacttatactgaatgaggaagagaacaaatacttggctgaatgaggtattgcaaaagacagcatgcacttttaagaaagacttaagttattatgtcatatgatttccattctttttatctttttcttaaatacatgacaaaatacctacacaaagagtggtatttcagttaatatagtaaatttattttccagactgacattcagcttaaatacgccagtatatgatttaatccataggtacctgatgaacatattattttcaggttggttacagatgctaaacgctgtctgaaggtcattcccagtaatttatatttatcagtgtaaaagtgaagtgatttgaactataaaaatacgtttgaaataattcatcaatgtattagataaactcagtttcagaattataaagaaaaaaccttagaccaaataatgtggctgattaacagtggtatgatttctaccccgagggtttaaaaatggatttaaagtaactgtctttgaactcaaaagaatgcaaaagcagcaagttcagaaaataaaaggcaagaacaggtaattaatacaatttgggagagtcagttgaattcacaaggacccagtctttgcactctttcagtgaatgcaggcaaatctgttattctatctgtaaaatgaaattattgctttcctattaatgtcatatttataaaagtatcatgaggatgccaaatgctaaaaatagaggtggtctagtaactagaaattgccaccctagggagcacacatacttatctccctacatcctaataatgtgatgtattttggaacacagacattataactttatgaagttttaactgttgattctttcccaagcatcataaagttatgatttaggcaatgtatgactgaaataattcattcataatgtataggcacattaacataaatattgcacaaaatatgcctctaactgaaactgagaggtacaaaaacatatttcactctttgtaaataactttgtgaggaaatatgactctgtgattgtatatacacttttcctgatactttgacattcacaaacagtagattgcactgcagtttgtaaacattttaagttgcataaaattctccttgattttcaaatatagtataatactgtctactaaaactcctttttgtatcaactaagtactctcacatatattagtttataataatgtttgttattattttttaaagtgttttccattccaggaaaagaagtaaattcttatgtcaaagtagccaatatggttgaagaacaggtattagagaagtctgatggtaaaatcaatcttagagcctcaaagaagctccatgaacacagaggaatgccaggtgttacacagctttccttcactctaattcattcttgactagagcccacatgtctgttttggggacatttaaactcttaaaggatttcttatgatatttactaaatacattaagaagaatgtcaaccagtgcccctttgtatactgggacatgtagtcacctgattaaaacaggtaacaatgaactctgactttaaaatggattaagatataaatgctctaagctaggaaaggtttttcccatctcacagtcaatgatgggagcctttcattcctcaaaaataatccctttataggtcatcgaaaaagaatacacacgctgcagcacatgatgcagtaccttcattagcccagagcacataaagatcctaagcgaactaccataggacagtgctcattcttgggactggaacaaatgaaacactgcacatacctgccagagcaggccactttcctcttctctgagatttaaaaagctcccccaaaatgttgttattcccatcccaaatacacagaaaacagggcatggctgtttccagttcttggcctttaaacaaatctaaatgtcagtactcatagtggcatattacaaagtaataaacagtgcacacttgagggcaaaccacatattgagctaattaagagctcactgtgattaggattagatcaaacataatagcagaacataagcaaattttatctgaattctgtaaatgaatacacatgttgcaataacattaaaaaagcatggcagcctattccaaaccagtaagaatagtttgtgcaaatagtgggtctttgtgtgtttgaactcccaccacataagggcaaactcaatatgcatgctaatgacctacaattatcaaattaaaaaagaagaaaaatgctaaagatgccagagtgaacagcagggaaagccacacaaagacccactatcctttaactttttacaaataaatttaaactgtaagttagaaacacaaaaaaataatcacaagtggctctaacattcaaacgaagtaaacgaattgtgtaggagatatttgatcagggctgcctgccctgcctccacgctagagtgaaacttggatagtgggtctctggggtgctttcacaactggaagacaacattgggtcctaaaaaaagaaaatgaggaataaaatgaacataatgcaaattaggtgggtgagataaaatttgactagtaacaacatgcaacatcaactaaacaaatttgaactgttaaaattctctatcttaaaaaaagttctaattatgtaacaaaatgaaaaataatacttaaaagggccaaagaaacacaaatggtaatctataatttaactagctttcattgactattacaagaactacaaacaggtgattcatctataaaaagctgggtaggtacaacaaggatctcgtatctattcctgactttaaggattaagcattttctgaaccatatcctattaaaattataggtttatataaacaatgtgagttcatagctaccaacacaattaacattaatcttcatcttctttgaaaaagcaattatgattcttcaatttctgataaataattacttcaagtaaacaaaatcggtacgcctcactttcctagataatttaaacagttgttttatagaaacaataaaccatctcagaggaacctctttagaatttatccttagaattacagaattgagagcccttttattccaggatagatgacaagcctttagccattcatttaggcaaaacaataaaagtattcagtttttagatctgattaaactaaaaaaaacccacatatacccgccagaaacaaggtaataggtaagttactggtaataactttataacaaagagaaattcgaaactactcttattttataaaataacctcttgaacattttgttttcccagctgtcagtatgtaaaatgaccaagaaaatgatgagttcctccttgcatccccaacatttgcccttccagcaaacaattagtacttatccttcatgtaccagctcaaatatcttctgttgtatctttcacaacatgccttctttctccacaaagatttagggggtctttttccaaaacatatttgtataaatattcattgcagcaattgttatatttatctgaatgttgttccccactaacctctaaagctacttcagagaatggattgtcttgtcttgtttgtattcccagtactcctagtcagtacagagtagacactcaagtaataccaaatgatgaatttcttaaatgaacagtgggaagaatgttaacatagaatccaaaaccccccaaaagagtaaaacctgaaacacataggagctataaaatcattgcgtaggtcaataatgaccgaaagacgattattctttttcttcttattttaatctttcaatatttccttgtttgttttgagacagggtctcactctgttacccaggctggagtacagtggcatgaccatggctcactgcagcctcccacctcagcctcccaggctgctgggactatagggatatgccaccacactcagctaattttaaaaatttttctgtagagatgaggtctccctatattgacgatcagtcttcctgcctcggcctcccaaagtgttgggattataggtgtgcgccactgtgcccagccctgctatttccatgttttatttcagggagggcttgcattacaattggttgtcttctagaggcatgctgtctaatacaggagccacaggccacaagtggctatttagcttaaaattaaagttaaattaaattaaaaattgagtttctcagtcgtattagccacactccaaataatcaaaagtgactagtggccgctgtattggagagtggagatatagactgttttctgtattgcataaaattctactggatagtgctgtttagattgggtatctctctcaactacaggcagactaaggctctgccagttccacctatactaaaatagcagacgaagcattttctgggcaaaagtaatttgcatgacaaatgtgtccttgaataataactaacagatgatatcaatctattttctgtatcattagtgtattaaacatttactgacaaccagaaactatgctgcttctttttggaataaaaaattgtcactcaattaactctctgggaaagttacttttctaggagactgttactgccttgaagtagatttctctagagtaatttttaaattatctgcagaggggaaactgaaaggaccttcataaaataggcgggggaaaggtataagacctggggccatggtcctgtccttcctttcaaacagcttttatctgttctttatattccctattctatgaggcttaattggaaaaagtgtttcaaaccacaacaacatattcagaaaaccatcactttagatcatagatgctatagaagccaaatgtactgacacaccggcatgccttcagggatcactagccaaagatcttccaaacccagtaggtctgaaaagtcttttccattctcaacaccaagaaagatgccacagctagttagataaactggtttctaattaatcattgtgaactgccaaaccatcagcagagcttaaaaatgatcatttattaggcaacccaagttacaattttctttatcacttctgaaaccctccaatatttttgggactattcaaatcacaaaaaactggattcctcccatctccaagttgggaaacttagttgctttatgtaaagggaaggtttctcccagggtcagaactatctttataagctctaaagtgagaatgcacaaaattatagatatggtataaattcataatccttatactgaatcataagtgtatctgagttttgtttgggttaccttttatatattctcagcaactgaatttaaatgaaaggctaagtattttaaatttcataagagatatatcatgagatattttaaaaataaaactaaaaattaaaagagtgggaaaaagtgacaatcatttcataaaggtaaaaagttatttccaagtactattcattccctaatttattactaatgctatatttactgtcaaccaaaagaacggctagataaatacagagagataattttatatagtaccaaacttcacacttcgagatctggacccttgttctgaaaataatgaaatagaccttgattgatacatcccttgtggaaaaaggtgactatctaaagaatcacctgacaagaattttgcaacagtcaaatatttaatttttaattttcttccaacatggatgatatgtaaacagcgagaaataaatgagaaggttagaaatgtaatggcttctgtacactaaaagagtaattttgaataggtgaatagggtaattgctggctacttttttttttttttctcttgagacagggtttcaccttgttgcccatgctggagtgcagtgtgtgtgatcatgacttactgcactcttaacctcccgggttcaagagatctcccacctcagcctcccaagtagctgaaactacaagcacgtgccaccacacccagctaattttgctattttttgtcgagatggggtttcgccatgttgcccaggctagtctccaattcctgggcttaagggatcctgcgtgccttggcctcccaaagtgctgggattatgggtgtgggccattgcgcccagccactagctactttttattaaaccaaaaaagaacatgggacactgaaaaagaggatgatagtaaaaagaagctgcagtatagatggcagtcataccaaagaactcataggaaaaattatatactctcagattaagtctaatacgaaagtctggagctagcaagtatttaaaataaagctgtataacttctgaccttgtaaaaagtttccttttgtttcttctcactttaaacactaatctacatttgctgtgagtgctgagtttaagatctaatccagaaaaggaataaatgcagtgctgtatattgaagtttcacactaggtgagagaaaaataatttaatattactcacactgttgacttggatctgagtctgtcgtcatcttaacgtagtttgaaggaaagagaccagtcaccccgttgatctctccttgccaccaatcaggatcatctttgttcataacattaatgagttgtcccttggagaaactgagctcatcttcattatttgctgcatagtcatacatagcaatcacctgacatactatcacaagaataacaaaataacacattaaacaaattaattattcctgcaagggtcaatcatttgtaatctccctaggatttaaattattttaatattaaatattaaaattaggctaaaatttcccttgaactgctctttctcaccctccttcccctattcctggtcttacaaaaacaagaatttcccaactgcagttaacaatccaagtgaagtacttcactttaagtatgatggtgtaacaatttcacattgaaagatttcaaagagtcgaagtggttcaagtatcagtgaataagctggctgttcctacactgaacttttcagaaaggaaattctcagtggcatgtcccttttaagcagacataaggaaagaacacatttttaatgttttccaaagattgagctaatctaagaagttgctgagttttaacaaactcctctaaaatgaaatacaaattaacccacttccataccaggatgaaaggcaggtgtggctctttcactacttggacccaaaagtttaacatgactggcaggaaaccatcctttctgtcgcttttttcctctggcctaaaaattagcaaaagaaatacataattgaaagatgagattaaaaacaatcattgagacataacttaaaaattagaaaaaccataaatgtgtagtaaataatttaattttgcctaaagagaggtctggtttttgccctcagctcctggaaagtaatctctaaatccttggactatcctgactggtcagagtgtcttagtttacctgtgggtactgggtcatgccaaatctaacaatgtgatgtgctttgggtcatgcagtatcagctctaccttggtaggggatggagactgagttcagaaaaacgggcaatcaactgtatctatgtgaggaaccccagtcaaaactgcacaccaaggctttgctgactggcaatactctgtgtgtattgtcacacatcattgccaggaggagttaatactgttcatgactctgccaggagaggacaactggaagctctgtttttggaactctactgcactctgccccatgtgtctcttcccttggctgactttaatctgtatcctttcattgcaataaactgcaacatgagtgtaatagctgtagtgagttctgtaaagtccttctagtgacttacagaacttgagagtagtcttgaagacccccaaatttggaattggtttcaaatatgagcatgatcttgggggcctcgaactcagcattagcctttcaagtaaacattaaacaactggaagacacactaaaacatgcatctcaaactactgctgaaaacagcatctgaagaagtctatgtggaggtctttcaggctcagagttctcggaatatttcacaaaaatatttatattctaaaaagacatttctagagttctcctaacccttaaaatggtgcagccgactacaaatacttcttggagctttgttaatcattaatcaggaggtcagaagtaaaatttgtaaagagtcatgtttcccacttagttcggtccatcttcaaagtaaatcagaaggtggaatttcagggggttattcaagaaggtattaaatttgaacccccatttttcttcaggaatcctaagactcctgatttgcaagaatgaagctatgtttatcctccatactacaattatatatcactcatataaaaatatagctattatatctcttgtcatcttttaatccctaaaatgctttttagttttaactagtaaggaaataatagaagtgagagaagaacccttttcctgtatcaaaacatatgcaataaccatctattaacgttttagggaaaaaaaaaaggttcatctatgtctgtattgtctttaattgcactgctgtttcaaaaacctaagaccactagcggacagcccaattagtagtattttctcagcacaccatctagattatgtctttctcctagaggctatactgcaagcctgggactatcccagggaaagatgatgctgtttctttaagaacatgatctgtgaattataaaggaatgcattattggaaaacaattatgtctttggagaaaattattccttaaattgttacttataacatcaactcaactgtgctaaaaatgtacacacaagagactaaaggaaatataatgcagtaaaatattgatattgattacctctaagtggaatgattatgggtgatctaaaaatttttattaattttatcttttttatggagcatgcagtacttttataataaaatttatagatgctatttaaagaatattacctgtaactctccttgccaccacccacttgtatttttctttagaattaatattaactgtcctggtgcaaggctaagttgttcagaaccagaagcaacatatgctgaagttacctgagcaatctctgaaaagacaaagaagaaactatgaattcaagattgcgacagagcaaacacgttagtaattttttaagatcactactatacgtaccaggttttttatttgatgctccagacttgctagcactcccaaaactctacaaggaaaagataccgtgttgttttattatttccaacaatccaaatgtaaaagtataaaggttaatgggaattagagatttcaaattcccaggattcttttctctttaaatgaagatgaaaatgacaatgaacctcatgcagtattaacaaataagtgaaaaatccaacacttatgaggagatctggtctgctaatgtaatacattatatacgagtggctgtcatcgtcaaccattgactcaacaggaagagctcgttttctgaaacctaaatattaaacatgaccctccaggccaaatgcactccatttatcaatggcgttagcaccaatgcccactatgcacaacatatgtgtcctggatatgtcaaggtatacgttattttgctcctgctttctctaagggatcctgacttatctatggatcttgatgaacaggagacaatgtttttatttttatttattttaccatcctccccccaaactgactgaatctgacctaagaacaaaaaatccctatcctgtgtagcaactattacttctgtttcactttaaaggataaactggcccaaccacatttcctctttataggaatttgaacaacaaaagggatgggattaaaaagaattttgttctgttagtgaacatagctgcagtacaagtattaagcagagtggatggtagttaaaagctaacattttctgagtactgtataacagacactgctctaagaggttccatatattctgctatttaattttcacaataacactattaagtaattatgattatccccattttacagagaaggaaactgaggcacagaaaggtacagtaacttgtccaaggtcacccaggctctaagtgttacagctaagagtcaacccaggcagtctgattctactacaccaatggctctcagcatgtggtttgtagaacctggaaatagtccttgagcctctttcaggggtctgtgggataaaaactatcttcataaaaatactaagacattatttgtcttcttcactgtgttgacatttacagtggtgggtaaaatcattggtgctttagtgtgaatcatggcagtggcaccaaatgacactgaagtatggtagtgttcttcaccgccatgcactcacagtaaaacaaagccagtttcacttaataatgtctttaatgaaacagcaaaaattttattaaatcttaatcttcaagtccataccttttaaaagttctgtgtgactaaacagaagtgtgcctaaaacatttgtgctgcatactaaagtatgacggttgtcttaaggaaagtatttgtgtgactaaattgtccactcaactaggtttttcatggaacaacatttttacttcaaagaaccaacagaaaaactatttagacttgggatttagcgaacattttcttaaaaatgaagtaagcctgtcccttcaaggaaaacagctggcaggattttttgccaatgataaaattcaagatttccagggaaaattaaaattttagaaaatttgtacctaccactatgagtctgacagtttcctagtattgaaaaacttttctgatgagtggtggtattaacacatacgatttttcagatactgtgtaatgaaatgtgtccacacagggaatatctgcataactcagtgattcaatattttccaaataaacaacaaataatgttatcacatcatgcacgggtaaaagatccactcaacatgcaaaacagactagtgaattttaatgtaacagtaagaactgttcaccgatagggcttcagattccatgttgcaactaacctataacgattcagcatttgtcaagttttagtgtggtagaataaaaaagaacattggtagatatctgcaaatgctattaaaatacttcttcattttctctcatgtatgtgtgaggatgaatttttttatacttcaaccgaaaaaaaaaatgtcaccgactgaatacagaaacagacatgagaaagtagctgacttaattaagtcagactaaagagatttgcaaaaatataaaacagcctgtaatcccagcactttgggaggccaaggcaggtggatcactggaggtcaggagttcaagaccagcctggccaatatggtgaaaccccgtctctactgaaaatacaaaaattagctgggtgtggtggctcatgcctgtaatcccagcactttgggaggctgaggcaggcagatcacttgaggttgggagttcaagaccagcctgaccaacatggtaaaaccccgcctccactaaaaatacaaaaattagccaggcatggtagcggatggctgtaatcccagctattcaaggggctaaggcacgagaattgcttgaacctgggaggcggagctgtagtgagccgagatccagcttgggcaacagaactaaactccatctcaaaaaaaaaaaaaaataaaatatatatatatatatatatgtgtgtgtgtgtgtgtgtgtgtgtatatatgtatgtgtatatatatgtgtatatatatatgtgtgtatatatatgtgtatatatatgtgtgtatatatatgtgtatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatatacacacacacatatacatatacacatacatatgtatgtatacgtatatatacgtgtgtgtgtcttgctaaactttgttttcatgataaatacggctgtttttcataaaagcacgttatttatgttaccatgtaatggatttaattattgttattttaaaatgaataaatatataatttcgcttttcaaatttctgatacggtaaatatcattagctatactgaacatactttaaaaaagcctatggggttcctcaataatttttaagactgtaaagttcctgaaaccaaaaagagaacttctgcactataccatactggtggtggatgaaatgaggcaggagctcatgtaagctgagtcacattaatgttacagtcttaaagtgaaaattggcgaactacttcaaggtggtcctttttgtgtttctctgaatccagatctacttcctagcagttatcatgaagctcaaccctaccctacaactcttgttcttagaatttcatgaaatcttgccccctttatctaactggagccatataataaaccctattttaccggagctactgtgaacagtttctttgtaaccaaagcaacctgatcaaaaccataaacatgatctctaagtataaatcttgattaacaagaatgggttgattttatttttaataccaaaataatttaagtataaacctgattaaccagaatgggttgattttaatatcaaaatacctcttgatcctttggtttgacatagtttgatggaaaaattccacttctatctccaatacttcctgtccaccactctccatctttctgggtcaccaatatttcttcaccttctgtgaaagtcaaatctccaggttccacacttgaatatggataaagtgcaatatattctgtagggaacaaagcaaaaagaagtagattctggttttaagattacagaagtgaaaaagaaattaggttattctccaagacattgtataagtttgctgtaaaagaccttgtgccttcaggaaacctaacataaaaagatctaaaggtagaaaaaggaacgaagcaattatttaataattccttagaaaaaagttatttgacttaacataaaactttagagtttcttttattcccaattgtttatttttttatcacaaagaattacccaaaactacaaacagataatagtatctctatagataaatacactgaggcttagtgagattaagtcactcagttattcagataatggagtcaagataggaaaatatattttttaacttttttataccagaaatagtttaatctgctatattattttctctttaattcttttaagtacacagttatggaaacactcaatacccagaagacagcagcactagaagccaagctccatcctgatgacccagctcctagcacagtgcttgacttggagtagacgctcgataaatagttgttaacaaatgacctcaagggaaatatctaaatttttatatcgcctttgatttttgtttctgtgattgtcactgcttagaagaaacagttggtgacttggttttctaagtctttttctttctttctagttttatttatatttggccaacatggaatttgatcttaatatcataaacttgagacgatgagaaacaccacctacaacctatttactattcgcattcccagtattactcaattaatttaacaaaattcaaagtgattacaaggtttaggtacgctgcaataaaagtcgggtcctttccaacatgctcctcactactttcctaggctcagctcagagcactcattccacagtacacctatgattcagcttcactggtgacatgacgttcccccgttccttggctcatgccattccctctgtctagaagtgcattctcatcctttgtcactctgctagatcctactcattgtttaggatgatgcaacactgccatctctgtggattcatatgtcctactctaaattggttttgttcgctcattaaagaatttatcacaactgtatgctccattctattgtgagcactttggaaacttttattcatccttgtattttccaggctctagcatagaatcttcaacgtaacagatactgaataaattgtttaacattaaactgatatttttagcaaaacataaaatgtacctcaactattcaactaactttataatggacttatacatttcatttataaatgtatgtaactattaaataaaaatatcctctgaaattagggtaatctttcatttttcaacacattaacaaaatcaaaataatttactaatcaaacaacccaaagggatatagaaaaaaattctttgcaatacttatgataaagtataccttggtcctccttaatgattcatatggtacattgtaattaaaatgtataagcaatgaaatgtattgaaatttccttacctcctaaacatctataatcaataattgcaacactttttatttatgatgttattcatcaaaccagtctatgctgaattttcatagcactgcctttctaaagtgccaagtattttcacccatattttttctatattctcaatattcatgtgaaatagataggggcaggttttcctaatctcactttaatactgcagacacagaaatggggagaatatgcaactatgtgaagaacagcaactatgtgaagtcaggtagttagtcaagagctaaattgattaccatctaatttacaaattgccaaaagcttaccttctccaactgaataggctgccgaggtaggtttcttatttacagctgcatacaaagcttctggtctaccaaatatataaacaaacaaacaaacaaacaaacaaatacaagcaaaaataagaaaggtgatttgatgcacagcaggttttagtagtgcattttttagggctttctcaaattaaatatagtcttagtacacagaactgggaagacttatacacaacatcctgcaggattaagaacagcctaattataaacttctacatttttaaatatatttttaaaatttcaatatgatttacaaatagtttttcaaatgtgagatatttcgcctttctaaagaaacttaaaagacacccacaaattgttaagtggtaagcacatatagggcttagtttagtgtaggaaaaaataaaggcaatatatacattttattatttgtttagaatgcactacattaaaaaaataaaaataataaaactttgtttttattatctcagaacagctataacattaatttccattttaacccaggaatctgttttcaaaaatctagaagactgtcctgtttaactagacacctgtgggatgcaccaggcctccctaggacctgtgagtaaattacactgtgaggcagtttttaaataaacagaaggggaaccttattacaactactggtcacaactgaatggactgtcttgtttaatgctaaattctccattactgcaggttttcaagttatatgccttatctgttagaaaacactagtaactgaatgcatagttagaagaaatgccctctaaaacactgaaacaatctgtttttgcttaagttttcttctctgtaaatgttatggacataaaataagacaatttctataaaggaattgtctataaagggcctagcacagtgcatgcatacaaatgccagctatatatggttgttgttactgttattatattcttctaaatccaaaattcggccaggtgtggtggcaaacacctgtaatcccagcactttgggagaccgaggcgggcagatcaactgaggtcaggagtttgagaccagcctggccaacatggcaaaaccttgtctctactaaaatacaaaaattagcccggtgtggtggtgcattcctgtaatcccagttacttgggaggttgaagcaggagaatcgcttgaacacaggaggtagaagttgcagtgagctgagattgtgccactgcattccagcctgggctacagagtgagactctgtcttgaaaaataaataaaaagggctgggcatggtggctcacgcctgtaatcctagcactttgggaggccaaggcaggcagatcacctgaggtcaggagttcgagaccagcctggccaacgtagtgaaaccctgtctctactaaaaatacaaaaattaggctcatgcctgtaatcccagcactttgggaggccaaggcaggcagatcacctgaggtcgggagtttgagaccagcctgaccaacatggagaaaccccgtctctgctaaaaatacaaaaaaatttagccgggcatggttgcacatgccagtaatcccagctactcaggaggctgaggcaggagaatcgcttgaacccgggaggtggaggttgtggtgagctgagatcgggccattgcactccagcctgggcaacaaaagcgaaattccatctcaaaaacaaaaaaaaacaaaaattagccgggcatggtggtggatgcctgtaatcccagctacttgggaggctgaggcaggagaattgcttaaacccaggaggtggaggttgcagtgagccatgattgcgccactgcgctccagcctggccgaaagagcgagactccatctcaaaatcaatcaatcaatcaatccaaaattccatgtcaggctgaaaagcaaatttttagaaacagcactaccttccagaaacacagaaactcagcagtgaaagggtctttaaagattatttggcttaaccttttcattcagtcaattagaaaactgaagattaagtaggttattccttacagcctggcaaaaatagcagagccaaaactcaagcctcttgattgcaaaagaccagcatcttttcatcaaatcagactgcttttctaccaacttccatataaaacacaagagacagttacccatagctatattatagtacttatttccttgtattattatattcgacaacttgactccctacagagtaggaaataaaggtcagagacctatctagtttttagcttttttcatttgaaaattcattcaattgttcattcattcacgcctctcttcattcactcagctaatatgattgagcagctactatgcatgaggattagaacaggcatgaagaaactgaaaaatgaacaaataaaaaaaaagacatgcatcccagcctcattgagcttatgatctaataagggacattggtttaaaaaaatcagtaactataatgcagagtgctataagcaataagagaagttatattcagggaatcttggagactcagaaatgggaatgccccaatttggcaaagaggaggccctcagtaaagagttacttaaatattgacaatttatagtaaacaggggagaaatgcttgaaagaaaatgaaaagtaacttttctaactgatttatggtacaaagaagtggccaggtgaggtggctcacacctgtaattccagcactttgggaggtggaggcaggaagatcgcttgagcccaggagtttgagaacacagcctggggtaacacagcaaaaccccacctctacaaataatttaaaaataagccaggcatggtagcgtgcacctgtggtcccagctagccgggaagctgaggtgggaggatcgcttaaggctgggtggtcgaggctgcagtgagccatgatccaccactgcactctagcctaggcaacagagtgagaccctgtctcaaaaacaaaaaaagcaacagatctataattttgagtagcttgaaaattttatgaaatctgaaataactagaatgaaagatattctaaactgaaacaaatacctgaggtatgcttttttcatcctaagaattacctttcttttttctttttttttttaatacggggtatcactctgtcacccaggctagagtgcaatggcgtcatcttggctcactgcaacctctgcctcctgggctcaagagattctcctgccttagcctcccaagtagctgggactacaggcatgtaccaccatgcccggctaatttttgtattttttgtagagacagggtttcaccacgtcacccaggctggtctcaaacccctgggctcaagtgatctgcctgccttggcttcccaaaatgctgggattacaggtgtgagccaccacggccggccagaattacctttctgatattcaaactcaagtataaaattgttattttattatacactcaatcagaccatggctgactcattagtgaaaataccaacatccacatctcatgaaaacacataaagatgcttactcttcccgttttacttcactcccaggaatgatcttgacataagatttgggaaaccatcctcttcctccatgcacctccccaaaccaccaattttcttgctgctccaagacagtaataatgtcatgttttgagaagttcaagtggttatctttctttgcagtccaggaacaaagggcctgtgcttttaagttttctaccacttgtccctatgaatacaaaaccaccaaaaatttttaaaaggcaatggtaactatgatttctgtttctgtgtatataacatacttactgttcaaacagcagaccagttttgtgtcgtggtgacttaagataaccttagtctactaactgactttaaattatacatgatagacaactatgtgactagccttctgttaagacagactgaaaacccaccattcaaagaaacctcatcacatcactggtagagaaggtaaataatgtgtactcaagaaatgtattcacacatccatgaaatacatatcatggaacaaatgaaaaaggaatgttactgtaaatcttttttctcttccagcttgcaatgtaattctgtttactccactagggaaggaaattggcatgcttggctccctctgtttctctgcttttctcttaacttcctcctattctattctattcattcttctttctttccctcctctctcaaaggaaggagtgttttgttcctttaataaggctaaactcttcacttattctccaagtcttctattataccctttcattttctaaaaatatttaagtccttctcttcaatctacttctctacttgcttctacttctgaattccttaaatgatagtcttaaactttttttccaatttcactccttgatcacttctaatttaggttcagcactcatcacactactgaacctcttccagacaaggttattaataataacatcaaagccaaatgcttcttccaaacccttattcctcttgatctctaaacagctaacatcaagccttgtagttcctgaagctgactctctggtgattgatggctcctcttttgtccaacccttttcccttactgttccacaggacttccctaaatactcttaattatgcctatgacttctcaaacctatattttcagtgtaattttatctcctgatctccagacttgtatatcaaactgcctactgggtgtttctaccaagctgtccctaatacacatagcttaaacttagcatggctgaaacataatcatttttagaacctaccaaacccattcctcctgcactgtctaccaaagacaaggatactactatccttttggttgctcacgctaaagactgaagaattatctttaactcctatttcttcctcactctccacattcaatggattatctatttaatatcatttcctaataatcttctaaatctatctcctctttcttatatcttaattaccatagcacttgttcaaaccatcatctcttgttatttagctattgtaatatccttccttaactggttgttttcttctgctaatccagactttatgttagtgccagaattatctttctaaaacatacacaataactccactcttaaaaatcctcagggactttccactaccaagttgcctagcacggtattaaatgcttcccaaataaacctcaacctctctctccaacttcgcttaaccctttctccatgaatcctgtattccagccatattattaacaatgcttgtttcctgcaaatatcttgtgttaacatgccttggtgactttccccaaattgttctttcatgggaataactttccttctttgttgggtgaaatcttatctttgaagaccctactcaaataccttgccctttgtgaaggctgctccaattctcaccaattgagtaagatgatctcttctatatataccccctacagaccttgtagatatctttaatacagcatttctcatgctttacagttatttatatgtctgtcatgttcattagattatgatctactgaatggtgagtttctggtttttaaaaattgttttagagacggggctcactctattgcccaggctggagtacagtgatatgatcataattaattgtgcctcaaactcctggtctaaagtgatcctcccacctcaacctcccaagtagctagtactacaggcacatgccactatgcccggctaatttttaaattttttgtagagatgaggtcttgctgtattgcccaggttgatcttgaactcctggcctcaagcaatcctcccatcttggactcccaaagagctgggattataggcactgagtcactgtgcctggtgtcaatgtcaggtattttttgacttattttttccttaaatttctagcacataataaaatgcctggaacctatggccatggcattttttgagtgaaggtgaaatctggaggactttggactttattctgatgaagtctgcaatttaaaaaaataatgttaatgtaaccctattgcaatagttatatctaaatcagaggctaaatatacgttaaaaagttctaacgttcccaaataactttaagaaaaaaaaaaaaaaaccgtcaagcccaagtctctcatcttcttattataataactacaaatcaagaacaatatatcatgagatttgtaaaaataacattttgagcttagaaaccttagctgctagcaacttggtattatggaaaagaattgttgagaaacctaggccgggcgcagtggctcacgcctgtaatcccaacattttgggacgccaaggcaggtggatcacctgaggtcaggagttcgaggccagcctggctaacatggtgaaaccccgtctctactaaaaatacaaaaattaggcatggtggcaggcacctgtaatcccagctactcaggaggctgagtcaggagaatctcttcaaccagggagccggaggttgcagtgagccgagactgcaccattgcactccagcctgggcaacagagtgaggctccgtctcaaaaaaaaaaaaaaaaaaattgttgagaaacctctaagtaatagtcatttcttcaacttcacatcacatgtgaataagaaagaaactgaatgctacaaactctggttaaatgagtgaatggtcctttgtatataattttcattctattttaatcaggagcaaattcaaagaataaagcccacaaaaataacagacaacatacctgtccatgaataggtgatacagatccaggggacacagttcgagtgaaggctgattttttctgccatgatgtatttacagttaggtttgaaaaagatacattttgataatcagtcactgatgctggttgatttgaagaaagtggtctgcaaatataacactttgatataagtatatttatttgtttagaacttaatgaagtactaccaatttatcaacttacatattatatacactgtgcttacacacaatttgtgggaaaagaaataattattaacaaactactgacccatgttttcacttactaaatttcagtattaaatctggaacaaaaagtagtcttgaagagtacaacccggattacactatgatgaagtagtaggctgacaccattatatattaggtatttacacatttgcagatctatataaactttactgttagctaaaaacttactcagaggaagttgaggtagcagataaagaaactgtaggaggaagtaaggccttctttggagatacagctttttcattttcacttgatggcattttttctacataattgcatggaaaccagccaaaatttccttgaaaactaccataaagccaaccaggttctcctacggttttttcatcaacctacggaaataaaaagaaggattaacagtgcttagaaattcacacatttacaatggaaagagatgaaaactattgtatagtattctcattttcagaattaagcccatctaactaaacagctaaggcattttctacaaattaacagctactatttccagtgactggcaagttgtctttttaattttaattttatccaagttacatgaaaatattttacaaagacaaatagcattcattatatatggctaatgagggaaaacaatcctcccctatctcatggctccttatgccctgattttcactcctgacctgccattcttcctggtttcttctatatcaccatttatatttctgaataacatatttatactgctttttcttgaattttttcaattttagacattactggcttttggctatgggaaatgaagattgacctctctttcactgtagcctcttactctaccaatactgttatagcttaatctttatttaaatttatttaatgtttataatattatgattatgtttaaatatttcacatctgagtcatgcagcatgctgctgattaaatttccttttttgtaaactttttattctcctataatcattactttttttgtttttggcttacttttttctgttcctgttacacagtttttttgaactctctaacagaacaataagatcttctctgaatactattttccaactggtaaacatgtcaggtgatttatcaatttcattgcttctcccagacattttcatcctacagtgtgacatcctccatcctcacagtgtttctccctctgcttcttggtccttgttccttaaacactaaggacagcctcaagtttcatcactggctttctttcctcattctatacccttcctgaataagcccacttactcctatagtttgatcagtcctctgtgcaataatgaatccaagagctatgatctcagtgctgacttcttcccgaagcaacatgcctatactttcaactacttgcaagatatcttcaagtggatgtcccatgggaacttccaagtcaactttaaaactgaacttttctcctccatcccctccttctcctaaattcctctattattcacaccaccaaaaatttagtcattctaaataaaaaatctttggctcttacctcttttacacttccacatccaaactactgaatttgtcattaaagactcttctaatttgtcaacccaccctcactgccctacttcaggctttttttcatttcacactcaagattattatgatttttactcatccttcaagattctaacttcccccaacccaagccagagttatttcatacataactgtcataattagcattatatacattatatatgcataatgacacttaattatgtagctaatacataagtatatgtacttactacagataaattatttatatgtaaataatgacttatttacatatctctcttccatttgtccgtgagctttattgacccccactgtctagcatagtagaaatcacttaactcactgaataaatgaatatggtagttgtgtctctgttctccaatccattttccatacctttctaaaacacagacttgacagtgttatatatctattaaaatcatgttgaatccattcatatttttaaaaactgctttctcagatatcattaatataaatttcatgtttaaggtgttaaatttgatgttttgacatatgtatatacctgtgaaaaatcaccacaatcaagatagccaacacttccatcacccccaaaagtttcctcttgttccaccataagtcctccagcttgcccctccccatgaccttccctgccatctctacgaaaacactggcctgttttctgtcctatatattagtttacattttctaaaattgtatataaataaaatcatactatatgtatcctttttgtctgcctttttccactcaaggcatccatacagtaagaacagtttgttctttttttattgctaagtaatattatatcatatgaatataccacaatttgtttatcctttcaaatgttggtagacattaaagttttttctagtttttggctattacaaataaagctgctatgaacatttgtcttcatacggacatatgttttcaattctcttgtgtaaatacctaagagtggaatggctgagtcacatggtaggtacatgttttaacttttttaacaatggcttatggagatataattcacattccacataatccttccatttacagtacacaattaaatgcattttagaatattcaaagagttacagaatcattaccacaataacttacagaactgttttcctcaaaaagaaacactaggctgggcacggtggctcatgcctgtaatctcagcactttggaaggccgaggggggcagatcacctgaggtcgggagtttgagaccagtctgaccaacatggaaaaaccctgtctctagtaaaaatacaaaattagccaggcatggtggcacatgcctgtggtcccagctactcgggaggtggaggcaggagaatcgcttgaaccaggaaggaggttgcagtgagccaagatcacgccattgcactccagcctgggcaacaagagcgaaactctgtctcaaaaaaaaaaaagaaagaaagaaagaaacactatttattagattgtcatagctaagaaactgaaaaactttgagtaacccgaagttgttaagattttctctgttttcttctagaaattctacagttataggttcacatttgacatcatattttacctattttgagttaatctgtgtatatgttgcaaggaacaaattgaaattcatttttttgcatatgaatatccattgttccaataccatttgctgaaaagactgttctttttccactgagttgcttttgcacctctgtcgaaaatctgttgtttatacacacacacacacacacacacacacaaacacacgtagcatgaatctatttacctactctgttccattgatctattttcctgtctagatgctaatatcacaactgttttgactgctgtaacttttataataagccttaaattcaggtactaaaagatttccaactttgttcccttttcaaagttgttttgcttttgaatcatctcgtcatttgctacaaaaacaaaaagaaacaaaaaaaaaaaacaaagcctgctgagatttttgttgttgttgtagagatgaggtcttgctttgctgcccgggttgatctcgaactcctggtctcacgcaatcttcccattttggtctcccaaagtgttagggttacagatgtggatcacagcacctggctgcctgttaaagttttgatgtaaattgctttgagtctgtgtaagaatttgagaagaacagacttcttatctttttctaaaaaatttgtttacacaggacttaagagaagaactgacttcttatcaatactgaatcttccaatccatgaacactatatatctttccatttatttcggacttcaatttttctcaataaaactttgtaactttcaataaacaggtcttgcaaatcttttatcagttttatctgtatttcatatttttatgcaattgtaaatggtattttaaatttcaatttctgaatagtcatcgtttctatacagaactacaactgattttgttatattgatcttgtattctgcaaccttgctaaactcatttaaatagttctagtagcttaatagattctatgggactttttacatagattatcatgtcttctgcaaatcaatacagtctgtcttctccttttccaatcttgatgccttttactctatggtaagccactttagacccattaggatttttctcctagcagatgttgtctctctagtttaaagctcttaaaagttcaaacttcttagtgtagaatttgaatactctgaaattacagtttctttgtcaggtttcaacttacctttctagcttcatctcttaccatttgttcgatattctaggcaaatagttatatgacattctttaaaaacacctggcacatgcaagcctcaatgtttttatttaaggtattctcttctgcccagaatattacatggtttagaggaaatactacagacttgagagttaaaagaaccacatttcagtcttagccatgctacctggttatccttcgttaagataatgaatgctatcttgtgtgctttgtcatctacaaatttggggggaaatacctgtgctgccctcctctagggtatctttcagaattaaattgagtatatttatgaaggcgctttggaaactgtaaagcactaagcaaatataaggcataatccttcaaggccttcctccatcctatccttgggaaaaatgttccccaattctatttggttgtttttccttcattctctgggttcccacagtacttactcatataaattagtattgaaatttatcatgttatattttgtacagtaatacacatttcttttttttcctagactgtggtctccttattcatttttgtatgtcaccagaggcacatggttacaaactcaacaaatgttaacttgaatggattattctaaatttgattaacaatagacttaaagcttaattagtaataaatggattattagggcaacttcatttatgtttatggtaaataattctcattttaatgttatatgtctggctatttattacatcatgaatgaaatatttagaaaactcctaaaccagagctgctatggctaaactgtatgatgtcacagtaatgtagctcccataaaatggtgttctaaaatagttagaatgaaagcaaacacttatgaaatattatcctgtaaatctagtttaagactagtttaaaatagttaagtctgccaggcacggtggttcatgcctgtaatcacagcactttgggaagccaaggtaagagggttgcttgaggccaggagtttgagacaagcgtaggcaacatagtgagaaactccatctccacaaaaaaaaaaaaaaaaaaaaatagccaggtgtggtggtgtgtgcctgtagtctccactactcaagaggttgaggtgggaggatggcgtgagctcgggtggtcgaggctgtagtgagccatgatcccgccactgcactccagcctgggtaacagattgagacccagtttcaaaaataaataaataaataaaataaaatagctaagccagagcaatataaattcagacaagaatacaataaaccctgaggaattacacaaaccaaagtatttcaatgctgcaaaatgctcagcattgtacctgatttaaatgtattgtcttggacatggatgacgctgaaaaccatcattcccagcaaactaacacagaaacagaaaaccaaacaccacatgttctcactcacaagtgggagttgaacaatgagaacacatggacacagggaggggaacatcacacagcgggacctgtcagggggtgggggactaggggaggaaagcattaggagaaatacctaacgtagatgacaggttgatgggtgcagcaaaccaccatggcacatgtatacctatgtaacaaacctgcacgttctgcacatgtatcccagaacttaaagtataaaaaaaaaaaaaaagtatggtcttaaggaaaggaatcaccgtaagctatgagtattggctatatataggtacacatatgtacatacatacatacacacacacacatttaccacatttacttacatgcccttcctactttcctttctacctcccttcactgacggacttggctggctggctgacttttcagacagggtcttactctgtcacccaggctactagagtgcagtggtgcaatcacagctcactgtagccttgacctcctgggctcaagtgattctgccacctcagtctccacagcaggtgggactacaggtgcacaccaccaagccccgctaatttttttttactttttgtagaaacagggtcttcctatgttgcccaggctggtctctaacgccagtacctacgtgatactcctgcctcggcctctcaaagtgctgggattatgggtgtgcacctgcacctggccaaaagcttttaaaagtattaatttctagatacactttttcctagtgttttcaacctaatcaagaagaaaaatctcgttcatttattctgtagttaggccaagttgttttagtaagaggtcaattttaatctctttcacatctgtcatttatagttgtaattaatttttagttgttaatttacatactgagttaaactgaacattttatataaattctcacaggcctagcaaaactacttattacttcttcttaactacttattaattaatgttagcaaaatagcattaacagattagaaggctagaaaaacatttcagcttgtcatcgaaaatgtggccaagactcagtggaatttctaatccttttcactttcaatgaaacctccggtaacaccctcatccattaagttgatcagaccttgcctcctatcttaccgggaatttggaagtcctgggacctgacttcatcttctacttcagcaaaatttactttaatccctcccaccctttcttcctgccctctaatgacaaaggataaggtattcaatccttctaccactctcttccagggctccagattccagccttctagccttttcaagaatcttcctcatctccatctattagtcagaacagggaggtttgacaaggaacatgaagtgccttcctgatgctgtacgttctacacactgatctgaggggggcttcacagatacacagatgtgtacacattctttgagctgtatacttatggttgtacactttgctatatataaattatactttaataagaaaaaacaatctttatcagttatttatactctttccattatcattaacctgtttcctctctgcagatcctttctactattatttaaacttgctcaagcttcagccaactttaaaaaaaaaaaaaacttccctcaacccacatttctcattatttactaccttctctccttctccctttcaaagccaagctcattcaaagagttttatatattcactgtctcctcttcctctcttccaatttattccaactcactgaaatctggcttctcgctctactagtccacttaactgatactgctgtcctcaagttaacaacacctgtgctattgctaatctaataatttttttagtccttgttttatttcacttgcagatcactcttctcaaagttccctaacattaaactctcctgtttttttttttttcctactactagtcactccttttaaggctccacttcctctaataattccttcagtgtccatgtttctcaggaactgcatcctcaatcctcttctctctcacgttactactcccctggatgagctccattactctcatgtcttccaacaccatcacatcacactggcgacatccagatttacatcctcagcccagaccgctgcctgacatctctctaggtactctggagatccaactactactgcctggacatctgaaactcatacaaaactgaactcataattctacttatatattccccctctgattttccctcttaggaaatgacaccatcattaaccaatttgttcaaatcaggcaactcatgactgacagtagtaactcatgactaatacttcatgttaatgattcagcagagtacacaagcacccaagacacacagctaactttatgtttctgttgtcactgccaccagaatggctctctgaccatgggagaggtctgtgctaaagctggtagcagtctacaaccttttccttaccttccttcctctactgctttaggttgtcacgctttttcattagcctacaagcgtgttaagagcagagataatgtcttattcactaaatccctagtctaacatagtcagccctcaaaaaatatttgttgaaataaataaaaaatataaccaaaaatataagtaaactcttgaccaaacacgcccagagattggttgtatctcttcatccagacaccatcaccaacaaggagaggaggaatggtaggaagagcagacagtggacttgggctggttgtagaacaaacctctccccctgctcgggcacagctccggtactactaatagcggcaatggcaagagcaggaatgtgtgtttagggtttatcttgggtgctagcgttttggtaaatttttttccctagtatcattaaacatttgccacctaactgataaatcacactaactggtgacagtgcagggggagcgggggaaagaggcactggctagatactctggctagatactctggttaacattagtttaacaagaagaaaacagaagcagagactaaaatccaagtttgtgtgcttctaaagcctgtactctttccattatgtcctactggctctatcaaacactactcctgggatcttctcttattcatgtattttatatggattgtgataacacaataaagactttcgttccaaggaacaaattgcctgtatccagttagggctgtggaatctaactccttcaattcttttaacagttgctgtatggcatagcagaaacaacgctggatttggaaataaaaaaacacataactgcatcccattctggcactgcaatgctgacagttacaacttgtgtgagtttaagcttccttggctagaacttagttagtaataataactgtcctatgcagctctgaagtatgttgtaaagtccaaatgaggtaatgtttaagaaacattttacaaaggtaaatatatgaaattaatggtcaacattactacagaaactaatatattacaatgtatttaggttattcatgattaaaaaaaaaattcatttcctacctgaattatatctccagaattaaaactcatctcatcatggttccttgcttcaaaggggtataatgctctataattcaccaaaacactagctgtctcacctaaagagaagacaattgtcattatttgcaacttacatgtatacatctttgctatgactcaataaagagctctaaaacctaaaagaaaaaatcaagcaccaaatactacaatgaaaatccacttgatacagacttgctaggatttcagtatcttgactagtcatctaataaaaaagcaaacaaggatgctcatcttaagtaaggtaggaggcagcaaaacaaagagatgacttgcgggatgaagcacacacatgggtagaaaggaaagtgcaggagtgggggccaggctgagctgtacaaagtggaaggagaccaagcaaagagaggcttggtttgatctgtggaggtctgaatataacagggaagtaaaggacaaaaaggggggtctcaaaagataagaatagcaagttaacagggatggctgaagaaaaatctatacatctatcagaatggttctaaaaggaaaacagtggaagagtacacaaatatactgaatttgataagaataaaattgtttactttgttcatctttagaatgttttaacttataaaatttcaacaaactgtatcattaataatgattcaaagggttcatgtatctaaaagagatacaatactactaaaagtattgtggaaatggactgaggtgtatcaaaattttactgttgtttcattaaaataaatagcttagttatagtggttgaataaaatatttaaaactattttacttcaattatgaaaaccatgtctgagtcttttcacaatcagtagtaactatcttcttttctcctgctgtgctaagatttctactgctgtgttaagatttcagtctgttttaataagcctactgctttttatccaagtttaatttataaaaaggttttttctgactctacaattagtatctttctaattttcttccctttttttgtctcttatcaggtcatttttttcttgttgcatttgttctactgtctcaaagtatccttatccttacgttttttctcctcagctttcaaagtatccttatccttacgttgtttctcctcagctttccgttcctcttcttgaattttttcttgtgttttttcttcctggagtcgcttttgtttttcttcttcctcctttctaagattttctttccataagttttcttttccttgctttgctttcctttacataaaagaaaaagagtttgtataatgtcctagaaattttttacactaaataaaaacatactaagatctggttcctgtcaaggtgaagaactagcaatgaagtattagtacaggggtggggagaaactgctgagatcagaggtgaaaggaaaacaaatcaatcaatcaatcaagaaaagctttggaagctttggattgattagtggatgcactggggtgtatgactgacaatttcccacacccaaaaattccctcctgctaaccaacctccaaactcaagaaaaaaagaaaaaggttgaaatggaaccattcagcaaataaatctaaaaattacatctaagtttccttcctttctctccagatatttgacaagaactgtcttccagctgttattcccactgtcctatctaatctttgtttcaggggtttagtcattgttgctgtggaaataggaaatgcttctagaaaaacaacctacttttttttttttttttttttttaaagagagagggtcttactctatggcccaggctagagtacagtggttcaatcacaggtcactgcagcctggatctcctgggctcaagtgatcctcctgcctcagcctccaaagtagctagcactacaggcacatgccactatacctagccaactttttaatttcttttttataaagacagggtcttgctatgttgcccagtctggtctggaactcctggcctcaagtaatcttccctccttggcctccaaagtgctgagattacgggcatgagccactgcgcccagtctactttttatattattacttcaaaaagtcttttttgtttgcttagataatagagcatttctcctctctaggtccacgtgctttggtaaacatttcaatgaaatctaacacagctacagtttggtttccagccagtcaaggtgatctgtgatcaattattttagtattagaactcatgcatcttatagttctcctttgcatgtattttcacaaccttactcagaggtagagctgccaccacttaaatttagcaccttctccaagcctcagcactatcagggcagtgaagattacagctggaaacattcctgagatttgtcagcatatatacccttccaaagtgggaaccttggcataattccacatctctattccttaattcctgaaggaatctcgaaatcctggataattcaaaatattgtaggcccttagtcatcaatgctttctccttatctctcaactgtttcagacttcatactgctggttcactagcccatttactagattccttccaacaatttccaaacctccttcatcctctatcatgtcatagaatgcttcctccggcaactttcaaaacggacttctggttctcctgtgaggaaaatgcttctcttgcagtcctcacttaatttcaactaatatcccctttctcagttcctctgtaactttccgggacacttttccaagcctagtaattaatacccaattagctttcatttgaatttttatagcattataaatatcactatcagagtacttagcacatatttagcacaacaaaaaaaccagagggctcattaaattaaaattttctatatattttttaagctcttcattctttccatcaactcctcctgccaggtaatcatggccacataagtatgagactaggacaacctggataaggctccttgtttaatttaaggaaaggatgtcaggcccctctactctaggcttactgaggggtggtacttggctgagctcaacctgcaggaaatcatgccagaattctggtaaactttatgtaagagttagtagttgagaaaccggtccagtgccacaggatgcctcagaagctgggcaaagggcaaagaggccacaactaaaatgtgaaaacctattaccaataccttggggaaaagaagggaatatacctgggcaaatggccaatcaatccaagatgtggtactaagacccagcttcagactgagtaggtcctatatgcacttccgctctctttgatttctcttctctactacctaatgtgcaaggatgatgaatgaaattaaacgcatataactagtataatcttttggcctgaaaggaattgtgaacacgatgaagaaagattaaggtaactgcatatgtcaatagaaagttctgacataaggattagctgtggaaccactgcacagctcccttatgtaattaagtggtacaagttaagcagtaaataagagctgtaagagctacttcgtttgaactttactttctctacttctatattattctattatctcgttaggaggccacaaaaacaggggtctagatcaccaggcgcagtggctcatgcctataatcccagcactttagaaggccaaggtgggcagatcgcttgagcccaggagtttgagaccggcctgagcaacacagagaggcctcatccctattaaaattcaaaaaaaattagcagggagtggtggtacatgcctatattcccagttactcagtgggagcttaggcaggaggattgcttgagcccgggaggtcgaggctgcagtgatccctgatcataccactgcaatccagcctcggtggcagagcaaggaccctgtctcaaaataaagaaatgggggtctaggagtaaacaatattatagttattcgtttaactgtctgaatctcctattagaattatgaggagtaatccaaagtctaccagcatcacagccaacaatagccactcaaaaaaatgtgttggaggtggctactttgaaaccattaagaatagaggcctgccaaatggtaatgtgtcttccttgcctccctagtaactattagctttttcatagaaattactcatctactctttaccaaggcaaaaaaatactggttcatccatatttgttaactaattatactactttctgatactagaaaacttggaagaaagagaagaatgtattagaaaaagaatctcaatggcagaaaaataccatgcaaagtttctaaatgaataattctaggcttcagataccacaaatgtcttacttctccttactataaatggaggcaattaatatatctcaagtgataaaaagagaaatgcatcaatgtggcattctacattcagtattactatatacaattaagtattctgcttttatgatctttcaggaaactaatagatttaccaaggaaagatggaatgaatgagtgtttactatgtgcaacaaattatacttggctctttagctacattattttattttttaacttaagagacaaggtcttgctatgttgcccaggctggccttgaactcctgggctcaactcatcatcctgcctcagcctcccaaatagcttgggactacaggcgtgtgtcaccacgcccagttccagctgtattattttatttaatacatttacctatgagatatgcattattgtctctattttcagatggagtaactgaggttcagaaagataaaaataacttaaccaaggtcacccaggtagtaagtggaagagcaagaattctaatacaggtttgactccaaagtctgttatttttcactagtagaaaataaaatcagttactgcaaacttgatccctaaaaggactgaacttatgagatccagaatctgattaggataatccctttattttccttaaattttcataaactaaagatatgagcaacaaaattacaattctaatggcaatatagcacaataaatatatcagctatattaccttgcagcctcatcttctagtttctttttctgcattagttctaatcttttcctttcaatttccttcaacttgtcacgtttgatcttataaagctgttcaagggctaactgctgtgtgttgtaggtttctctcagttcctaaggagaaaaagaaaataagtcaatacgtgaatgatttaaatatgcttgtcatatgtattaatgtggcatttgcattaaaagataaaaatcctatagcaagttgaactaaatttaaaatatttaaagttttaaaaaatatctagatgataaaaaaaaccttaagtatttaaaccatatagctcctgagataaacacattaaaataatctacttttccatcagttcatttctacggaacacagaatctttaacaagccgatgctttgatttggtacatcattttcaattaaaaaaagcaatccattaaaaatatgggggaataatttgcttgttataacatctgaagagaaattttgttcagtcatgtttttgacatatgtaatttaaccaagttatttttatccaatatcatcttgaactaaacacagaattattaaataatttagttcaaaactaaaaatggaaaagatgtctgcctaaaatcatgaccaccatgagccaaaataatgaaaagcattccaaacaggagttgaaataaacaactgcttattgaacatctagttgtatgctaagtgctataaagcgttccaagaggatccaatacaaggctgactcccacgtctacagactttgtctttaaagagttcacaatctcaatgtagaggcaagtgtcaacatgcagggcagaggtaaattccttagcaggaacttgtgattatctgttcagcattttctcttcctcttcttcaacagcaccctgccttcctctaggaaactgatctttccaccttcctcccaacatcttacgtggttttaaaaggtctgccaaactcagagctcctcccattcccatcaggcacaattgtttactcctgacctaaacaatcacagcaccttacttccctgctcagaaacgactggtccaaaggacataagcataatccaagctggcccagaatattttcctgggattcacatatgttgaagtggggagaaagaaacctttctgcagctcattaaactgggataaagtaaacctggagctgcctcacaaccaaataagacctggggataggaataaaatcaactcagaaaaaagagaagtacagattagagactgagctggagagaaagggtactatagaagctgaatgttcaatatcatggctcggagacctaggaactgcccctgtccagcagcccttccatggattcagttagtggtcctaggatgcttctaataatcactcattagcttaactattttgaactagatttctttcatttggaatctacagaatcctgaacgagagagtagaaaaaggaggctggaggaaagaagtgggggcggggggacttaagagtaatcaaaagaaacttcatggcaaaggtgagagctggacaatatttgggtagaatgttttggtaaaaaatgttttttggtatcaacctatacacaataacacaactccaaactccatttcttttcagagataactattttataagtgaaccttttacttgattgaaatagtagatttgatctaagtacagcatgctgtccagagactatgtccaacatgtctgagcaaaacatttacaacttaagccaatagtaatgcatactgcttttatagcagaatttccacagctctcagcttctagggttttatttgttgtacctttctctaaattctattgaaaagcagaagaatatagtggttacaatatatagagaagcaaggtggtttagtgatgaggagcatgggtctggaataagactaacaaggcttgactcaggctctgtatactagctgtataaccttaggaaagttattttatagtttcctcatcagtaaaatgaggttaattatggtacaagggtgtccaatcttttagcttccctgggccacatggaaagagggaaaattgtcttgtgccacatgtaaaatacactaacaatagctgatgagctaaaaataaatacataaataaataaaattgcaaaaacaaatctcataatgttttaagaaagtttacaaatttgtgtagggctgcattcaaagctgtcctgggccgcatgtggcctgtggaccacgggttggggaagcctgttatgatacgtgcctcacagagttgttgtgaggataaaatgagttaatacatataaagtgcttattatagtgcagagcacctaggttctcagtaaatcttagttattattattggatgaagtcaaaaatgaggagagtactcagtctaaaaggagagtaaaaaggagccaaattaatgtctgatctcaacaaggctgcaggcttagccctccaacttgtcctttaaaatagagctctaagtattcctttactaaccctattccctgcagtgtcagagttaatgagcttccttgtgccattctgtatattcctctatcatagtgtcttctcttccaactatatgattgcctcctccactgaagtgagtttcttgacaagactgtctttcatcaaggtgtctccagccaacagagagtctagtacaacatggatatttaataaatatttattggacaaatgaaaaatgcataaacaatagtctatgcaaattagtaagatttaaagagcaccacaaagcttgccaagtatttcctctatttgactatggtgatgtaaaaattcctatccttagacctattcctctgggttaagtcactacttccaggaggtccttgctacacataatagttaagcaagaaaaaaataaaccaatcagaattcattaagagttgttctcaatcttttttttttttttttttttttttgagatggagcctcgctctgtcgcccaggctggagtgcagtggcgcgatctcagctcactgcaacctccgcctcccgggttcaagcaattctcctgcctcagcctcttgagtagctgggattacaggctcatgccaccacgcccggctaatttttgcatttttagtagagacggggttttaccatgttggccaggctggtcgtgaattgttgagctcaggcaatccacctgcctcggcctcccaaagggctgggattgcaggtgtgagccactgcacccagccaagttgttctcaatcttaacagaatgatagattatctcttttacgttaaggaacttctattactagtttgctaataagttttacttttaaaatcataaatggatattaaattttatcaaaaacctttcctgtatctaatgagatgagcataatctttttctcctttagtctgtttatatagtaaattacattaaacttttctgtatgttaaatcatctttgtatggctgaggtaaatccaacttggtcatggcaggttatgccacctgcaggggtattactaacgtagattactccagatccttggaagcatagggttaagacctaactccttgaaggaaaccacaattctaccattaacagattctactttccctctatggacaagcatttccccaatcattatctcaagtcaacactggttgactttccaaaatactaaagatattttggagattctgacaacccctttcttaagaagagtgagggaaagtaattttgttttttcacaaataacaaaaatatttgtatattcgtatataagagtttacaaagcatttccatctatatgcgatctcatttaatcacaagactttgcaaagaagacaggcagataatgtcagcatgttttgtaaaggaagaaagcaaatttggagggtaaatgacagatcgttacacaactggcaagtggcatggataagactagagttcacttttttagattcctaggccaggagttttcgttgcacttcactgctaaagatgtgtgaattttcttttttttttttttttttttttttgagacggagtctcgctctgttgctcaggctggagtgcagtggcccaatctcacctcactacaacctccgcctcccgggttcaggtgattcacctgcctcagcctcccaagtagctgggactataggcgtctgccaccatgcccggctaattttttgtatttttagtagagatgaggtttcactatgttggccaggctggtctcgaactcctgatctcatgatccacccgcctcagcctcccaaagtgctgggattacaggcgtgagccacagtacctggccagatgtgtgaattttcttaatggtataatggcctgtcaaatgtctcacttttgaatccactggctttgtcttagtataacttgaccaaaagagtaaaaatcattaattctgtacatgcatattgcaggttccagtaaaacataacattctaaattaaataattgaaatattttacttctgttgtcactacaagtagcctaaaggagtggtggttaaccccggtgctctactatcacaaaggaccacagcatcagaactaagtgcctgtcctgctccaacactaccaggaccagttccatctcacctactgataagacacagcctttcttctcattccttatcacctgaattcttatctctacagtgctgtttatcccttaatctgacccaatcccctactcattctctcctcaaacctctccactctcctggaacttcctctatgtgatcaggaaactatcatacagctaccaatcttctctgaacgaaaattctcttccctcgtcactttcttggctgatccctccggatactacttttctgctagtcctctctcagtttattatcatatactccatttacatcagggtcagaggataactacagtattttccttgctcttcactgccactttcagatggttatttccccctcactcttagcaactccatgcttttctggggctcctaccatccagcaataccattctctccttcctttttattgttatctattagtcacctggtcattcactcacctcactattctctaagtctttgacatccacataaatgatgcaatccaaacctcaagtctcaggctgatctcttcatcaatgacctttttaactctacttaatccatcactcccattattacaccctgagtcttactaatcagaaacagaactaccattgaccaaatatcccattcttcaaacgtaagttcttacccttcgaacttttcttatacctggtacatctatatcaatagggtttgtttgtttgttttttctgagacagagttttgctcttgttgccctggttggagtgcagtggtgtaaccttgcctcactgcaacctccacctcccagattcaagcaattctcctgcctcagcctcccgagtagctgggattaaaggcgcgtgccaccacacccagctaattttttgtatttttagtagagacggggtttcatcatgttggccaggctggtctcaaactactgacctcaggtgatcaacccgcctcagcctcccaaagtgcagggattataggcgtgagacaccacgcccagccatcaataggttttcaacctcactgagaccattctgttgactcccatcattctctttctttattaacaccccttcctctcttcacatccttcatgtctagttcatgtttcagagctcatcttgatcatagtgcttttgtcaagatctgtaactcttctgtccctctctctttgtgcatgtctattaaaacctcaaacctgtatgaaccatgaacctatttcatcagctttctctgtgcttatacctaaacagctgaacattggtgaggcaaaatcacacaattaggcatactgttttcaatttaaatacatcacctccaacttcaaaaagacattcaacattgctcagcacacttaggttttcctctactaagcttgcatatctgcactgagatgtctatttcatgcctatttctctcctgaaacttcctaatcttccatccattctcctcactaccagctataaaccttgcctcattaggccatcagactgcagccctctcaactttccatctcaaaaaaccaatagcactttctgcatctccacccctcttcttctggcctaggctgagttatatcatgtcctcctctacccaggaagattctttctgatggtccaacttacctctgattttaagtcttgaagctgtcgatatgggagtgggccagggaagtactgggtagagaaaggcgggtccctggctagggcttcagcctcgggcctatgcccatgaacctaggtgaggacaggcactcctgcctttgcacccaaatgttgcatcttccaagaccaccctggcctgccacgccaccatcctgtgcctacaaaaacccgagatcctaaaaaggcagaggcataagtggctggacgtcatgaggaccacatcggcagaagacgacacaagcagctggtcatcaagagcacgccggtggaagagcatgtcaacaggcaccagcaggccagcaggccactgaccagaggaacaatgcggagtttggccagagcagtgagaaatcaggttgcggcccgactccagggtaaaaccgtctcccttctggctcccccatctgctgagagctacttctactcaataaaaccttgcattcattctccaagcccacgtgtgatccaattcttccagtacaccaaggcaagaaaccctgggatacagaaatccctctgttctgtccttgtgataaggaagggggtctaactgagctgggtaacacgaaccgcctatagacggcaaactaaaagagcactctgtaacacacccccactggggcttcagctgtaaacattcacccctagacactgccgtggggtcagagccccacagcctgcccatctgtatgctcccctagaggtttgagcaggggagcactgaagaagtgagccacatccccatcacctgcccttcaagggggacaagggaacctttcccgttttactgtcaacttcctactctctaccaacaaatttaactgcattcataaccatcttctccccgtatgttacactgaaagtattctttttatctaatcctttaatctgtgctctccattccatcttaatctgcttcttcagggactttgctccatcaattaccacaatctcaatctttctctctttccccctgcctcctcctttcttttctctttactatttccttcaagtctttcttaaaccaaaaaaaaaaaaaaaaaagattttcctttgacccccatgcttttttcttttcattctaagagttgttgctactcacttaacccttcctcaactcttactcattcctgatccactgcaatccagcttctgcttatcactcaagtgaaatggcacttttagcaaggtcttcaaaagttttctttttgacaaattcaatggatatttttctttttctttttttttttgagacagagttttgctcttgttgaccaggctggagtgcaatggtgcgacctcggctcactgcaacctccgcctcccgggttcaagcgattctcccgtctcagcttcctgagtagctgggattacaggcatccgccactatgcctagataattttttgtatttttagtagagacggggtttcaccatgttggccacgctggtctcaaactcctgacctcaggtgatccgcccgcctcggcctcccaaagtgttgggattacaggcgtgagccactgcgcctggccaatattttttagcactatgttaactaataactctgtatcattttctagtaactacagaagacctcttttcttgctttctgtgacaacacagtctcctgactgctctgacagtatagatttcatatctctttagtttcctaaattgctctgatgaaagtatcaataagcagtgtaagtctggaaggcaggaagcagaaggaacaaagtaaaacaagggacaagaataactgctggcctgtggagaatcaaatgctaactcaaagaatcagactctgtgagggagaacagtccacaaatcatcattaaacttcactttacagatgaggaaacttagtttagtttctatgcaatccgtagcaaaagttctaaaaaccatataatctggccattcatgccataaccataaaggctaaaatatgggtcccctgctgctaccatctttccaatttgccctacttcgctcaggtaacaaatgaactctacttatcatgtttctgtcttcactgtggaatatatatgcatataggcaactgccctattgctatccattttagtactgagtaaaatgtgtagtcaaaatctactagagtcagcaagcagtaaacataaagcacatttctttaagctctattaaaatatttttaataatctacgttatacatggcaaagagaaatatttatataatttaaacatttttatctgatgtgcaagcatgtctaaatatgagcctggtaactagacctgactaaagttgcccctgcattattggttctttaaaattgtccttacaacagtattaggaagcagcttggtgcatatatgacataaacttgccctagatttcataaagtattaagttttattttaaacactgattttcagtgatatgggtaagtgatttaatctcacattttcctttgaattgagttagtaatcatctttatcagttaacccactcccagggatgttgtaaaggaaccaggttatatttctaagtgtcctggacttcttttgagaaaggttactgtgacaggcaaccttactgacttctggcattagactcaaacaggcagtcagatagcagaaggatattcaagcaagcagaaagaaaaaggcttatattgtatatgttatttcaaacaaagatactcagataaaggcaaagaatagtctagttttaaaaaaataaaacagcaaagtaactcaaagaaaagaagctagatattagaaaataaccttaagtaagaggaagaggttgttgagacagcttagcagagacaaaaggcactgaagaacagagtcatccatattcccacactgtaagataaggcagataaaaagccaattaaactacgtacagaatttttttttttttttttttttttttttgagatggagtctcactctgtcgccaggctggactgcagtggcgcaatctcagctcactgcaacctccacctcccgggttcaagcgattctcctgcctcagcctcccgagtagctgggactacaggcgcatgccactacgcccagctaatttttgtatttttagtagagatggggtttcaccatgttgcccaggctggtctcgatctcttgacctcgtgatccgcccgcctcagcctctcaaagtgctgggattacaggcatgagccaccatgcccagttatgtagattttttaaagaaataatatagggaagataagttggctggcttgtctaaccagcaatgacaaatgatttggttttctataaaatttttttctactgaacatatgcttgtgtaaagtgtattattaacattgttcacctcaaattccctttccttacctgaagccaccatgttgtcctttctttagcatgctgtttactctatatttgctgttaatgttattctaaataagtcagcatgataaaagccatatgaagagagagatttcttatacaaaagctttatgaaaagctttatttcttacagagaatagcttatgctctggaaactttatattgttagcaaaggaataactgagactattcccaaatttacattctatgccatgagcctgggtttttagtttctttcataggtatggcttcagtgtacaatgaatactgtggtgaatgatatgcagacagtctatgttttggacatctgctctgccactgcggcaaacaatgaatcattaacttgctttttgtgcaaagtttatagtgccagattctgttctagatttcactgattattgcattatttaacaaaggttaattaaattacacttcacaaggaaacaaaataaaaactgtgttaaaagagccactaacacctaaactatttcaaattttccatatttctcatttttgaaaattgcctaggataacgctggctgagatcagttctgtaatactgacaaaggcaattgttctggaaatgtatagatgccaagacaaacagcacatagtcatcaaaaattggaaactgtgataaagtatatgtttagttatatgacactatgtcatataactagaacattaaaaacaatcttgaaattcttgtatagttgaaattataaaataaattatgaaaatgtaatacatataatagctttagctatttattctattaaatcaaaataatgaaggtaagaaggcagttacctaaaaataaatagtatcaaaaataaatacctttagttgattgttaaaagaatccatttctgacagcttagatgcagtttctttttcaagagcatctaactgttctttaagtctttggcataattcttccttttctaatgattttttatgaagtaaactgacccctgaatctgaaaaacaaacatcagacagtttacattttgcagaagttcgtatgtcattaccagcatgtcatttactgtttggtcagattgatgtaactagaccaatacgaaggatgtatacacaatgcagaccagtacaagagaaaacattcagttgttatttccacttcccagattatatgctggaaagagcatcagaggaaatggttgtaagccttggttctgcattcaaaaggactaggacctgaagtgaaattctactttaggaaagatgcttcaccaatcgaatcctcaggcttttcatctatacaatgagcatcatgctacattaaatgaggtgatggatataaagccattgtacactctggtccacagttaatactcaattaatagaaactatagttaaagtagctttccatttattcttagtgctcccaagaacagggaaatattcacagcaaagattcagtaagtattactaactggattatttagtaacattattttaggaggtaagaacagaaggtttcattttatattatctttttttacatattcatgcagggatgaagaaaccagatggaaatatataatgcagaatacattacaataaattaaaatagcaatattatctgtttaaatgtctgtttttaactttatcatatttttgaagtacagaagtacaaaatttaaataaaatgaaacatacagagtaaaaaattaaaacacctccatttcaactgcaagttcatcccccttttaggcatttacatttagatgtgtacatactcaacttttatttccatgggttttaacagaatcatattgtctacattgctatgcaacttgttttcaatttagtaagatatcttatcaatcaggacaaacagatctagttcattcttttaaattgctccatagtagtttacattatggctactgcataatttatataactacctttctgactggtatgggtagatgttggtctgaacccactgatcaacatctacccattttcccctccctctaacccctggtaaccactcttctactctcagtttctgtacaggagttcaacttttttagattttatatgaaactgaggtcatgcagtatttgtctttctgtaactgacttactgcatttagcataagggagcgcaaatatctctttgagacagtaattttgtttcctttgaatatatattcagaagtgagattgctggatcatacaagagttctatcttattttttttagaaaccttcatactgttttccttaacaactataccaatttacattcctccaacagtgtacatgggttcccttgttcccacatgctcactaccactcgttatctctgatctttttgataacagccatcctaccaggtgtgaggtgatattatatttcaatgtggtttagatttgcatttccctgatgattaataatgttgagtccctttttaaatatctctttaccatttttaggtcttctttggagaaatgtccactcaggtcctttgcccattttgaaattgggttgttttttggtattgagttatatatattccttgtattttggatataaaccacttatcagatacatggctcacaagtattttctcccattccacagactgccttttcatcttgattgtttcctttactgtgcagaaactttttagtttgatgaagtcccacttgtttatttttgtttcctgagcttttggtgtaatatccaaaaaatcactgccaaggccaatgtcaaagagcttttgtcaatgttttcttctaggagttttacggtttcatgtcttatgtttaatccattttgagctgatttttgagtatggtataaggctccaatttcattcttttgcaggtggatatccagttttcccaataccatttatcgaagaggctaccttttcccattgtgtcttcttgatacccttgtcaaaaattagttgaccatatacacttgggtttatttttgggctctctattctatttcataagtctgtatgtcttgtaattgacaaaaaattgtatatatattgtatgcatgttgttttaaaatatgtatacattgtaaattggctaaggagctaattaacatatgcataatttagctaattaacataatgtgtatgttaattagctaggctctctattctgtaaatctatgtcttttgtaatcaacaaataaaaacttgtatttatagtacgcatgttgttttgaaatatgtatacattgtaaaatggctaaattcagctaattaacctcacatacttacctcacatacttaccatttttgtggtgaaaacacttaaaatctattctcttagcaactttaaagaatacaatgcactattattaactatagtcaccaggttgtacaatagatttcttgaacttattcctcctatctaactgaaatgttgatttcctttgagcaaactctcagtgatccccttttctctcaccagccctggtagccaccattttattctctacttttatggataaatatatacactccacaaataaatgaaatcataccgtatttgtctttctgcgcttggcttacttcacttaatgtaacatcttgcaggttcatgttgtccctatgtctgtttttatgccagtaccacactgttctgattactatagcttcataatatttgcaaacaggcagtgtgatgcttccaactttgtttttctttctcaagattgctttggctatttgaagtcttctgtgattccatatacgttttaaaattgctttttctatttctgtgaaaatgctatttgaattctgatattgtgttgaatctgtatattgctttgggtagtacagataatttttaaaatattaattcttccaatacatgaacatggagtatctttccatttatttatgtctttttcaatttctcccatcaattagttttcagttacagatctttcccctccttggtcaaatttattcctaagtatttaattatttttgatgctgtcatgaataatattgtttacttgatctcttttttgaatagttattggtgtaaaaaatgcaactgatttttgtatgctgattttgtgtcctacaactttactcaattcatgtattagttctaagttttattgcagtctttagggttttcaacatataggatcatgtcatctgcagacagggataattttactactacttttacaatttgaatgtattttattcctttttcttgtctgagtagtcctgctagtacttccagcattacgttgaacagaagtggtaaaaagtgcgtatccctacctcataccagatcttagatcaagcttatccaacctgcaggccatgggccacatgcggcccaggatggctttcaatgtggcccaacacaaattcataaactttcttaaaacattatgagattttttttagcactcatcagctatcatcagtgttagtggattttatgtgtggcccaagacaactcttcttccaatgtgacccagggaagccataagattagacaccccgatcttagatgaaaagtcttcagtttacccccattgattatgatagctgtgagcttttcataaatggcctttattatgttgaagaaaattccttctatatctattttttttgagagtttttatcatgaaaagatgttaaaccttgtcaaatactcgttctgttatttatggagatgatcacgtggctcgtagatttttgtctttcattctgttaatgcacactttaaattctgacagaaattgccaaactactattccaaaaaagctgttatcaacttatgccaccaacaatacctgtttctgcaaaccctcatctatattggatattatcaatcttttttcatttttgctaattggcaaaaaagaaacctgattgttattttaatttgtattttcttgataaccagtgatgtcaaagaaacatctatttatgtttctggccagagtcttgaattgttaggtcttatcctttgccgtatttttctattgggctgtcttaatttttgatttgtagaagctctaaattcttgtattacatgtacttcaaattttttagtgtttatgctgtctttcattatgatgttttcatttttaatcatcaaatctgtaagtattttcttcatgactctatgtattgtttaaagagaccttcctcataccaagattataaaatattttcctgttttataatagtttttaagttgtttttatgtttagcctcctaatttatctagaatttatttctgtacatagagagcggtaaagagctcctctgcaactctttcagataatccactgtccctcaaatcacttactgaaagcccatcctttccccactgatgttaagtgccaactttatcttatcctacgttgccatacatgcatgggctttcttctagactctattcaattccattgttctacttttctatttctgatcaataacacactattttaggcactctaactttcatatcttatgtttcgatatctgatagggttagtctcctcccccctaccaaagtttttctttttcaagttttgcctaatcttgtacaatttattttctagatgaatttgtcagttatcttcccaagtttcattttaagaaacccaaaaagaactgaatatataaattaggagagaactgacatagtattgatgtatagtatagtataatattaagctagttcatttaggaacataaaatgtctctaattattcaggaatcttttttttttattttgttttgagacagagtctcactctattacccaggctggagtgcagtggcaccatctcggcccactgcaacctctgcctcccacgttcaagcaattctcatgcttcaaccttccgagtagctgagaccacagatgcgtgccactacccctactgatttttgtatttttagcagtgatggggtttcaccgcattggccaggctggtctcaaactcctggcttcaagtgatctgcccacctcagcaccctaaagtgctgggattacaggcatgagccacagtgtccagcctattcaggaatctttcacgtctattagcgaagtgttatagctgcatatttcttcttcttcctttttttttttttttttttgagacggagtctcgctctgtcaccaggctggagggcagcggtgcgatctcagctcactgcagcctctgcctcccaggttcaagtgattctcctgcctcagcctcctgagtagctgggactacaggcgtgcgccaccatgcccagctaatttttgtatttttagtagagatggcgtatcaccatgttggccaggatgatctcgatctcttgacctcgtgatccgcctgccttggcctcccaaagtgctaggattgcaggcatgagccactgcacccggcccatatttctgctttattcataacaatgtatattactaataatgcatgttttaataccaaatttgatgacatatatgagcactatgttgggtaactggaaaataagacaaagaaacaacatggtagtacagtgggctttacagttagacatgaatttgagtactatgattgtaccatcctgggtaactacttaatctctctgaacctcagttttcctgagctcacaatgggaataataactataccaaagggttattgtaaagattaaaggaaagaatgcatcaaaactgactcacacagtgcttggcacatggctggtaatcttaaatggcaattgttatacagagaggcatctaagggatacagggtacttttcaaagcccaaacaaaagcttcctattttgaattggactatggctaaataaataaataggtaacagctgcactgaattacattccacagagaaagaatagccccatcacgtcctcaataagacatattctacattttattcacaattcaaataggaacaatgacaacaatgatgacaataataaagatatatttctgccactgtgcatatcaggtgggttagctcaccctgactctggaatgcctgtgtaggggtgaggtgggggctaatatactttgaacaggaaagaaccaagtataaggaacactgtctgagcagggacatggatagaccacatcaatggaaggcaggagacacaataaaaatagttcacaagagtgaacttcatttctgatatttcttccacgtgaagggccctgcactagcccaacaatcccagcttctttccttcctttcactaactagtgagctcaagttaaagacctaggaatgtacagcctaggctcctcctaagccctcactctctagagacttaactgcccacaggaaacctgcattctactttgttcatgcatccagtgctttataggtgcaactataccacccacagataaaccacactgcctagaatcagcttcatcaataatgaggcagtgatttggtttctcatttgtcttgctcctttgccttatttcttaatttgttcagaacttgcgcaaagaaggggatactatttattgaactttgtaaacagccaaaactataataaagagacctacaatggaataattgacttgatagagactcaatgagtgacattttaggatactttagtcagttgtaacacaacatctgcagatttacttttctttaaataaaccttgtttctgctatgcttttattggtatagtatccaatacagagaatttttttcagttttctcattgggacctgagcaaaaacaaaaacagttactatcccataaattatcctggaatgttttgttccacaggtgtcagagggccaagatggtaaaattctttgtatgaagcacagagttagataatataaagggtctgggcagagcataccatcctgcttaagcctatgactgctgcacgctaacaccctagaatcccaggtgcggccccaccataaagcctcctcctgaacagttctttaaaatcagtgcaggacttttcaaaatgcacatgtagtcttgtgttagagccaaatttatatcttatagtctaacactttatttgatgtttcaattatatacataaaaatatcatcaagatatgaagtcataccacaatcattactattttatttttatctactttttatcactaaaaatgctctaacatctgggatatttttcactttattttgaaactttaaacttacaggcaaaaagtgttatttataacagaatactttttttaattttaaaaaagtaacaatgtgactgatacagtcattcagaaaaggataaaagtaatcagacaaaccttagagacttaccaggtgtgttactgaactgcatgtttttaattctttcatttaataattgcttctcaggtaccagatagataagcttattctgatattccttataaaaagaaaaaatagtacctgattacaatgttataatattgtccaagagttttttttgaaaactttaaaacaggatttactcatctttgaaacttattttagaaataatacatagttgtaaactgcttacaacttatgaatcaactagaatggaattatgccaagaaatatttaagccaaaatcaattttgagtgactggctgaaattaaaaggcagtgaagaaagcctttgtaaatggggtgtgtctagaagcctacaattttcagcttactgatgaatgacagcagacctgcgctagatggtatgtgtaagcatgccatgatacttcaggatgaatatgtgtatatcaaagagggactaaaagctgggtgcggtggctcacacctgtaatctcagcactttgggaggccaaggcaggtggatcacttgaggtcaggagttcaagaccagcctggtcaacatggtgaaaccccgtctccacgaaaaacacaaaaattagccaggcgtggtggtgggtgcctgtaatcccagctactcagaaggctgaagcaggagaattgcttgagcctgggaggcagaagttgcagtgagctgaggtcatgccactgcactccagcctgggtgacagagggaggaaaaaataaaaaggactaaaaactaggaaagcaggtttaaatcagacagaaaatatttttggcttttgtttatctctcctgtaacaaagcaaaaagactgattaattgccagtccatgcagtaagagaaattgggtaagagaactctagagatgcagaatgcttccacagccccattctgcaaatagtaattattgaaccagaccctactgcacaagtaaggaagagaattaccaggaccccaagggacatattcaagttctcatcataattttaaaaagaataactttaagtcaaaatttcctaaaattagtagcaataaccttattttaatgtatgatatggtctgaatgttggtatgtccccaacattcatatgttggaacctaactcccaatgcagtactattaagaagtagggctttaggaggctccacactcatgaatgagatgactgtccttataaaggaagttgaagggactgccttaccctttctgcatgtgaagacgcagcaagaaggcactagttttaaaggagacagcaagccctcatcggacactgaatctgctaacaccttgatcttggacttctcagtctctagaactatgagtaataaatttctgttgtttataaattacccagtctaaggtcgtttgttatagcaagtaatgaattaagaatgcataaacattgttaaagagttaaaactcaaagtgataaatgtccacttacgtatatatattaagcaaaacttaaccagacgtctagcagagttttagtaggtctatggacttcctgatattgtatacaggattgcgtgtatttagatcacaagcctatcaaagactcaaggttattgacccccaaaacaaaactctattagaagaactgtttcgttttgttttgttttgagatggaatctcgctctatcatccatgctggagtacagtggtgcgatctgggttcactgcaacctctgcctcccggaatcaagcgattctcctgcctcagcctcccgagttgctgggattacaggcatgcgccaccatacccagctaatttttttgtatttttagtagagacggggttttgccctgctgactgggctggtctcgaactcctgacctcaggggatccacccgcctcagcctcccaaagtgctagcattacagccgtgagccaccgtgcccagcccagaagaactattaattgtacatgtttaagaacaatttagcagtgaaggacttacctgaagttcctgttgaagttgcttgatttccataatttccaagtcacactgcttatccagaacttccagctcagtcttttgagtttgctttttgagtcggacatcctgaagtctgcctgagatctgctgatgtttgccattctataggaagatcatataaatatatagtaacataaaatgctaatagaaaatgtttctacaaggagaataatatttttagttaaattttaaaatctcagttatcattcatattcatcctgaaacaaatgcctaaaaccaagtggaatgtgtttcagagttgtgtctgttaactcgagttattagtgggaaacacatcattctcagagtgcaagagcccatatgttagtatgggaaagcagaaacataacacattgaatttttttctgaattcagcattagacaatattaattaacaatattaatatcagagacactctcaaagaatgatgaagaggaataaatgtttgcatgtgatgctcggcattaccttctctgaacttctatttctaccctaaatatggccatctaatttcctctaattaaaacagtgcccaggaggaacgttttggcaacagttctgttctatactaatattcttctccttttttcctcttcttctgtgaagaaatcaaacaaatagcagagattctcaatgggacctaagaagaagggtgacatggggggttatgggctgaactgtgtcccccaaaattcatatgttaaagtcccaagccccagtacctcagaatgtgacaatatttggagacagggcctttaaagaggtgattaaggttaaacaaagtcatacaggtggaccctaatccaatctaactggtgtccttattagaggtggaaatctgaacacaaaaggcaccagagataaaatacactcagagaaaacaccatataaggacacaatgaaagatggccacctgcaagccaccaaaagaggcctcacaagaaactaagcctaactaaccttggtcttagatcttaggagctgtgaaaaaattaatttctgttgtttaagccacctagcctatcgtattttgttacagcagccctaccaaactaatacagtggagtgaggggaaatgacatcctgggttaaaacttactgatgatgaaaagttttactgaagactgtttcatatttgaaatacatacactgaaaggaacatgtgtatctctgctggagctcacattcttatcctcaacatgggatacgtataggctctggacctttccagactctgcacattcacctgtgttactgtgcttcatgtgttgcaccagttcttgagggaaaaacaatcaatcttaaggtctcttcccattatatatagtcaagatgatatatatatataaaaatagtgcaagagagttaaaagttttttacaactgttttgtagtactctggcatgattaatacttgtggtatgtatgtctatccatttgaaggaataaaataatatatttctgactaaagatattgtgatgattaaaaaaataatttttaatgtaattcaagtcatcaaccaaataaaatgttagactatgatcacacaagatctaaatctggctctactacatgactaggtatgcatttttgtaaaaccctactatatgatcagggtaggctcatgggattctagggttgtggcagaatagtgccagatcttttataccttctcaccacacatttcaaacaaagtcttttaacaacttgaccctctaacatctgattggtaaaaactgcttagtggccagtattagctaagaactacaatcctgcagaactggaactgtaagagatcatttaggtcagcagtttcaaatcagttgtctttttaatagtagaatctttttttttccaagcaaatcttgagtgaaaccccaagaaacataaagcacataaatgtcaagcttctctgttgtgaagcgtgggaagaattagggagagaaaatcactgttctgctgcccgagcttcccctctcctgcctctgcttagtcctcctcagaccatcttacagagaccaatctgaaaactgaaaatcactcaactaacacaactctttatttcagacaagggaaaagtgaggcacagagaagggaaatgtcttgcccaggagtacatggttcatcagtgtctgaactgatgctacaacataattctcagcattttgagtcattatccttttctcagtaaaccatattgtacagtctgtttatatgaaaatgtgactaatgacattaagacataactaattcacgagagattttaaaacacaattacatttttcttttttttttttttgagatggcgtctcactctgttacctaggctggagtgcagtggtgcgatcttggctcactgcaacctccacctcctgggttcaagtgattctcctgcctcagcctcccaagtagctaggattacaggcacccaccaccacccaccacggccagctaatttttgtttgtttgtttgagacggagtctcactctgttgcccaggctcgagtgcagtggcgcgatctcagctcactgcaacctccgcctcccaggttcaagcaattcttctgcctcagtgtcccaagtagctgggactacaggcgcacaccaccactcctggctaatttttgtatttttagtagagatggggtttcactatattggccaggctggtcttgaactcctgacctcgtgatccacccacctcagcctcccaaagcgttgggattacagtgagccaccatgcccagcccacagctggctaatttttttttttagtagagatggggtttcaccatgttggccaggctggtttcaaactcctgccccagttgatctgcctgccttggcctcccaaagtgctaggataacaggtgtgagccaccacgcctggcccacaattacatttttcaacaggtagctccatcatcattcagataaatttcacttaaacttcagccataccagtgcttccaactcaagatgaagattcttctttttagagtttaacctgacaatttcttcttgttctctattcttttgattgagaagctcctgtcgccgaattctctcccattctaagcgacgttgtcgttcaagttcctgttttgctgcctgaaaaaaaaaaggaattatacttaatttttaaatcaaaaattttgcacgattcaaaaactgggaagacaacaataaaagtcaggcagagtttagcacttagtggctttagtgcctaagggtagctaggcaaatctagttttattaatgggcttaaagacttccaagaaagtggcttcatctatcatattttctcatttcttcacgagatcttttttttttttttttttttccagacagcatcttgctctgtcacccaggctggagtgcagtggcaccaccttggctcactgcaacctccaccacctgggctcaagcgattctcctgcctcagccccaccaagtagctgggattacaggcacacaccaccacacacctggctaatttttgtactttttgtagagagagggtttcaccatgttgcccaggttggaagaccatccttttgttacagtcatttttctcttaataagttacagaatgacttcataaatataaatgttaacaggaataattttccctctattctggtatctgggggaaaaattctatttatattatttcagtgtgcaataacttcctgtgctccatccctggccctttaaaacacagccagtcctcctaaggacccttctttcccagcaacactatcccaaaggcctgtgcaagcccatcctcttgattcctctctagagagactttcaatgcccagctctcatctttctgtctctccaattccttggactcttaatctggatcttaaacttgctttcgtctaatgacttgctcagttgcctaactaaccttagctcctcactcaacttagctctgcagtcgatcctcctttgattgagatatcacctgcagaggatgctttctctaccacgtaccagttctgaaaactccttataagcaagaagcctctttccctcctcaagggaaggaatgatcagatttgtatagggtaagaatgaaatgatgcagagcaaaaggcaaaacaaaaattcaaaaataagcattttttaatcaaatgaaatatagtcacttattaaatgtaatgattttcttaagaagtaaaaaacttaaaaataacctctcgtctttctatgtcttttctcctttcttcctctcgttgtctctccaattcccgttgcttctctaagcgtttttctaattcaagttgtttcttccattcttgttcttgtaattctctctgttttcgttcccactcttccttttctttctgggctttacgttctgcctccctttgttgctgctccatcaaggcttggcgtcgcttttccagctccatgttccctcgctcatagttggctttccgtttgtcctcaaaagtaactgaacaaggtatgcctatcagcatccacacacattaacagcctacagaacctgtaatctagtttctatatacttatgccttgtgatcatttgagtgctatcagtatttgaatacttctcctaaggataattttaactcaaatctaagtggaaaaatatctactttcttcaaggatattcaattttagaaaaacaaatttttaagtttgaatccaatcaagagagaaataatttttataaacttgccaataaaaatactttttcggttgggtgtggtggctcatgcctgtaatcccaacactttgggaggccaaggtgggcggatcacctgaggtcagcagttcaagaccggcctggccaacacggtgaaaccccatctctactaaaaataccaaaaattagccaggcatagtggcaggcacctgtaatcccagctactcaggaggctgagacaggagaatcgcttgaacccaggaggcggaagttgcagtgagccgggattgtgctgttgcactccagcctgggcaacaaggaaaaaaaaaaaaaactttttcaacttttttctcttcttcaaggacaatcaaagctgtgtggttatacatttgttttgatgtcattaacatcctaatatattaaaacagctacaaatgtattctttcaaccaatatttaaatgtttttaaaggtaaagatttcattacaaagtttcctctaataactcagcctaaattaggagaaatactttaactcagatgtctataatcctgtcaaatacatctaactgtctcttcttccttcacactcttctcattttgaccatcttaattttatcaataccaaaatacatcccatctatcaaatagttttttctcatatagcacatcaaatattaaaaatataaaaattctaaatattccattacatttaaaggtagaatttaaaagaactcagtataaatatacaactttgacactcagtgatacctggtaatttcttctgaggctcctcttcttgcattttctgatatgaaggcagagttccattaatggaatcaatttgctttcctcctctaaaaaaatcaaacaacaaagttagcatcatgtagtctggacattttcagactagattacacagactaccagtgattatggcaatttgatattgggaatacagtattaaagatatttaaaacagtttggtatgtcgttacaaaatacagtagtatatggatattcaagacagagaaatctggattcaaatcacagttcagctaattttggttcttgggcaagtttttctttatctctttagtcattagcctccttatgtataacataatgaaaacacatccacttctttttttttttttttttgaggcagggtcttgctctgctgcccaggctagagtgctgtggcataatcacaacttactgtagccttgaacttctatgctccagtgatcctcctgccccagcttccagagtacctaggactacaggcgcacaccaccacacctggctaattatttttatttttgtagatacggggtctcactatgttgtccacgctggtcctgaactcccggcctcatgtgatcctcccaccttggctcccagtgttatgattacaggcgtaagctgccacgcctggcccacacctacttctaatatgtacccttttcaagtataacttgttgaatactaaaatcaatggcagtgcaaatatttaactctcttctaaatcacatctgccaagttatcaaaaccatagttctccacctccaggcacactcacctgaaagatggaggaacaagctcaggaggtaaagtcagtggtaatggctgtccagctttggccatgtcagtaaggtgcattgcaagaataaactcttctgcttttagctgtccatcaccatcaacgtcagccagagtcctaaagaaaatgttaaaattcacaacttaataaagtctatttggagtaaaatattgccttaaaagttcaatttttattttacttttatttatttatttatttatttatttatttgagatggagtctagctctgtcgctcaacctggagtgcagtggcgcgatctcagctcactgcaagctccgcctcccgggttcacgccattctcctgcctcagtctcccgagtagctgggactacaggcgcccgccaccacgcctggctaattttttgtatttttagtagagacggggtttcaccgtgttagccaggatggtctcgatctcctgacctcgtgatccgcccgcctcagcctcccaaagtgctgagattacaggcgtgagccacctgggcccggccaattttttatttttaaaagaaggataatgatggtaaaactgctgggtacacttattttagtgaaatgtaaatacgtacatttacgtaactcactattgaatgtaagtatgtaagtatgtacttcaatagtgaattaattttttaccgttgattttcaagacataaaagagagggaagaaactttgaaacagaaagagaagtaactaccccttctgagaaagtggcttgtcttactccatggttaattcacctaccaaatcacatttacctatattaaaaacaagatattctctgattctccatagaagggattagatgaaagaaaacaacagtttttctagtaaaatatagtcatgaactgcataatgacatatcagtcaacaatggactgcatttataatggtggtcccataagattataatggagctgaaaaattcctaccacctaaggacactgtagctgtcataaagcaacgcattacctatgtgtctgtggtgatgctagtctgaacaaacatactgcactgccagctgtagaaaagtacagcatatacaattatctacagtacatacactcaataacaataaacatctgttaatatattactggattatgtatttactatactttatttttattgttattttagagtatactccttctacttacagaaaaaaaaaagttaactgtaagacagcctcaggcaggtcagtcaggagaaattccagaaggcattgttatcataggagacaatggctccatgcgtgttattgccccgaacaccttccagtgagacaagatgtggaggtagaagatagtgatactgatgatcttgaccctctacaggcctaagctaatgggtgtctttgtgtctcagtttttaccgaaagtttaaatagtaaaaataaattttaaaaacaagaaagagcttaaagaataggatataaatatctttctgtacaatgtgtttgtgttttaagctaagtgttattacaagagtcaaaaagttttaaaaaattaaaaggtttacaaagttaaaaagttattgtatgccaagattaatctattgttgaagaaaatattttttgtaaatttggtgtagcttaagggtacaacaacattctgcacaattacatttgcctccaagcttaatactaactttcaaatggctgcttttatagagcatctctgagtcacaaacttttacagaaacagtatctttcttgtaataggggagagagagtttaattaattaatgcatagttaaattaatcaaatgtaattaagggacaaacttaccaaatagtagccagctgagtttgagaaagatttgactgaagaagggcatttctagcttgaaaacctgattaagtggggaaaatcataaaggaattctttagcatctttaaagttatgcataacaaattagctgtatctgtaaaataacaatgctaccagggtatcctgggaacttttaacatcaaaatgtttttaccacgtgctaggtgctaagcattcagtagcaattaaacccagtcactgccccaaggaattttaaatctagaattagcagtatcaagtgctgtcccctgtcttttcagcaagataataatacacacaagtggctaacgtgaaagaacaagatatcaggcacacagagtatcagaggccaagactgtgggccctcttgtactcccagcaggtgcagcacttcccactcctacgtgactgagccgtgagtagcagaagagtcaggcgctactctgggttcagcctgagtcaaggcctgtccaaaacaactcttacacaagagattacatctgccaacactgcctcagcaacagctccaactacaacaaaagccagccaaatgcagctagatttattgtcccactaggctttcaacataggacttgataatcaaagcaaccatgtattacaacatgcagctaaatgtttatattttataacttttaaaatattttcattctatttttttaatctggacatttaacataaatcacataaaaacactggaaattaaactcacagcctcgccctattaattactcctcagatttcacttaggaaatttgatttgaggaggtctttgtgttaaaaggaagattcttctaaataagagagatggaaggctatttcaaacctgaaaaaaagttcaaaactactatttcagcttttggaccgaaaaaagatccttttggactgaaagaagatcccttagcatcaggcaatagagcaaacagaagagagaaggaggaggaatgtaaatggttaaaaatcatactcgtggagggctttatatgtgtgaggcaaagtctgagtaatacaaagggccatagagagccaacagagtatcttacttactaagtaaaactcatttgaacatgtatgtacactcttagtcggccaagcctctggatatcctatatcctctgcttagaatgccagaccctcaattctttactttgtagtctatcctctgaaatctggctctaatctcttttcttctgtgaaacattctctcttatatccttggagttagtcactttctcatctatattaatcacagcacttttaaacaagtaaccaaacaccttgattacatgagctcttcattatatgggctcttcaaagatatgaaccatgtcttgcccctgtctgtattcctgtgcctaagagagtgcccagaaagtatgtgattcaggaaacagttacatcaatgacttgatctaaataaatttttaaaaactatgtttagggggaggagaagagaagtaaaaaagggaaaaacagaccagtggacaggcgcggtagctcacgtctgtaatcccagaactttgggagaccaaggcgggcggatcacctgaggttgggagttcgagaccagcctggccaacatggcaaaacctgtctctactaagaaaaattagctgggcgtggtggcgtgtgcctgtaggaggcaggagaatcgctggaacccggggaggcagaggctgcagtgggccaagatcgcaccactgcactccagcctgggcaacagagcaagactctgtctcaaaaaaaaaaaaaaaaaaaaaaaaaggatcaccaactcctacacttattgaacaaaacaaacatataagtccaggttagcctcatcctcatgttcttggggctcatgctcagcttaaggacaccagcagcaactactctttttatagaaaaccttgtctttacctacagatatatagctttacccttgtaggtctcagaataataatgacattccctaaaaaacaccataatacacaaccttcgtacaatgtgacatatactaatgaagtaacattagggatcacttccccacagttggctccccattcactgcccttcatattccaatgcaaaatcacctctgtttatactgttatagttacagtacttatacaaagcgtactactcttaagtgtgctgcctaataattttttcttttttgagacgtagtctagttctgtcacccaggctggagtgcagtggcatgatctcagctcactgcaacctctgcctcccaggcacaaataattctgttgcctcagactccagagtagctaggattacaggcgtccaccaccacgcctggttaatttttatatttttagtagcgatggggtttcaccatgttgaccaggctggtctcaaactcctgacctcaagtgatccgcccgcctcagcctcccaaaatgttggaattacaggtgtgagccactgcacccggcctgcctaatgaatttttacacaggtatgcacatacacacctgtatcaagatgcagaatgtttccagcaactcagaaggtttgcacatggccccttccccacacagtaaccacattattctgatttctatcaccattaattaggtttcctgttcttcagcctcatataaatgggttaaatggtatggtccttttgggctgctttcattcaataccatacctgtgaaagtcattcatgttgttgcaggtatcagcagttcatttggttttatcgctttaaagtattctgttatgtaaatatactgtcatttatctattctcctgtcgatgaacatttaggttgtgaacatttttgtaaatgtctttttcatcaacttttgttcagttgaaaacaaataacttctttttattagagagatggggtctcactatgttgcccaggctggactcttgggctcaagcaatcctcttgccacatcctcccaagtagttgggactataggcacatgccgctatgcctagcaaagataaactttttttttttttttgagacagagtctcgttctgttgccaggctggagtgcactggcgcaatctcggctcactgcaacctccgcctcctaggttcaagcaattctcctgcctcagcctccagagtagctgggactacaggtgtgcaccaccatgcccagctaatttttgtatttttagtagagacggggtttcaccatgttggccaggatggtctcgatctcttgacctcatgatctgtctgccccagcctcccaaagtgctgggattacaggcgtgagccaccgcacctggccaaaattaactttttaaatgcaaaatgtagggtacaaagaagttaattttttcaaagaataggaattatgactttatattaatctccagtatggttcaataccatatttcacagaatctaaaattccactggctataagacatactattattttatgaataagaaagaaagcactgctaataaaactatgacacagtgctaagacatcactaattgtagcacacatcctaattttagagacattaaaatgtaaaaaaaaaaaagtgtcaaaaaagcataccttgtttcatgcaatttgataaaattacagaaaatcttagttatgtaatatgaaatacatgtaaaaatacaaagtatatatgtaagctaagaagtataataggtcacccgtgaacctaccacccatcttaagaactagattactactaaatgccttgaatctatccgtgttccttgacttatccccatgcttccacaagaggtaaccactatcctgaattttgtatgcataattcccttgctttaaaaaatagttatcacataggtatgtatctttaaataaaatactgtatatttttgcttgtccaatcgattccaaaagtcttactgctcgttcccttgcctctctgcataactacagaccctggactcctatttcacagactacttttcattctccaaataggccatgtattttttgctcttaatttctcctttgtcaccatcaaatgcccccacgttcaatctctgtcgaaatcctaactttttcatggagcttaaatgctcccttcctaaaagatacctcatctgaactcttcagcttcaatatatctcattctatgttccttagcacttaaagctctattatttttaaacacttattttactcggtcctaaatcataatttcttgctgagtgaagagggagtgggaaagttagaaggtgggaactctacttgcctattaccctctgtttatgtctcctttgctgttctcaattagtacagttcagatgatgttctggcctggactcaaatgttttacagtgaactaaggccaagttttacagtcacatttgggttagagcattaaagggtgagcaatgctcacttgaggttatataaacagagaaaaagcccaatgcagaggaggattctcaggaaaagtgagctgaggctaagttccacacactctctcttgtgacccgtggctctccattcactgcaaagcttagaggatgaggtctgatcttaagggacaggtcttttgccaaaaagttgggggtatatctggtgcccgacttgacagtaagaactttgaagaaagcaatcaagttgaatccatctttgaatccttatacaacttcaggtatttgtatttatcaaatgcctgctaaattttttggatgttaaaatgtcagatgagctacacaatacaaattcaaatgacagttcttcagtggaagtccacataaaagaccctttttcatgctcttcagcactgtatgctgcttacctgagagatatccactcatacttttgtcaagagtattaaatttttgccgatattttaatcttgtaggctgaggaactgcccactctgaggtcccagtcttgggtgagttccctgagagtgaagcagtcgaggaagttgagctataaaaaaatttatttaaaatttttatgttactaaataaaatatatttaattaaattttataagaccaaggcattaagaatcttatataccaggggtcctgaacccccgggccaccgacctgttaggaaccgggctggacagcggggctcggtgagtggcaggtgagtgagcactactacctgagctccagctcctgtccagtgagcagtggcattagattctcataagagtgcaaaccctattgtgaatggcacatgtgagggacctaggttggatgctccctttgagaatctaatgcctgatgatctgagatgtaacagtttcatcctaaaaccattgcttcaagtctgtgaaaaaactgtcttctatgaaaccagtccctggtaccaaaaaggttgaggatcgctgttacatactataatggtgactgccttttctctttttctggggaggagacagagtctcgctctgttgccagcctggagtgcagtggcacaatcctggatcactgcaacctccacctcccgggttcaagcaattctcctgcctcagcctctcaagtagctgggactacagtcacatgccaccacgcccggctaatttttttgtgcgcatttttagtagagacagggtttcaccatgttgccccaggctggtctcgaactcctgagctcaggcaatccgcccacctcagcctcccaaagtgctgggattacaggcgtgagccactgtgcctggccaatggtgactgcttttgcattttacatttttttaaattttaagcaattatcactattcttagtaaagcaaagaccataagaagtatagaactccatgagactaccgcatataaagaacctgctctgtgccagaccttatattgtactaaggcctttacaaatatttctaatcctcccaacaaacttaaaaaatactacagtccccatcttttagatgggtaaactatggctcagcgatgttaagaaaaaacaaggccacagaatcagtgagtgttcaagctaggatatgaatgttgttcttctgggtcaaatctaacactctccgtacactaccctgaagagtataatagtgatttatatgaagggtgattaatgtaatgaatactgatgcatttgtgctttgtaaaatttaaaagatatccaattagtagaatctgctcaagaaagaaattaacaatgtacaatgagtatgagacatcttgggaaatatacacattttttaaaggaaaagtacacagctttaggcaaagaaaaaattaaaatatagaatatttttagtttacatgaattattttttcaaaagtaaaatgccacagacacttaataattctaaaaataaaaaatttattttatgtgagttgtaagtagtaaatttaccttaagtatttgtacttggccattataaagtaaaacttaggtaagctcaaagctttaaaaaaatcatttgttaaataaagacttcttactgaaagcataaaaagttgtcagagttagctattcatacctactagatcctaaatcaatcagagactgcgctttctgtatactagcacctccaaatcctcccatcatcagactataagatgacccatgaggcaatgctaaaaaagaaaaagaaggaaaagtatgaaagaaatttgtatctgttcaaacacaaatagtttctttctttacatgaaataatgactctttagaaacaaagtactcacttgaagaagaataaggaatgggtaaaggctgaatgagactggcggttccatttggtaatgatgatgtgctaacagaaggcactaggggagtgggcatcattaagggaggaaggttggtccctgaagtcgcagaagacaatgatgttataggtgcagctggaggcaatggctgaggaatggacagattgggcatgcttcccattcctaaagtcaaaagaaaacattttttccagtgctagaaaatcaattataaaacacatgcaaaaaacaagtttacagtacagtgggcagactctatgtttaccaaaacacacagatgaattatccttaaaaaactcactactttgacccagcagtgagggaggtaaactgctgctcttaatactaatactctgatctgtatgaactaagaaaacacctagcaaagagttaaatattctcctctctcatcatgaataaaactaagcagccttttccaattgaatatgagtctcctcaaggaaagaatacattaccagatcaaatgaggtttttgtgaaaggataatacagtgctactaagttacttgactaatacacacacacacacacacacacacattcttcttctctctctctctcacatactccccccaaacaaaaaggttctaagtagtagatactttatgagatccatttatgcatatgcattatttgcaagaaagtgtgtcacatattttacttttcttgtaagtaacattcctatgaattcaaggacgagttcttaaaaggaacaaagtgatgacttttattcatttattaactgcagaatacttataaatatggtcacacaatgatttagtatttatctttagaattcactaaaatagtgaaataattttgtggagtctgttgtttgtttgagatgggggtctcactatgttgccccgactagaatgaagtggctattcacaggtgcgatcatagcacagtacaacctcaaactcctggactcaagcaatcctacccatagcctcccaagcagccagaactacaggcacacacccctataaccagctctagaattctatattctaagatctgtagtgaaggaacatgtttcagatacatagacatacctaattgaatgttccattcaaaatgagtgcttctcacatataattataagaaattgcctgatcaaaattaacagaaaacataccaaccggttatcgctgatgaatacgtgaacttattagcccaaagtctgcaacttttggccctaaatttagctggctaattaacctttaaaaaaattcaacttacataaaattttaaattatctcccaaatcgaaccatttcaagtgagtttaaaactgctcaaaattttttctgtattactcacatatatatagagagagaggaaactaagaatagtatttgggattggctatacctagggagaccatataattcatcacgcaactaggagttgtaaaaggagacactaactggaccagatgccaggacaaaaggcataaatcagaactgtccctagaaaaccagaacacatggatcccctacctgtgacagtgaatttaatatttattatctctaacatgaaaattaacttggaatctggggactgtcattttgtgctaacaaatccttttctaatactcaaatatgcctagggataaagtttaagtagcaaatacaggtatttaaattaatacatacttaccaaaacgagcagaaattaatggagaaaacatagggggttgcttcataataggagggagaaccacaggcaactgttggccttgaagcttcagtttgatgagtttcatagctatggagaactcttgctgatccatcttcccatccttgtttaggtctgataaagccctaaaaggagcatgaggtaggtagattgctatgtggtgtggtggtgggaaaactaacgttattttggggattgacaaagtaaaaatgatgatatggcattcacgtgtacatcatcactaaatttaaaatatctaacatgtaaaatatataataacaaaaagataaaacctacactttaagaaatactgaccagagataataactaataaaacactgcctgtcaaaacagaatctagagacctttgggctgaattccaccagtttaggtagaaaaaaattcaagattataatacttctaaatttaatttattcatctgtccaaatatttactgaatacttgctatgtgcctcgtactctaccaggcatgagaatattccaagtggaaagatgggacaggggttgttacttattgtaaacgtttttaaaaaaacagatattatagagaatagtttctttaaagaaggagcaggggaagcgaggactaatttggggtttatagattatgaaataaatgaaactacaaaataacagaaagaggattttgagattctgccaaattataaggaaatttttctcaatgataatgtatatatctttccttagaaaattctaatgaaattagaaatttgtcctagagaactaaacctgaattattttcaataatttgctcaataaaatttattttccaaaaaactgaagaaataccttttttttttttttttttctaaagagagtctcattctgtcatccaggctagggtgcagtgacacaatcatagttcactgcagcactgaattcctgggctcaagcaatccttccatcttggcctccctgagtagctgggactagaggtgtggccaccacacccagctaattttttttttaattttctgtagagacagggttctcactatgttgcccagcctggcctcaagcaatcctcctacctcagactcccaaagtgctggcagaaatattcttaataaccaatagaatgcaactaaaaacaattttatgttaacactatattacaaaaaaacaaaatactatcagaaaattaggttcatctacaaaacactttaccatatttcagctaaaacaggggccggcagacctgattgtaggaaaaaattacgtgcttgatcacctggaggtaataaaaacaaaacccaagcagcacattagtaaatgaaattattccaatgcttctgaataataatgggtatatgttaatgatttattataattttaataccaatcattaaagaataagtgaaatagaaacacataaaaattatttacataactttaataagacagatattttaaaacaaaagtcacatctgcacttctattgtatattaatcagtgatgaaagatgattcatctcagtttttccacaattggggtcttccttaaaaatacttccacttagtaaaatttatatttaaaaacactattccctaaaagagtttcaatataaaaagtaccaggtgttaggagagagagtcctccatgagtttcttcacactcctatgtgtcttgctctgtataccaataatgtaagaccctaattgctctctgcctgggtcacttctcagaattgggtttgtaatgagcaatcttaacgaatccggtaacgtttcccactgagacaagggacaaacttgctttactgcttgctacaaaagggtgggttccccaaattcagtgttcctctcctgtaacacaatcatagcatgtgtactattctcctgggctctctgcattgtctctgtgggacttagggaacactaaaggaaacagaaagatagatgccaatgctcattttgctagttatgctgttagtcataaggttctttgtctctgactcaggaatcttgggtcttccacccgtaatggacaaagttattaacctgtaagcagggtaatcaaatcctgataccaggtaaggtaattactatcatagcagtacaaataacatggttaagtagatggattccaaaatcagcccaaatggtttcaaagcccagattaacactaaccatctttgtaaccttaggcagttacataacgtctcttagtctcagtttcactatttgtaaatatagacaacaacagtgcctactttacagggttgttgtaaaggttaaataaaataatgcacttagcatagcatctggtatatagtaaaaattcaataaatatcattgttctcatagttactattattgtatgtaaagcactaagctactttggcacagaaaaaagtttaattaatagaaaaaaatttcaaaggcacacctaaattaatcccattttggctctggtggtctttctgcaaaacaagggctagcatcaacaatcagtgcttggtgtagcctcaaagacagagggctagcattaggaaaacagattccagaaaaaaaaagtctagattttccatgaaatgaatctaagaaataaactgaaaactttctagatataatgttaaaatgtgaaaccagacaattacacagaaattcttgactatcatttaggattcaggaaaaatcttccatatcccaaatttaaaacaacaaattaagacagttccaggaaaaataaagttagcatttctttaatttctagaattctgattgatatgaattttatcgtttattaacacaaatttgatggcagtcaaattaaaactaattcttagatatcacataaggaccataattcactaataaaactaattataaatacaaacctgttatgtaacctcctgaaggtttgaggttatcaaactgcctgtcatgcttagtacgttcttcagaggtaatagcccacatgtttggccctcctgaaacataagtggaagaaactatagtgtatacatgagaatgcttaaaatacaattctaaaatgtaaatagaaatcacaagtgttcattgtatgacagtatttaatatttgagtgacacaaagagtagagctctatcataaccatacatagcacagccctaaggcttttcactcattggctcaattaacgtctattgaacaagtgctatatcacactcactggaaatgggcatcaagctaaatactggcaataaaaagatgaagaaaatattcccaccctcaaggaattcatgctctagaaaacaacagtacttacagtattcacctgtgaaaaatcctaagcagaactatatactgccatagtttagccctgtgtccccaccagaacctcatttcgaactgtaatccccacgtgtcagaggaggggcctggtgggagatgactggatcatgggagttgatttctcccttgttgtttttgtgataatgagtgagttcctcacaatagctgatggttttaaagtgtggcacttccccccttgctgcttctctctctcctgctgccacgttaagatgtgctttgcatccccttcgccttacaccttaagtttcctgaggcctctccagccatgtggaactgtgagtcaattaaaccctttttttcataaattactcagtctcagctagttctttatagcagtgtgaaaacagactaatacagataccaaaacagctgtgccaattctgagttagaagcaccaaggatgagataacaggaaaggtaacactgaggcagagccttgaagcttggtttgaattttgccacgtgaagaggagggataagaacatttcacaccataagggcacagcatgagaagtcaaggcatgtgcaaggtgctgttaagtgcactgagcagactaataactagagttagtaataataaacaggtagggtggaattaactgtaaaaaggtcttaaataccatcctcaagagcctgaccccataccctggaagttatagagagccatctagtagtttttattattttattatttatttatttatttattttgagacaaagtcttgctctgtcaccaggctggagagcagcagagtgatctcggctcactgcagcctccgcctcctgggttcaagcaattctcctgcctcagcctcccaagtagctgggactacaggcatgcgccaccacacacccggctaatttttgtattattagtagagacagggtttcaccatgttggccaggatggtcttgatctcctgacctcatgatccacccacctcggcctcccaaagtgctgggattacaggcgtaagccaccacgcccagacagtttttaaataagcttttaatttggaataattttagatttacagaaaattcacaaagatagtacatggctcctatatacctttcacccaatttctactatgttaacaactgacacaaccatagtacatttgtcaaaacaaagacattaacagtctggtatataactactggctaaattaatacctccacctgcagtggtggctggtaaactccaacagaattaaactctgggtagtgaagacagcacaaggcactgtgactgatgattctgcccatcggagcctctagcaaaaggaagtagccttcacctagagataatccttgggatcagaaagcttgacccacgaaggcctagtgattctctagcctgatagtcccattttggggagggtcaacttgaattccacaaggtgggaataacctgaaaagccttgtttgtcaaatagaaatggtatatcaaagaagatatagacactggccccaacagtattttggctttacgttaaaaagtggcagtggccgggcgcggtggctcacgcctgtaatcccagcactttgggaggccgaggcgggcggatcacctgaggtcaggagttcaagaccaacctggtcaacatggcgaaacctcatctctactaaaaatacaaaacaaattagctgggtgtgatggtgggtgcctgtagtcccagctactcaggaggctgaggcaagaggatcatttgaacccgggaggtggaggttgcagtgagctgagatcacgccatagcactccagcctgcgccgacaagggcaagacgcaatctcaaaaaaaaaaaaaaagcggcaactatccctctgagggaaacctttatgcacattccactgcttatagtaaagctactggatcaatgaaggctcagatcagagaagctgcaagttgctggtgttcactgggctgcagtggctattcagcctcagaggcagctatgctgaactgaaaggagacatgggcagaacctggattcttgggctgctgccaatgacccagctgtttggtttgccacttggaaaattacagattgacagattaaagacaccctcctggggctacaaattgaaaacaaatctcaactgctaattgaattgtctgtgtcacctatgtagacacctacagtatgggcccagcctctgatttagactgaaatcaagtatgactaatgtgcagaggataccactgcatgccaaactgtgacttggggatggtgggggaggtctcattgcaggtggcattgttccctttgactcctggcagactgactatattggacctttgttccctctctcaggctatcagtggtgcctcaaactattgacagtatttttttgtttttcacatagactttttagagcagttttaggttcacggcaagattgagcagaaggtacaaacatttctcctataccttccaccccactgacacatagtccctcccattaaaacattcccctgttgacacttttttaggttaccaatcagcccacgatgcccacactgtcatggcccttgaaactaatctgtgtcatgtttcttttttaaaaaatttagagacagggtctcactctgttgcccaggctggagtacagagtgacccttggctcactgcagccttgacatcccaggctcaagtgattctcccacctcagccgcctgagtagctgggactacaggtacgtgcgactacagctggctaatttttgtattttttgtagagacggggtctcactatgctgccaaggctggtctcgaactcctgggctcaagtgatcctcctgccttgacctcccataatctgtgtcatgtttttggttttctggaccatatgcattctgacatggatgcacttttatcataaaagccattcaacaatgcactgacagcctgactctatttccatcacctcctcctggtccacatactttaaagtaagatagtgtggtcactgactgtagctgtctccagaaaggattcattgcttattagctgcttcctccctaatgatcagggctaaagggtggggtatcacaggagatatacagacctattgtgaaaattcaggattctactctgaccactcctggacatgatgcatctttctagcccctaacagcaactgtaggcaggcttggttcataaaccctccagctgggccactgaggtaaaaggggatctagagcaggaattcccaacccccaggccacggactggcactggtctgtggcctgttaggaacctggccgcacagaaggtgagcggtgggcaagtgagcactaccacctgagcggcacctcctgtcagatcagtggcagcattagattctcataggagcacaaaccctattgtgaactgtgtgtgtgagggatctgggttgcatgctccttatgagaatctaatgcctgatgatctgcagtggagcagtttcatcctaaaaccaaccccctcccaccaccctaccacaaatctgtggaaaaattgtcttccatgaaactggtccctggtgccaaaaaggttggggaccagtgatctagaggattcaaagttaattctggttagggtttatgaaaatgtccctcttacatctaactcttctggatcactaggaaatggtaaagttatggctctgaaatgagaaacccaggtttaatggcagtagagcaacaagaaggcacctgaggaagaaacgccttagaccccaggaggtatggtattaagagaggaattaatgatattttctcttgtagaactgcccctgtagccttcttctgcaagaaaaatgccttggtatggctctcctaaattgttggaagcaccttatgagtctgccatcccccatcaggagccttatcaagagtctatcaggaacatcaggaatgaccccagaaaatgtatctcctgtccatatcacttccagaggtcttcccccacccccaatctcagtaatggatgaattccacccagctggtggcgaggacaaacaaaacaagtgggactaatttgggcaatccctccaaaaacaaggactagactcaattactcaaactccactggaaaccctcagacttgccagtcatccaggaggctatgttagaggcactatcaacctgtgcccctcttctgatgtaggtcccacggcagtaggggttgcagggggaataactgtaaacattttctttccaagcataacccatgcacacccttgatcttctacttcttctgtggaaaccatgcattaacttgcctccctccaaaaacacagtaatgtacatgaagagatcttcaagtgtttaaaaaaacacttcctcagtcctggaaggcattcaggtcagcctcaactcactggctagggttgtcagagatttatcctagattttctttttttgcaggctaagataaagtgtgtgcaattatgaatacactctgctgtacccagattactgattcaggccaggtagaaaagttaaaataaaacttaaggagaggccggacatggtggtgcacacctaatcccagtattttgggaggctgaggcaggaggatcccttgagctcaggagtttgagaccagcctgggcaacatagtgagaccccatctctacaaaaaaacttaaaaaaattagccaggctgggcgcggtggctcacgcctgtaatcccagcactttgggaggccgaggagggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaattagccagtggtggtggctcacacctgtaatcccagctacttgggaggctgaggtagaaggattgcttgagcccaggagatcaaggctgcagggagcactgatcacaccactgtctgggttacagaacaagaccctgtctcaacaaaaaacaaacaacaacaacaaccaccaaaaaaaaaaaaaacaaaaaaacattgttttttaaggagaaagccacctggctttctaagggagacactgatgatttataggatttgtttagctgggaccctgcagagcacagctgagaacactgcaagctgagaccaacctgctgcttggagtcctgttgattagtcttaatcaaatgctgcataaaataaatcagacttagtcccagcccgttttgtcagattaatcggagtggccaacttagtggtatgtacactcatgagaaaatttgctagaagtcaagacaatggagaaacaagggagaggaacccttgggagacaattctccatgagtttctcatgtttctgtacatcttctaaagcaaaggattgatagcttttgttccagactatctctgaggatgtctgcattgcaaatacaggggtttcttcccgagcttgggattagctttttgttgtccgccagctctctgaggtttttgtaaagctctgcacattcaacatgactaatcaccatctatacttctgactacctttacaatttattccatttctgccaataaggaatcaaatacgtttaggtatataaactcatacataattcctgcttgtattgtataaaaatctgccttacaaagacaattttccaggaacgtatatcattgaaaagtaggtgctcactgtaatttttaacactaatatggatttaacaaattattcttagtcctaaatgactggattaaaaaatctataaatatcctctcttaaagagaagttttaagattatagttaaaaataaagaaacagatgtactgaagaactaaggacctaaaatagctaaacctacacactttctaaataaagaaataccacatatgtagtaaaaatcctacttgggttatcagtttatcagaaaataaataaataaacctgtcaggattcctgtcactaggaaggcaagtagtatagccacagaactgattttctattatatgacttcagaaaaattatgatgctgattttaaaaacaacaaaaatgacaacaacaaaggatgacaaagatggaagcagctcacctttattgaaccctgactattgtcagggactttatatgcagcaactcactgagcccccagcattaacctataaattaaagtactattattattctcattttataggtaaggaaactgaaaacccatggtaataaagtaacttgctcaaggtcatacagtaagtgacagagctgagattagaacctgggtagcctgactccaaagcctccatattgaactcagcactaactatgtaccaacatatatgggtaagatgctcatgttccttctaattcagatgccacctctataaactaggaatattatataactccacaggcctgttgtaaagattacatgtaatatacctccattatagctaacacttaatgaaactcaccctgtgtcaggtacttttctaagagctttacatgtattgcttcaagtaagtctcataagaatcccatgaggtaactattgctatcactgtttatcagagaaggaaacagtggtacagagatattaaataatttgcccaaggtaataaaattggtaagtgttgaaggcaagactagcgtctactcaggcttaattaagagtcttaaactatctgtcttgttggtaattaaacataaatacactcacaaatatattgtccattgatttccaacaacatgtggagataattcaaggtggaaaacagtcctttcatcaaatggtgctgaaagaactggatatccatatgaaaaaacaacaaaagaacctcaaccttccagcatatacatgaattaactctcaatgaatcacagaactagatataagataaaacttcctgaagaaaatatggaagaaaatgtttgtgattttggattatgcaatgactttttggaacacaaaaggcaaaaatcattaaaatattttgacaaactggactttataaaaatctaaaatttccactctcttaaaggacactcttaagaaaaggaaaagacaaactacaggctgagagaaaacatttgcaaaacatattcaataaatataggtcagcatatatacagaactattcaactcaaaaattagaaaataatcccccccctcaaaaaaaaggaacaaaagatttgaacagacacatcaaagatatacagatggcaaataagcacgtgacaagatgctcaatatcactatcatcagggaaatgtaaattaaaatcacaaaaaggtatcactgcatgtctattagcatgtctgaaaattaaaaaaaaaaacaacacggagtgctgataaagatgccaaacaaccgcaactcatatatgctggtgggaaagcaaatgtgacagtcactttggaaaacagtttgggaatttcttatgaagttaaatatatatttccacatgacccaacaatagactgagtattaacaaaagactcttgggtaaatacccaagagaaacgaagacctatttccacataaaaacctgttctctgatggttatagcagatttagtcataatcactaaaacctggaaataacccaaatgttctgcacctgaacggctgaatggataaataaattgtggtacacatttatacaatggactactattcagcagtaaacaggagaaatgcatgcaacattatgactgaatcacaaagatattttgctaagtcacagaagccagacaccaaaggctacatattgtgtattccatttatatgacattctggaaaaggcagaactgtaaggacagaaatctgattagtggttgccaataatacatggctaaaggtggaggtataagggtacagagaactttttaggtgatgcaaatgttttatatcctaatttatatgactatatatagttttagaaactcatcgaaccgtatactttaaaagggtgaattatacccccaataaacccaactttaaaataaactaaaacaaaaatataaagcatctaatacatgcctgccatattaggagtcctcaataaattagtttccttattcaacccaatcccagggaacaatataattaaaaagaagtcagagcattcaaatctttctcagggaatagcctgaaactaaggctctttagttagaaaccttaagactattttaagtctgaagagtttggttaagaaggcttaaaagctgctcggccaggcatggtggctcacacctgtaatcccagcactttgggaggccaaggcgggtggatcacgaggtcaggagatggagaccatcctggctaacgtggtgaaaccccatctctactaaaaatacaaaaacttagctaggcgtggtggtgagcgcctgtagtcccagctactcgggaggctgaggcaggagaacggcgtgaacccagtaggcggagcttgcagtgagcagagatcatgccactgcactccagcctgggagacagagcgagactccgtctcaaaaaaattaaattaaattaaattaaattaaattttttttaaaaagctgctctaacatacatgggtatatatacccccgggcagtgatggactctactgctatcctaagacaaaagagagttctgctgcatcaagattgatgcaccaatgctcatcacagtatgatgctttcttatatatattactatctcctgacatttccttggctatgtgttttcacaggggctaaactcaacccatctgtttgtttactgcttagttcctcatgtctccaatcagtaatcttgacaccttcatattcattcattcagtaaatgtttatggggtacaaagatgaataaaatgaaccacttgcctgggcacagcccagcacttcagaaggctagggcaggaggatcacttgagcccaggagttgagaccagcctggtcaacatagtgagacccctatctctaaaaaaaaaattcttttaagtagctggtcttggtggcacatgtctgtagtcccagttactctggaggctgaggcagaaggaattgcttgagcctggaggttgagattgcagtgagcaatgttcatgccactgtactccaggctgggttgacagagtaagaccctgtctcaaaaaaaaaaaaaaaaaaaaaaaaaatgaacaccttaaaagaactcacagactctaatattttaaagagactctaccagccaagaaaatcacacacaacaatcacggttacatattatcatgattaatgtaaccaagagaataaaaatgttctaaggcattttaacaaggaataatttttaagtagtgttcaaataaccttttaaaaaattaatcatattaaaacataaagtattaatgcaccaagaattttctaggaacaaaaagataacactggtcaggtgtgatggctcatgcctgtaatccaagcactttgggaggctaaggtggaggacttcttgagcccaagagttcaagaccagcttggacaagatagtgagacccccatgtctacaaaaaatctaaaaattagctgggtgtggtggctcacacctgtggtcccagctactcaggaagcagaggcaggaggattgcttgaatctagcaagtcgaggctgcagtgagctgtgttcataccactacactccaacctgggcaacagagtggagaccctgtctcaaaaaacaaaacactgcaataagaaaactgggcaatacgtgtaattcaaagccaattttaaaatagttaattcagtcctggctttcttatttaaatatatcaactaacagaaccctttgaaaaggcaaaagtttgttactttgaacttcaagtaaaaatctcccaatcttagtctatatttatctgtaagccttatcgaagaggcagaaaaatctaagtttaggggttgatgtctaatatttccctaaaaagctaacaaacttttacaatatgtaataatcgtgttagaaatacattaaaattctatccgcttcccctaactcatcactgatattgaaaatatgggattttcataaacatttctgttgcttattctcatctcacttgctggctctttcaaacaagttcttatagtcagtgaagaaaaaaattttcacatttacagaacatctactataggctagatctcattcagtaagtagtctcatctcggtttttacacacacacgtatatacatacacacacacacatacacacacacatacacattcacacacaggcatacttacagacaagtcccaatagcaatgggcatcaaaacaatttaacaatctatgtcaggattactagaggagcaaagttttgtactatacatgaatgctgctctcagtaacatcttaaaccctgaattgaacttaaattagatatgtctaagttatcgtcaatcttctaagtaggaaggtaccacagtctacatatgcaattaattcttcagaagtttaaaaaaaattactatctgtatgcctatatagcacttctaaatgcattttccaacattttagatgattattcacataatcattcttttgttattgaatagtccatttgttctcaatgttatattttatatataatgcaatgaactgcaaagtagatatataaatgtttatggaatggaagaagcagaataaagaaggaccgggactgtactgctttatgttcattttgcttataaaactgattaacatgttggctgaagtttacaattcaactgtttaatgcaaattcctttgtatggggcataaaaatcctcaaacttgagtagagcatgttactactacaatcactgccctaattttaaacttacatgtatcactcattatggaaaaattatttaattattaaaaattgtctgtggcatcaatgtttataatcccacaccattttcccaataggagcaatactcacattaatccttaaataataggttctgaaaaggtaaaacacgaaacaacaaaatctttacttcaagtctatccttaaatgacacatgacctcaccacacagaatttgattttactttttatacaaataattcacttctccaagattttcctaaatcctgagacataaaactttagatatacaacatgtattttcgttattaacaatgtaatgatttggtcctatgtctgaaaacaagtttaaaaaacaactgattaacactagacggtaatatcaaaacagaattgctttgtgaagatggtagaatggtgattcttccctcctttttttaaatgctctttaatattactgttttcaatttaaataataaagaattattgagtttattctctatttcctgatatttatctacaattagctaatacaatttaacataaaattaagaattcagaatctagatttctttagcgatttaaaaatataatgcatgtttttcaattaattataaatgacaaacacagtaacttaatacctactaagggtagttaattagtatttgggaaaagaattaaagctacaatcagaacaaaactttaaaaacttttcattattcaaattacctaagcattttctttttctttttctttttcttttttttttaaatggagtctcactctttcccaggctggagtgtagtggccctatctcggtacactgcaaccaccacctcccgggtagttcaagtgattctcctgcctcaacctcccaagcagctgggattacaggtgcccatgaccacactcggctagtttttgtatttttagtagagattgggtttcaccatgttgaccaggctggtctcgaactcctgacctcaagtgatctccctcctcagcctcacaaagtgctgtaattacaggcatgagccaccacacccggccagcactttcttttaaaatgtttgatattaaacaattatgtatgcaggcatacataatcttatctaaagggaaaacataatcttacataaatattactaaattaatctttattggcttcatcggtttacaatcatgttatgttatcaaaatacctttaatagtcaccttatagcactctgctatttgtcatccagttttatgcatcaaacacaatataccttttggttattcctaactgctcaatggcaaacacacgttccagaatatagtcatgggatttacaacataatattcttacagaagacatatgcagtgttccaaaatattttccaagaatacttcaagttttgtatttatacacttaaggaaaattatctacatgaatattttaaacctctaccaaaaaaaaaaaaaatccataacctcatcttgccacaagcacaaagctgcttaccattcatagctgtgggaaactgagccatcatggtcctgagttttccttgctagctctcagccatctgcaacataaaaatattgtgccgttgataatacaacaagggcaaatcacagtttagtgcacccgctaagcagtaggaatgtctgtccccttcagctcacacttccaacagaaaacaatgcagagcttctgctgctgctgaacaggcagaatttacatttgaggaagggtaagagattttgttgggtaatcgtgctgccttaatacagaaaaacagtcacatatttaatagtagatactgaataaagaaacccttggcatgaaccaacattcttgtagaaattaatttggaagagaaaaaaataaatcaactgtataaattaagtatataagaataacatggaaatccatacttttttttttttttaaatagagtctcactctgtcacccaggctggagtgcagtggtgcaatctcagctcactgcaacctctgcctcctgggttcaagcaattctcataccttggccacctgagtagctgggactacaggaatgctccaccacacctggctaatttttgtgtttttagtagggacagggttttgccatgttgaccagaatggtctcaaattcctggcctcaagtgacctgcccacgtcagcctcccaaagtgctgagattacaggcgttagccactgcacccagcccatagtatcattttttaaaaactcccaaacaagaaaaatattcaaaataaatgtagcgcagctgtttaaatgagctcaaggggtttataaaatagtctaaaagtaattattaaaacacacaaaattattaaaatacatatataacataactaaatgtgctgggcaagcactctaagagaagggactttggaaattcacagctctgggttcaaacccagctctgctattctcccagctgtgaccatggaaaagttatttaaccttttttgagactcagattactcatctataaaaaatactttgcagaagtattttttaaagtgttaaacataatccagtaaactgcctgccacatagggtgttcaacaaatggctgctattttgcaaacaaccagaaaaggagagtgcagtatcattttgaaccctgaattcattattcagctgtcaataaattcaaaaattgttccatgaatctttttgtgggtctgtttttttttttgtttgttttgttttcttgagacggagtctcgctctgtcgcccaggctggagtgcagtggcgcagtcttggctcactgcaacctcacctcccgggttcaagcgattctccagcctcagcctcctgagtagctgggtctacaggcgcacatcaccatgcccggctaatttttgtttgtttgtttgtttgttttagtagagacgaggttttaccatgttggccaggctagtcttgaactcctgagctcaagtgatttgcttccctcagccacccaaagtgctgggattacaggccactgtgtcctgcccgttccatgaattttgagagtaggaccagttaggaagtgaaggcctagcaaatttatagcaatgcacttagtaattaaaaccatggatcataatattgcaggaaaacactactatattaaaagatcatgccgtatctcatctatttacccaaatcatttaaatattaatatttttagaagcctaagaaaaatatttgcacagccattttaaacaaagaaggcattaagtagtacatacatcgtggtcaacgtttctcaccattttatagctagcttaaaaaatgaacacagaaggaagtcccatcaatcaagttatgactgcaacttcctcaaatacagaaatactgcaaacaaatataacatttttacttcttcaattttaaatcataagtaatgttaacccaaaataagctacatggctaaaaacaaactatctacttaacagatatgcagtagcaagggcccttattcattagttttctgtggctgagaccattttaaaacatgggagaaaacccactattgcaaataatgcattttctaactctgcataatagcatgtgaattataaagatggctctaacaacagaaaaaccaacgaggaatgggatcccatggacacaaggccttaatcagttgggatctaggtctaaaacttacaaatcatctgtctagaaccatttgttcgtcatcacgtattctgtgaatacaaaagaatgccaaatagagagcaacgtgaagaagaagacgcgagaacgaaccccggactgaccaaagcctgcatgccactgcatcctgtgccaagtgcttacctcctgccaccgttgccaccaccatgcccaagagaaagggtgaaggggatgctaaaggagataaagccaaggtgaagaacgaaccacagagaagacccatgaggttgtctgctaaacctgctcctccaacgccagagcccaagcctgaaaaggcccctgcaaagaagggagagaaggtacccaaagggaaaaagggaaaagcttatgctggcaaggaggggaataaccttgcagaaaatggagatgctaaaacagacggggcacagaaagctgaaagtgctggagatgccaagtgaagtgtgtgtattttttataactgtgtacttctggtgacagtagtttgaaatactattttttatcaagttttataaaaaatgcagaatttcattttacttttttttttttttagatgaattctcgctctatcgcccaggctggagtgcagtggcgtgatcttggctcactgcaacctccacctcgtgggttcacgcgattctcctgcctcagcctcctgagtagctgggattacaggcaggcgccaccacacctggctaatttttgtatttttagcagagatggcgtttcaccatgttggtcaggcttgtctcgaactcctgacctcaggtgatccacctgcctcagcctcccaaagtgctgagattataggcatgagccactgcacccggccacttttttttttttttttttttaaggcagagtttcgctcttgttgctcaagctggaatgcaatggcgcgatcttggctgactgcaacctccgcctcccaggttcaagcaattctcctgcctcagcttcccaagtagctgggattacagttgcgcatcatcacgcccggctaattttttgtatttttagtagaaatggggtttcactatgttagccaggctggtcttgaactcctgacctcaggtgatccacctgcctcagcctcccaaagtgctgggattacaggcatgagccactgtgcccagcctactttttttttttttaagctatgttgttagcacacagaacacttcattgttgtttttgggggaagggccatatgtcactaatagaatgtctccgaagctggactaatgtggaggaaacacctttcccttctagttttgagagagttcctcttggctcccaggaggagggattccctgactttaacacacatggccaccttggcacaaaagccttgtggtatggaaaacaaatttgtttttatgtcctcttctccctttccgtccttcagcagagacttaactcccttaaacccagacatctgttgagacctgaccccccaatcattagttaccagtgtgtcaggcaatctggactttccagtgatgccactgagacggcacctgtcaaaagagcagtggttcttcagataaattctgccattttcatttcacttcctgaaagtcagggtcggctgggaaaagttgttaaacaatatgctaaatgtgaaatgtcaaccctcactctaaactttccctgttcacagcatcagatgaagacttcattgggttttagagtggctttcaagaagggagtttgaaagttgttgtggccaggcgcagtggttcatgcctgtaatcccagcactttgggaggccaaggcaggcagatcacctgaagtcaggagttcaagaccagcctgaccaacatggtgaaaccccatctctactaaaaatacaaaattagccaggcgtggggcacatgcctgtaatcccagctacttgggtggctgcggcaggagaatcgcttgaacccaggaggtggaggttgcagtgagccaagatcaggccattgcactccagcatgggcaacaagggcaaaactccgtctcaaaaaaaaaggaaaattgttgtatactcaatgattgtctgcccatgtcctgcctgaaataccatgattgtttacggaaagtatctttaataaagctggatacagtttggcttgggaaaaaaaaaaagaatgccaaatagtagatgctcagtaatcacaggcataattctgaaataaaacctgagaatgaactaaatattaataatattactggcaataagggcaaatcccttgggtaaagctgaaggtactagtattacagaatctttatcatctggtatgtggaatttagccacccatgcacataggtaccatattatatgtaacatttatattgtatgtaacatctgattaactgtggtaacatctaaatatgggagtatattttgttggaaccaataagcttttaaaacatatcatttcatatctattacatttctattctctctgccccactgtggaataattacctaatgcttaacaattctactagtctatttgcagagtagtacttaacaattataattgaaattttgaaaatgcaacagataccaaaaactttgttttacatttttcaaaaagcaattaataaattaacatttactgtttaccattaattcaatacacttctgttgatcacagtagatgtactgtgtcatgctgagtattcattgagaatccaatgtttcaggttctgcagaaggagcttcagacactgacaagcttgtagacttatctaccaggtgccagatactgctaggcacctttgataatatggatactcctctcacaatatccccacaaggcagatgatactgtactcatttcacagaagaaactgaagaggttaaattacttgcccaaattcagtatgtcatgaagccagaatgcaatcccaagcctgtctaattcttaagcccatgaacttcccatgggctttatctgcctcttcctctcttaaatggagataatgcgtcacaggttcctacaaacagcaggagaacttactgttagcacatttgtccaggagaagaaaaacaagccagagatgactcccaacacactggacagcatcaatcacatacataaattagggagtgctaattgtttcttatctcttggtataactctctgaaaggaagaaaagggtaaccagcatctccccaggtacatgactggcgcctgtttcaggcaagtgcaactgaagtcagcatccaacaaacacccctttctactcttcacaggggatgaaatgtagtgacaggcaattttggcaaatttgcagtcatcatgtattttgaatactgttagttatgtatggtttttagaatgttcatatgattttcctgctcattaaaaattaatgcagaactggcattgttccctttgtagaaaccaagaaaatatattgggtaaatagtaggcataaggcaaagaacactgcttcaatttaatataattcagttgccatttggagtaattgccaaacgtactttagacaatgtagaaaatatactcacactaagacagaaaaaagtagaaatgctagaacaaaagcaggaaatcctgcttttacaaacggtcagtaagactcagaaaaagtcacagccattataagtgaaaagtcgcttaattaaggtttaggggtttttttgttttgttttttgagacagagtctcattctgtcactcagactggagtgcagtggcacaatctcggctcactgcaacctccacttcctgggttcaagtgattctcctgcctcagcctcttaagtagcggggactacaagcgcacgccaccacacctggctaatttttttttttcttttttttgagatggagtctccctctgtcacccaggctggagtgcaattgtgcgatctcagctcactgcaacctccgcctcccaggttcaagcaattttcctgcctcagcctcccaagtagctgggattacaggtgcccagcaccgcgcccagctaatttttgtattattagtagagaggaggtttcgccatgttggccaggctggttttgaactcctgacctcacgtgatccgcccgcctcggcttcccaaagtgttgcgattacaggcatcagccactgtgcccagcctgatttttgtatttttagtagagatggggtttcaccatcttggccaaaccccaaaccccttggcccagccaaggttaaagtttttgtttgttaagaagcacagttacagaaagaattacaattactttccgtgccaatagcgctcatgcaaacatggtgaacattcctaaaacccgcaggactttctgtaagaagtgtggcaagcaccaaccctgcaaagtgacacagtacaagaagggcaagaattctctgtatgcccagggaaagtggtgttatacaggaagcagagtggttatggtgggcaaactaagctgattttccagaaaaaggctaaaactacaaagaagattgtgctaaggcttgagtgcgttgagcccaactgcagatctaagagaatgttggctattaaaagatgcaagcattggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagatgcaagcattttgaactgggaagagataagagaaagggccaagtgacccagttctaagtgtcatcttttcttttattataaagacaataaaatcttgagtttatgttaaaaaaataataattacaattatcatttagtccaaaaccctcaattttcaaggtgggaaaactaagaaacttgtaaaagatcacaagttagtagcaaaggtcccagaaactacatctctgatgtacatgtccagtgctctggttttttaagacaaagtatcaccctgccacgcaggctggaatgcagagacatgatctcagctcactgcaacctctgccacctgggcttgagcaatccgcccacctcagcctcctgaggagctaggactacaggcgtgtaccaccatgctcagctaatttttaaatttttttgtagagatgcggcctcactacatttcccaggctggtctccaactcctgggctcaagtgaacctcccaccttggcctcccaaagtgctgggattacaagcgaaagccactgcacccagccttccagggctgtttgtttgtttttgagacagagtctcactctatcccccaggctggagtgcagtgcgccatcttggctcactgcaacctccgcctccctggttcaagtgattctcatgcctcagcctcccgagtagctgggattaaggtgcctgccaccatgcccagctaatttttgtatttttagtagggacggggtttcgccatgttggccaggctggtctcaaactcctgacctcaggtgatctgcccgcctcccaaagtgctgggattacaggcgtgagcaaccacgcccagcccagtgctctgttcttaaaagtttcccttggccgggcatggtggctcaagcctgtaatcccagcactttgggaggccgaggcaggtggatcacgaggtcaggagatcgagaccatcctggctaacatggtggaaccccgtctctactaaaaatacaaaaaaattagccaggcatggtggcgggcacctgtagtcccagctacttgggaggctgaagcaggagaatggcatgaacccaggaggcggagcttgcagtgagccgagatggagccactgcactccagcctgggccacagagcgagactctgtctcaaaaaaaaaaaaaaaaaaaaagtttcccaacttgcccactcatatcacctgggatatttactaactgtacattatgaatagaacctaaataaatgttattggcttgagacccttccacacagctactagttttttcttaaagcactcattaatgcccctttcctgcttagaaaatcttccactgattacaagttaaagtccaaacttcttagtatgaaatacggccctcttcagtatctcactgtatcacatactccaggtactttccatttccatatgtcctaagtataccaatcttttttgaaacagtaacttttgttctctcctctactccttcataaagaggtgctccctttgtcatggtcatcacactttcttctccttctttgattcccaattcaaatgtcatcttgtctttgaaagacttctatcctcccaggtagttagtcactatctcctatgtgtgtccatacacttgtttacaccacaataacctcatttatcacactattttaatttcatgattgcctgtttcacatgtcctggggagagaccatttttatttacctccatatgcctggtttctaaaccagatcttccaaagaaaacactcgataaacatttgctgaacaaatgaattgggtaaataatatggttgagataccaaaaaagatgtgaataaagcaagcagggagaggcaacgatgaactgaatatacagaaaggaaaccagcaggaagcagaacaggctccaacctacttccattaaaccctgcagaaatcagagttgtgcaacatggctctcctgtaacttggcttttctttttttttttttgagtatacttttaaagaaaggtttatttcccattgacttctgaaggttttttatcgagagtgaggaaggcggctcaggttttttaattacttcatgattcaatattttgaatcattttgattaaataaatttgacgaatggtctgacattcaaaagcacaatcatcaatcatcatgttcctgcaggcgtgtgtgtctatatgtatgtatgtgtgtgtgtgtgtgtgtgtgtatacacaaaatatatatatatatatatatatatatatatatatatatgtaatttttttttttaagacagagtctcgctctatcacccaggctggagtgcagtggcatgatctcggctcactgcaacctcagcctcctgggttcaagtgattctcctgcctcagcctcccaagtagctgggattacaggcgcgcaccaccatgcccagctaattttttgtatttttagtaaagacggggtttcaccatgttggccaggctggtcttgaactcctgaccttgtgatctgcctacctcagcctcccagagtgctgggattacaggcgtgagccaccacgcctggcttttttttttttttttttttctagagacatggtcttgctacattacccaggctagactcaaactcctgatctcaagagatcctcctgctgcctcagcctctcgaatagctaggactacaagtgtgcaccactatgcccagcttcctgcaggtatattttataaaactttctctagtgtctctgccactcccagcatgtgctaggtacacacagccaacttccaaactatacttgctgatcagttgagaaaagtgttcctgtctcatttagttcccaaggagatcaaggtcagttctctatgaatgtaaaccaaaaataaaattctaaggccccccaaccttctgaatggacttccttctcatccagggcactgttaaaatttaacctgaggctggttcaggccgtgatgggaagtggggttcagacatactcattaaaccctcactggccttaacatcaacacagacttagtctgataagaagcatttacatctatcctctcagaagcctgccacccagaggcttcatctgcatgataaaactttagtgtttataacctcttatcaacataacccagtcttttcctttctattgatcccaggtctttagataaactcaagctattgtcaaccagaaaatttttaaatctacctataaactggaatcccaccctccccttcgagttgtcccacctttctggatggaaccaatgtatttcttaaatgtatttgattgaagtctcttgtctccctaaaatgtataaaaccaagctgcaccctgaccaccttgggcacatgttctcaggacctcctgaaggctgtgtcatgggccatggtcactcatatttggctcagaataaatctcttcatatattttagagagtttggttcttttcatcgacatgagaagagctggagcaaaattacctgctactttatagtttctgcagtaagatgaaatttacagaatacatatattctccacctatgcattcattcattctttcattctaccattcatttattcatcaaacatgaatggtcattataataaagggacttggccaggtgcagtggctcacacctgtaatcccaacaactcaagagactaaggcaggaggattgatgaggccagaagttcaagaccagcccaggcaacacagcaagaccccaactctacaaaaataataataaataataaagggatttggggaatgccaagagaacccagagaacagaacgaacactacttgagaggtaaatcaaagtaaggtacatgtaatcaaggaggtaatatttgtgtaagaattatctaacatgaggtcggtggcaaactgagtgaactccaagtgtccttggagtgaatgacattgtatagtgtgcagataggctctgttataaagaaaggaagtttctgagcctgagagaaggactagttaaaagaaggaaagcacaagagccagtgtaacaccaaaaccactcctactcgtattcaaaaactgtgcgatttgagagtgatgtaatttcaaagaagtcacttcatcttaagaggtacaagaggccaggtgtggtagctcacacctgtaatcccagcactttaggaggccaaggcaggcagatcatttgagtcctgggctacacaaggaaactccatctctacaaaaaacacaaaaattagccgggtgtggcggtgcatgcctgtagtcccagctactcaggaagctgaggtgggagggtcacttgaacttggaaggcgaaggttgcagtgacctgagattgcgccactgcactccagcctgagcgacagagtgagacgccgtctcaaaaaaaaaaaaaaaaagagttaaacctttagaaacccagtagtcttcaaattacgctccttggagttctaaaagtttcaaggaggtacaacagaggtggggtagggaggaaagagggaaggttggaagggataccaacttcagtgagactagctctgtttttgtgttttatatattgaagcttctctgtaagatttcacctgattttttcttaaagataaatgacaacacactgaattccatcctcttcatttcagaaacaactaaataggtcaggtgtggttcacggctcatgcctgcaatcccagcactttgggaggccacagtgggaggatcacttgagcctaggagctcaagactagcctgggcaacacagggagactctttctctacaaaaaattaaaaacttagttgggcatggtggcacacacctgtagttctagctactcaggaagtagctactcaggaggtgaaaggatcatttgagcccgggagttcaaggttacaatgagctatgattatgtcactgcactccagcttgggtaacaaagtgagacagtgtctctaaaataaaataatgtaaaaaaaaacaagtagaagccaaagagattaagtaaccaagatcacacaatttaagacaaacagtaagtcatgctattgattttggacattgctgtgcaagtcatggagagccagtatttaaaacacagtataaagttgaatgtacttggcagggcgcggtggctcacgcctgaaatcccaacactttgggaggccgaggcggcagattacctgaggtcaggagtttgagaccaccctggccaagatggtataaccccatctctactaaaaatacaaaaattagccaggcatggtggcacacgcttgtagtcccagctacttgggaggctgaggcaggagaatcgcttgaacccggggggtggaggttacagcgaactgagatcacgtcactgcactccagcctgggtgacagaacgaaactccatctcaaaaaaaaaaaaaagttgaatgtacttgtttacccagcatcaagatgaagaaagtcaaaatcgtcgcagtccccaaagtcccctcatgctcccttccagcctctgtcccaccagggaaacatgatcccaacttctaataccatagattcgttctgtctgctaaggtacttcatatgaatggaattatgtagcccgttgtgtctcttttgttcagcatttggtctataagttgtgtcattatagatcctgtgttctcaaaaaaggaaaaaaaacacacacacacacacacatatagtatatgttctagttagagacccacatttggtagttatcagagattgggaatacttgtaatgtcagtgaattacattatccagggaaagtacatataaaaaaatatataagaagactggtcttttaagaggagaggaagacaactctgacaagcagtataggaacaaactggattttgagtcttgagacaaacacaccaattatgaagtgactggcatagtccaggtggtgagaacttgaacttgagcaatggagaagaggtatttcaaaggtagaatagacaggattttctggtcagctaaatgtggaagatgaaagaggagcatcacagatgggtttctatcttgggtgactgtagagcagtaatattaaccaagatagaagctctaagaaagtaggaatctagatattagatttgagggatgaacaacaaaatgttcaattttgagcacacctaatctgatccacctacaaagacatctagatggaagtgtccaagatatagtgaacactctatctagaaacccagatttcgtagtcattagggattgggagtagttgtaatcatgtgggtgaatgacattatccagggaaatcatgtataagaaaaaagagacaagaatagtcagaaacagaggttcagaaacacgagaaatcgggatacagagttaagagtttcaaggagaaaatggtattgtcacagaagttaagactcagctattagtgttggcaatctggagtgagtgtagttctagcacagtgatggctatagaagccaaattgaagtagattaggcaataaatgtttaaaataaggggaagagcctgggtgtggtgcctcacacctataatccaagcactttgggaggctgaggcaggcagatgacatgaagtcaggagaccggtctcacggtcaacatggtgaaaccctgtctctattaaaaatacaaaaatgcgccgggcatggtggtgagtgcctgtgaggcgggagaatagcttgaacctgggaggtggaggttgcagggagccaagatcgcaccactgccctccagcctgggcgacagagcaagatttcctctcaaaaaatacataggaaaaaaggtaagatttaagaaagggaggcagagttattataaggctttagtttttaggtgacagaacaaaactatttttagacaaaaaaaagaaataaagatttaatttacaaaaaggagatgggagagaagttacctaatggaagttagggccagaaaaagaagtagtagacagctctagaacacgaagttagaacctgggacagatatttctgtctctaagaatgaagttcaggaaggggagtaagaatgaacaaaggcatacataagtttagaagcagaagaaagagcgattgagaaggtacagattttcttctaccatttttttttcttttagagatatataatctttttgagacagtcaatgttgccaaggctggagtgcagtggcataatcacggtgcactgcagcctcgacctcccaggctcacgtgattctcccacctcagcttttcaagcggctgggaccacaagagcacgctgccaagcccggctaatttttaaaatttcttatagaggtgcagtctccctatgttgcccaggctggtctcaaactcctaagctcaagtgatcctcccacctcagcctcccaatgcaagctttctttgtctctcttctttaggctcagacaacagtccaaagggcagagctaaggacagactccttgatctcgtaggccctcaagtgtctaagcacaaatttctctcctcttcaagccataaaagagaaagacacatgcaaatcagttcccatgactcaaccagatatgtgcatttcagcttgcattcaaatcagcttaggccctacacatcaaaacatttgttaaaatgaatgaatgtgaaggaaaacattctaggcagaggttactctgcaaaagcagagtaactagtgtggtctggaaaaatagaagattacttactcacatgaaatagtgaagggctggcctggcacagtggctcatgcctgtaatcctagcacttgggaggccgaggcaagtggatcaccttgagctcaggagttcaagaccagcctgggcaacacagtgaaacccctctctaccaaaaataaaaaaaatcagccaggcgaggtggcatgtgcctgtggtcccaagtactcaggaggctgaggagggaggactgcttgagtctgtaagatgggggttgcagtgagtcaagatcgtgccactgtactccagcctgagtaacagagtgagaccccatctcaaaaaaaaaaaaaaaagtgaaaggctaacaacaatgcaaggaaccataacaatagatacaaaaataagtacaatgttaatgcctagctgatacaaatgtcaattagcataagatccttaaaacaacctgaaaaattaaacattaaaaaatatatatataatagaaagtgaaagtccattaccaagaaaacaatcattagcagttttgaatagattgttccagatatttcctatttatacactagcaaataccacttttacacaaatgaagtcatacttcattgttctgcttttttcatgttaccaatttttcacagtgaataagtaatcttctatttttccagaccacactagttactctgcttttgcttgtactgtaaccactgcctagaatgtttcccttcatgttcattttaacaaatgttacaattaatgctacaataaacattcttcatacatgtgtgtaaatataggtctgtggacagatatgtgcttccaaagataaattctagaagtggaagtagcaggttagagagcatgaacattctaattttaatagataataccaaacagcctaaattggactttacctataaagtctctcaatacaggctgatagcataataccaataagatgcggtttagagacacaaccctctaactctgacttaattcaaaagacattttagagtacctataccagtaatatactccatttcctctaagcaattttccacaaacattatttcccttaactaagctttcctctccaaataaatgtaatttataagcacatgctccacaaaaatctcaaacatgaaaaacttactaagcggactccacagacaggggaggaggggtgaacctgaagacccagtcctgattaccacagttaacagtttggtatttgtttttccagatttattttatgcatatataaacaaacatgttatttttcaaacccaaataaaattatgctagccaattaatattctattattttcattacacatattacagatatccttccatagcaatatataatacatcaatcatatccttttaaataggtgtacagcattttattatatggatataccagaaattaagctatcttccactggtggacattaagacggtttccagttttttgcctaacaaaccatactactttgaacatcctcatcctcatatatatactgagtatttaggtaggacaatacttctagaagtagaattaatgggtatcaagttgctttccaaaatttattaatagtaccattttatattcccattggtgtgtaaacatacttgtttctgtataatcttgccaatatttggtatgaacaattattttatgtattgccaacctgagaggcaaattttttctaaattttcatttctctgatcattagggaactcagcatttttcatatatctatcatgtatatttctcctatgaattgcctattcatttattttgcccattttctatagcatgctgttcaatggaaatgcaacacaaactacataatgtaattttaaatgttctagtagccacattttaaaaagtaaaattaggccaggtgcagtggctcacgcctgtaatcccagcactttgggaagctgaggcaggtggatcacctgaggtcaggagttcaagaccagcctgtccaacatggtaaaactccatctctactaaaaatataaaaattagctgggcgtggtggcgggcacctgtaatctcagctacgcaggaagctaaggcaggacaatcgcttgaatctgagaggcagaggttgcagtgagcccagattgcgccagtgcattccagcctggataatagagtgagactacatttcaaaaaaataaataaaaagtaaaaataaacgggtaaaatctgtattaatatattttaattagttcatatctaaatattatcacctcaacatatgatcagtataaaaattcttatgacattttacatttttgtactgtcttcaaactccagcttttacacttattatacacttagagtacttctcaatatagaactagccacatttcaagtgctgattaaccacatattaaaggctactgtatgggatagtgtggttctataggatctttatatgtgagagctcagatttcccccatttcagccttttttcccctatgtttttatttttactgtacaaataatttaaaagcaaaggcttcaaataatgtacaattatgaagagcaaaacatgacagtcattctttattacctcactcacagtaccatctccaagataaccatatcagccactgaagtacattctcacagcctatttttacatattatataaacgtatatatacccatatgtattttacattgtctaaaccttcttctaagataatacccatcagaaataccacattcgattctacataatattcaacaggatgggtagatcaaaatttattttttaatagacacataatacattaatactctcattgtaaaaacttaaaacatacaaataaagccaattcttttgaccatccttccccatcagtctctgaaaatacccagtgctgttaacaacatgacctgtatccacggatctttttctatgcattacaataatagatattatattaatagtaagcttttacctgtaacatatgctataaatgcttttaatctagcttgtttgtcttttaattttagggcatctttcattataccaatttaaatttgttggtctttcttttatgactagtgagtgtcttgtcatacaaagaaaggcctgtctcataccaggtcttataccagaaaattgtcctatattttattctagtacctctatgatttaagggttttatgtatatatttgatctacgtggattttattttggagtgaagaaatggatatgagtccaaattgtttgcgctacccttctaccaccaccacttgcgatgtctagcagtgtctacccttcttatctctatgacctctaagactgtatcccagcccacaaagatggaaaggcagaaggctacgtagagtatagcacagaaaggagggtgggggattaactgtagagaggaaaaacttgacaaacactactttagccagctggtcaaggtcaacatcaacagtcataaagcatgcagacagtatgtgctcttgataagatgaaagtatcattttgcctttgtcatcttcctcctaaaaattcactaacttagtccaagcatgacaaatcatcaaattccaatatacttacaatatatttatatatctcctacaatatctgtccagtaacctctcaaaactgtcaaagtcatcaaaaacaaggaaagtctaaggaactgtcacaactaagaggagcctaaggagacatgacagctaaatgtaatgtggtgacctggaacagaacaaggatattaaataaaaactaaggaaactgaaataatgcatagacttcagttaatcataatacaatcagtattgttcattattcctaacatatgtaccatactgatataagatattaataatagtggaaactatgtgtggggtacatgaagggatatatgggaactctgttctactcgctccatttttctgtaaatttaaaactgtttaaaaaataagcctatcaattttataaaaagcaaatacctcagaagtagaagagtataggtaaatatgtgcctctaattttgaccacattcattaaaaacaaaatacccacttgatccacatggaaatttatcttttttttttttttttttttttgagatggagtctcgctctgtcacctaggctggagtgcagtggcatgatctcggctcactgcgacctccacctcccggtttcaagtgattctcctacctcagcctcccgagtagctgctactacaggcacccgccaccacgcccagctaattttttttgtactagtagagacagggtttcaccatattggccaggctggtcttgaactcctgaccttgtgatctgccgacctcagcctcccaaagtgctaggattacaggcgtgagccaccgcaaccagcagaaatttatcttaagaaaatatctaaagaacaaaaatagattgcaaggatgcatagtacagttttaccaatattagaaaaaatacaaataagctaatttatccaaaaatagagaaagaagcaaaaaattaaagttacattcactcagaatattatttacctattacaaatgacaatttcaaggctataggagataggatatgtttattatataatgtaattaaaaaaaaaatacaaattgtaggccaggcactggggctcacgcccgtaatcccagccctttgggaggctgaagcaggtggatcacctgaggtcgggagttcgagaccagcctgaccaacatggagaaaccccgtccctgctaaaaatacaaaattagccatgcgtggtggcacatgcctgtaatcccagctactcggtaggctgaggcaggaaaatcgcttgaacccagaaggcgtaggttgcggtgagctgagatcgcaccattgcactccaccctgagcaataagagcgaaatgtcatctcaaaaaaaaaattgtagaatatgaatgtaaatttgggttttcttttttttttaatcttacatgaaccacatataccaaaatgttaaacaattaaaaacagataaggctaaacacggtggctaatgtttgtaatcctagcgcttttgggaggccaacgcgggagaatcattcgaggctgggagttcaagaccagcctaggaacatagtgagaccccatctctaccaataattttaaaattagctgggtgtgatgggtggtgtgcatctatagtcctagctactcaggaaactgaggtgggaggatcacttgaacccaagagttcgagattacagtgagctatgaacatgagactgaactccagctggacaacagtgagaccctatatctataaaaataaataaaaattaaaagtgaaaaacaaatactaagatctcagtaaagatcttactcttcagtaaagagaaggctatggtaaacttacaactagtttttcaaatactatgatttttttttttttttttttttttgcccaagctggagtgcagtggcgcgatatcagctcactgcaacctccaccttctgggttcaagcgattctcctgcctcagcctcccaagtagctgggattacaggtgcctgccaccatgcccaactaattttttgtactttttgtagagacattttagtagagacaaagtttcaccatgttggccaggctggtctcgaactcctgacctcaagtgatccacccgcctcagcttcccaaagtgctaggattacaggcatgagccacagcacccggcagcccttgtctatttttcagtctattataaacaataataaataacaagtctcttttactaaaagcatttaactgaaattaccatttcatctcaaatccagtcatgctacatccagtgctaaaaactacagaggaaaagtacactacaacaaacacaccctattgcaggggcagacagagcctggcatctaagctgatgccataccccataagggcctgcatgggaataacttttatctgtgattggtagtttcacatctcaaccaaaaggctaacagaataaaagagtaaagaaattcaaagtagcagctaacgggcagaaaagcattcgtccattttcctatgctatcaagccaatttgaagttttttaaaaaattaccaatatacttcaattactacaaataaagtatactatcgctgcaaaaaaaatagcacttttgaatataatatcaaaagaatcatccaagaaagcaaacataaaataataataaatgtgggccagttgcagtggctcacccctgtaatcccagcactgctggaggccaaggcaggatgacagcttgagctcaggagtttgagaccagtctgagcaacatagtgagattctgtctctacaacaacaataatcatcatcatcatcatcattatcatcatcatcaatatgcaatgagaatttttttaaagcaaactccaaaatctaacagggaaaaaaattaccaggaaaaaataaaatagagatattgtaacatggaatttgttacactaaaaccaatagcatacccagaaaacatccttcactcacaacaccacctaaccaaagcaaggtctcacttcccccaaatatttcaaaccacaaatttacaaattcttttcatcaacctgaattatttaatttgagtggtcatagacttttttattttaatctgataaaacctatggttgttctccctggaaaaacacaaatgtacaaaatatggcacataattctgaaggtttcacacatccaaagccaactgtagactttcagacagttcatgtgttccatagcttaaatgtttaatgataacatacacaaaccctcattcttaaaaaaagataatgaagtgggaaagacccttccaattatgtaatccactcattcccaaactatttttttaaaggaataaaagaatggctactccataggccgagcagcagcctcattcccaaactattctaaccatcacccacctaagtaagacaagagatccagcctacctacctcctcccattttctagtgcaaaaataactccctaaggaagaattgtagcaatgtaacaagtacacaagagcaaaacggtccacaaaaatttaaatgtaacattaattctacaattgtattaatccaaaaataacagcaactggaaccacagccaatttgagacaacaccactgatgtagtgaaaatatcttctgagtgtgggcatgcatagtactaattttctagtgctgccaaagcatggtatagctgacagatttcttagaagaaaactaaactagagccctcggtaagttctagaaaccagctaattttagttgtgaatactaaatttcagtaatccttagtaactcagattattggtaggtagcctattctaatacataaatatcagaggttatgggaatggaataacaatagcccctgagaactgaggagacggcttgtatttctggttcatgatccattaggaaaagcttctgatctagtgagtgtcttggaccatactgaggaagcattaatctaagccaataattttcaacaatttttccactgtgattctgagtaatggctcaccaatagtataaaattaacctcctaaactggaacccacatacattgctggtgggaatataaaatagatcaactgctttggaaaacaattcagaatttcctcaaaatgttaaacataggttaccatgttaagtcagcaattccacccctcagtatgaacccaagataaataaaaacatgtcccaaaacctgtacacaaatgctcacagcagcattattcacaatagccaaaaagtagaagcaaccgagtggaagcaaatgtccatcaactacagatggatgaatgaataaacaataaacaaaatgtggtatatccatataatccataaaatattatttggccataaaaaggaatgaagtactgatctatgctataacattgatgaatcttgaaaacactatggtaagtaaaagaagtgagtcacaaaagaccatatattgtataattccatttatatgaaatgtctaggataggcaatttcatagacacagaaagtagactagtggctacctagagctagcggtgttgagggagatggaaagtgactgccattgggtataggaggttcttttaagaacgacgaaaatgttctaaaattagatagtgatactggttgcacaagtctgtgaatatactaaaaaacactgaactgtaaactttaaaagggtgaattttacaatatgtatctcaataaagctgtttttaaaaaatctattcacgtgacatacaaggtgttttaggctctatcttccgcctaccctaccaggtatttcaacctccccacctccacctccacttgatcttattcccatgcctcctctctttgcacctgtggaactacctgccttctgagtgacacttctactaataatagcttcctttgccacagtcccattttgtcttgtattatctcattaaactacataccagctagtattgttacttttgttttcacgcctgccccgcttctattagactgtgagctcctgaatggctctttaacttcatatacctagtgcccagcagtcactcacatggtaggcactaaaatattctttaataagcacaggttagcattctttcaactgcacagaagacaaacccagcaacttgagtttgaatcccagtgcaagtacttcctagctttgtggacttgcacatgacatagcttcaatttcctaaccaaataatgtggatacagtagacccccttatctgcagtttcactttctgaagtttcagttacctgtggtcaaccatggtctcaaaatacaaaatggataattccagaaataaacaattcataaatttttaattgtgcaccatcctgagtagcatggtaaaatcctgcattgcccgcatctgtcccaaccaggatgaaaaccatccctttgtccagggtgtatccactgtgtctatgctgcctgcccattagtcacttagtagctgtctcagttatcagaccgactgtcacagtatcacagtgcttgtgttcaagtaacccttattttacttaataatgaccccaaagtgcaagagtagtgaggctggcaattcggatatgccaaggagaagccacttccttcaagtgaaaaggtgaaagttctcaacttaatatagaagggaaaaaattgtatgctgaggttgctaagatctacagtaagaacaagtcttatatctgtgaaattgttaacagtatattgttataattgttcaattttattattattaatctcttactgtgcctaatttataaattaaactttatcataggtatgtatatataggaaaaaacatagtgtatataggtttctgtaccatccatggtttcaagcaaccactaggggttttggaatgtattccttgcagacaagcaaagtactactgtaatcgtacctaaatgccaggttattttaaggcttagatgtcatgtctggaaaacatctggcacatagaaggtgtccataaattatgattattacaacaattatttcaacattattttaattataatcactaatcaacttttagttgtaatcacaatcactaatcactaatctaatttgttttactgaaacaaattagagttgtgccaattattaataaaaggacatgtttttctcactttaatcaatatttgagaaaaaagttatcatttctatctagaggcttagggtcccaaatatacaaagcattaagacctaaaagcctcaaagaggataacttctctatacaaacttagttcttaattctagttctgcaatttagcaacctcagtttagatttttaaacacaaattataagctcagatttttataaatattgagtttagccttcaaaaaaatcaaccaataagccaggagacataaaaggacaggaatagcaaactaatactgaagtggttagtactcaaattctattgaagatttaaatcaaaccaatttttgaagaatagtcaacaactctgaacaagacaattcacccacacaaagggggataaaaatacctaagaatagcttgtgactcagcctgcattcctataaggggtcccagggggactgataatatttagcctattgtcatctgtctcatatcagaactaaatattacagcaaaactatttacttgacatgaataaaaagtacagagggaaagaaattcagacagatgcttcactttcaagtaaaacatcacctctttgaaacaaagacaacttttaagttttgaagccatacaagaaaacaaaagaaagaataagcagattctatatcatctatataacaaatatttaaaacttccttgaaaacaaacttaaaaggtaaatggggaaaaatcacaacacatgataagcagttgatatttttaatgtacatagggctattaaaatagataacgaaaacactaagacctcaaataaataatctacgaaagaagaaacagaagaaataaaagtagttaataaatgttaacatcactaataattaagaaaacgaggctacccacagtggctcatgcctgtaatcccagcactttgggaggctgagtgggggcgaatcgtctgaactcaggagtttgaggccagcctgggaaacatggtgtaaacctgcctcaataaaaactacaaaaaaattagttggtcccagcgggaggctgaggtgggaggatggcttgagcccaggagaaggaggttgcagtgagctgagatggcagtgagctgagatcccgccactgcactccagcctgggcaacagagccagaccctgtctcaaagacaaaacaaaacaaaacactggccaatacccagggctagcaaaggtgaattaaatagggtgcttgcaggtacagcccatgggaatacgtattggtatcactcttcagaaggcactgtgaaaacatatatcaagagtcccaccaacattcatatcctataaagcaataatttcatttctgggaatctgtcataaggaaataacagtaaatgtgggaaatgctttaattacaaagatatggcagcattagtaatcattgaaaaaaactaaaaatgaatgtccaaaaataaaggaatatactaagccaagtatcatgcttccacttaaaatcaaattcatatgatatgtgaattaaatctcaataaagctattttgtgatcaagttcagttagaccacataataacatggaaactgcttatgttcttacaatttaaaacttacattttgatataaatgtgcatatttattatgaaaattaaaacagcagccatcaatcatcaatatttactaagtgccaagccctacactacaagttgttacatgttatcatggttacctcattatcactgataccatcaccaggcccatcctggaagggtctcaggcccaaggccatcaccaactgtggggctggcccaagataaaccacactttaaagaaggcttcactaaacattttcataggccccttgagaatgttaaaaacaaatttggaaattgagcccagtgggattgtgggtctgtactaccctacttttcagccttcttatatagattattccgatggtaagattaaaaattaagggcaaaaggctaatttcctttccagtcacggtgtaaaacaaagaccaaaataagaactatgttaggttagtttgaaatttctcactgaaccaagttaaaacaacaggtaacattaggcacttacactaagcagaagtcactgtgctaagcactttatattacatataacaacactaggaactagctaatatttccccatttcacacataaggaaacagaagctgaagagaattaaagtaacttgcccaagattatacagttatttggtgtcagagctggaagcaggtctaacttcagaggctgtactcttatcctctatggttatgatgaaaataaatgaaatttttattaaaatcacatatactttatctaaaatgaatacgcattcgtgaagaaaatgatcttaaaaatatgaaacagttaaataaaacaaatgtttaccgtctggtaatagtcccctaatccactaaatgtctgccataatccactgctgaatagctccacaagtaaataaatcatttaatgtcctgatgtatctatgaaattatattttaagtgaaccttttgaaacaatactatacattctgcaaatgaaatatgctgccctcttggagctgtgaaaatacatatttcttgatctattaactgtcctaattctgttcagtttcctcccttcctctcccacttcctctttgctctcatatcctttaagaccagttcagttcctcctcctcaagaatacctatattcacactttacccaagagaactctaacattagtttctgcgctccacagctgtaggatgttacaaaatccaaaaaatgaactcaagtaaaaaatacagtatttctgatgtaccttcaactttagatctatccacttacagaattaattataaacattcttatttttctacttcacacttggaatcctgtctttaaaatcagcacacagtaaccaaaacagcatggcactggtaccaaaacagacatataagccaatggagcagaacagagacctcagaaataacaccacacatctacaaccatctgatcttcaacaaacaagacaaaaacaagcaatggggaaaggatctcctattctgtaaatggtgctgggaaaattggctagccatatgcagaaaactgaaactggaccacttccttacaccttatacaaaaattaacttgagatgaattaaagacttaaatataaaatccaaaaccataaaaccctagaagaaaacctaggcaataccattcaggacataggcatgggcaaagacttcatgacaaaaatgccaaaagcaattgcaacaaaagccaaaattgacaaataggatctaattaaactaaagagcttctgcacagcaaaagaaactatcatcaggctgggtgcagtggctcatgcctataatcccagcactataggaggccgaggtgggaggatcacctgaggtcaggaattccagaccagcctggcctgcatggtgaaaccctgtctctatttttaaaaaattacaaaaaggccaggcatagtggctcacatctgtaatcccagcactttgggaggccgaggcgggtggatcacctgaggtcaggaatttgagaccagcctggacatggtgaaaccccatctctactaaaaatacaaaaattagctgggcatggtggcaggcgcctgtaatcccagctactcaggaggctgaggcaggagaatcacacttgaaccccggaggctgaggttgcagtgagccaagatcgcaccattgcactccagcctgggggacaagagcgagactccatctcaaaaaaaaaaaaaatagctggacgtggtggcacatgcctataatcccagctacttgggaggtgaacctggtaggcagagattgtggtgagccaagatggcaccacggcactccagcctgggagacagagcaagaccctgtctcaaaaaaaaaaaaaaaaagaaagaaaaaaagaaactatcatcagagtgaacaggcaacccacagaacgggagaaaatttttgcaatctatccatctgacaaaggtctaatatccagaatttacaaggaacttaaacatatctacaagaaaaaaaaaaccccaccaaaaagtgggcaaaggatatgaatagacacttctcaaaagaagacatttttgaggccaacaaacatgaaaaaaggctcaacatcactgatcatcagagaactgcaaatcaaaaccacaatgatggccgggtgcagtggctcaagcctgtaatcccagcactttgggaggccaaggcgggtggctcatctgaggttgggagttctagaccagcctggccaacatgtctctactaaaaagacaaaaattggcagggcgtggtggcaggcgtctgtaatcccagctactcaggaggctgaggcagaagaatcacttgaacccaggaggcggaggttgcagtgagttgggatcgcgccattgcactccagactgggcaacaagagtgagactccgtctcaaaaaaaaaaaaacacaatgagataccatttcatgccagtcagaatggtgattattaaaaagtcaggaaaacaatagatgctggcaagtctgtggcgaaatggaacgcttttacactgttgctgggaatgtaaattggttcaaccatagtggaagatagtatggcaattcctcaaggatctagaaccagaaatatcatttgacccagcaatctcattaatgggtatatacccaaaggaatagaaatcattctactctaaagacacatgcacacgtatgtttactacagcactatttacaatagcaaagacaccaaaccaacccaaatgcccgtcaatgatagactggataaagaaaatgtgatatacatacaccatggaatactatgcagccataaaaaggaatgagatcatgtcctttgcagggacatggacgaaactggaagccatcatcctcagcaaactaacacaggaacagaaaatcaaacaccctatgttctcactcataagtgggagttgaacattgagaacacatggacacagaggggaacaacacacaccaggacctgttgtgggggggcaatgagggaaggggacttagaggacgggtgaataggtgcagcaaaccaccacggtgcacgtatacctatgtaacaaacctgtacgttctgcacatatatcctgttttttttgtaagaaataaaaaaaaatcggcacacaagaaagtctgcctttcttcaaaaacagttttttcacaaattttttccataaataaaaaaggtactaaaaaaacttgaatccaaaaaaagaaaaagaaaatgcaccgttagatggtaataaatatatcacatttttggtaatgtaactcgtttattctgaatcatttctggaacttgttaatataaatgttttacaagtaaatacaatatgtaaaaatgctacttaatggactaatatgtactttcactcattcactaaacacatattttttactgaatgcccatataactttttttttcttttttttgtttgagacggagtctcactctgtcgcctaggctggagtgcagtggtgcgatctcggttcactgcaacctccgcctcccgggttcaacgattctcctgcctcagcctcctgagtacctgggactacaggcgcacgccaccatgccaggctaattttttgtattttttagtagagacaggatttcaccttattggtcagtctcaaactcctgacctggtgatccgccctcctcggcctcccaaagtgctgggattacaggcatgagccagggcacccggcacatagataactcttttttaaatgtatgaaccaagatgactctaccagataaggcacaggtgctgcagttaaaaggatcttggtttgaaacctggctattgtacttactagctcagagacctaaagtagtcaaacttcaggttaacatttcacttacctttttgatgggaagataataattactcctagggccttagtgagctttaaatgattatgtaaaacacttagcatagagtctaacatgcagttacgtgctcgataaatgacaaccatggtaaacatattttatactgaagaaagtatagttgaaggagacagccaatatgtgacccttttgtcttactaaagatggaaatttgtgaaactctacattaaaactaaaaatcctaaggttacatgattttctactttttaaaaaagatatactaactacataaggttaaaggattttttaaaataagaaagaaaaaaagaaaagcttcttgaaagctgctgagtttgggtgatgggtacatgctatttttgtgaaaatacaaattttttaacactattaatccaatccccaaaacatgcctaacacacctcctcatattcaggagagatcaagattttagccttgagatgtaccgaacaatggtaactccctgcttagtaattctgtacaggtcaagttttcttggacgagtttacctttcattacaaaggtgggcacagggaatagttatcaatgcatggaagggtgaaaaaatgcaagcttttcaactgcttattaatattacatcaaaatagcagcaatgcacattttttccacgttttcaaaaacataaaatacatccactttatttacttttgaaattacaagagagtcacaggcacagccaaaaaaagctaaaggaaaacacatcagagttgtcagtatctttaaatttggaaggacgtcattattaattcgcgtaaatgttttatgcgatgtttctaggtagcttttaggttttatcactgattaacaatatagcaaaccagcacagggagagaggcaatttttcgaaacgcttaagaagctttaaactacaagagctatgctacctaaactgagctcactaacaacgtaaaatttcaagtcacaccttgcctatttctgagtaagcaagcaaacactagtgagacaaactagaagcatggagcaaagcaagtcatttctatgctaaccttaattcctatcgtaaaggggttggctccatcaaaaaatattcctatttcagtattaacacaagtttcaaataaagcacacttgccattggtaattctagagcgacaaggcgcataattaataaatccaaacggagcatctttctatagaatacaaagccatctgcagtttcagcctcggtttacccactcactatgcatatgcagacgtctttaaaaataaataaataaatacacaaataaactttatctggcctgagagattacatctctcggtgcttcctgtatattctggaagtcaataacgctgaaggtaaatttaacatttccaactccggaggaacgcgagcggtagacgccaagcatccgcccactgtcctctcgtgactcgggctactttgacgcaccgggatgcggctcacctgacattcggcaccaacccttgccaggaaggaaaaccaactccgcgaaaataaaatgggtccccgaggaggcgtgcgggtgcccccagagctctcttctgctcacaccccgaaagcgagggggccacgccacccccgaccctcgccggcgtccgccacctgccagacgaggccgcggccagggacccgggctcggccgcaaggaaggggcagcccagcccaggccccctcggcgtctgtcccggcccggcagcagaggaaggaacccggggccggaggtttccgccccgcacggccgagcccgccaggggcctagctcgggggccgcccgtactcccgaggacccgtccccatcgtgcggagcgcacagccgcctcagcccgacccgcagagcctccgggcagcgggcgcggcgcccgcacctgccccgcgccttgctgcagccccgctagcggcttcacccacctggcgccctcgccgcgcctcccgctcgtcacagcgcgactccgcgtccctcagcaccggcagcctgggcgcgggcaggcgcggggagaccctgctctgccgccgtcgccgccactgcagctggcttggtcgtcaggccgccgcccgcgaacctgttgcgtagcctgtcacagccgctcagggctccgccggcgccgcctcagccccacaacaacatggcggccg

SEQ ID NO: 1834 - DNA, 3761 bp, Homo sapiens
cagagacagaggggccggaagttctcttcacggagccgcgcggctgcgggggcgcaaatagggtcagtgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgaggtatgaagtgaggcgaggagcacggaggctttctcccccgctggagcctgcggggcttggggagcgacgccggcccggcctcagggtcttgctccccagccagcccccgctcacctgccaagtcccctcctcccgtgacggcttcgggcctgtcccccatcctggaaagccccgtggcccccgcgagctccaccccttgttccgcccggtgccttgaggggatccagccccgcgtgggctcccgccctgcgtgggctcccgagtcacgtcgatgctggccccgctgtatcaccttcgaaaccgaatttctaatttgagcctcagcttcctcatctgtagagggagagaataatctgccttttaggttttggtgaaagattaatcagtaattcgtgtaaagaaagtagcataaggcctaccacgtaatatatggtaggtgttatattttgggccgtttggggggatatagacagtaaaaggcagcctttcctaaggacgccttgcctaaaatgaattttataaacactcccacgtaaggggtatttctacattcaattactagttcgacaaatactgagcttccaaacatcatacactgctagacactaggttataatagtgagcaaaagcagacgtggtctttgtatacatgttataccttcaataaacaattttattaaagaaaaaaaaaactgttccctgccttcatggagcttgaagtctagagatgactgttttttttttccaacctttccacattttctacaataaatatttttaaataaaaattttaaaatttttacttccttaaatccattgatctctcccagaatgttcttcacatctctctctccagagttttaaagaatgacaagctctttgaactctcatttgtttcacatctctaggccccggctgaaagggccctcacaacttaagcaggtgttttcatgccagcccagagtagaaacattgcctttagggatatgaggaggatacgtttgggacgtgagagaattagaagaataagataagtatgtacttcttttggatgaaaaaatctagctggagaagtatgggcggcctgagtacgtttcctctctgccaataccttctcccgccagactttaatcctatggtgcagtcagcgtcctcttgctaaacacagctctgagctacccttctgcctttattattattattaatttatttatttatttttgagacggagtcacggtctgtcgcccaggctggagtgcagtggcgcgatctcagctcacttgtaagctccgcctcccgggttcacgccattctcagcctcagcctcccgagtagctgggactacaggcgcccgccaccacgtgctgctaatttttttgtatttttagtagagacagggtttcaccgtgtcagccaggatggtctcgatctcctgacctcgtgatctgcccgcctcggcctcccaaagtgctgggattacaggcgtgagccaccgcgcccagccctgcctttttattagtagtattgttgttgttttttttttttatggagatggggtctcattttgttgccaggctggtctcgaactcctgggctcaagcagtcctcctgcttcagcctaccaaagtgcttggattagagttgtgagcccagcctcttctacttttaactctcatagtctttgtgattcatatcccactacccctctccccctaacaatatgttcctgccacacataaccacttgctttcctggaacacaaatacttgggcctttttgtctgcatgctcctgcatgggatgcccatcttcactcattcctgagcctagttcagatatcacctgcctctagatagccatctctgacattccatgccaggcagagttgattcctccttcctgtgatcccatatatctgggaacatatatttactagaactttttcacttcattttctaattactttttcctcctctgttctttgtgtccggcttctaggctgttttattcaaatttgtatcccagtgtccagtacagttgtctggcatatagttggtggtaagaaaaatttgaaagatacttctccctctgctctgccccacagtgtgactctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccacactgtgccttgtgtttggggcttgatagagtgtgaaaggtgtgttgcttgaaaggtgtggccttagacactaggagatgatgggtagaagctccttgagaaacctagcagtggccatagagaagtagactgggtatggggaacctaagtcatagttgtaacctacagctgattggtaagaactatgggccagacatttaatctctccatctatgaaatagtccattctcatttatctaccttaggttatgggctcttcttttagttggatattcacatttatctttcagtgttaactgggtatcagttatgagtctactactgtataatggcatccaaaagaattttaaagtacctcggtttatagggatttacaattcagtagaaacttgttattcatgtgaaacagtgaacataatatctaatgatgtggagcaagtacattaaaaacaggaaggaagagatctgtgattaaactaaaggccctttcacacctaa

SEQ ID NO: 1835 - DNA, 23249 bp, Homo sapiens
ttccactgaattcctttattcagtcaacaaacatttccagagccccctctgtactgaggcctcagcccagcccccaaggaaccctgaggtcaggggagacagctggacacagacacttccccagccccagggccagagtggggctggagggaaggacagggctacagtagtagtgggggtatatgagggaaggctgcaaggatgtggtagctggagttttgagagatggataagagttttccaaggaggcaaaagtggcagaaaagctttgcaggtgaggaggagcagcagaagcttaacctgcatgagaatccctctcaccagtcagaaagttgaccctgcacagccaaggggtaagctctgaccattttgcaggggacagaactgagacccagagagggaaaggaacttgcccactgtcacactgcatggaaggggcaaaactgtaggctccaatacttgggctcttaacctccttactctgagccttctcacgcttggcatgctgttccctctgccaggaatgcctttccttcccttgattgcgtgaaaagttcctgccaggtttggtgtcatccctttgtgccccttgtagggtgaggacagaaagggtcccattggacaggtgggaaaactgaagccctaggacactcagataccattagggtggactgggaccccagcctttcctgccccctttcaggatcccaaagagatacacgggctcccctaaaaggcagagtcccagccacagcaactgctcttgtccttggcttcctccagagaaacagagatcggggagcagaagtcagatcatacatttaaagctacatgagggccgggcgcagtggctcatgcctgtaatcccagcactttgggaggccgagacgggcagatcacgaggtcaggagatggaaaccatcctggctaacaaggtgaaaccccgtctctactaaaaatacaaaaaattagccgggtgtggtggcgggcgcctgtagtcccagctacttgggaggctgaggcgagagaatggtgtgaacccaggaggcggagcttgcagtgagcctagattgcgccactgtactccagcctgggcgacagagcgagactccgtctcaaaaaaaaaaaaaaaaaaaaagctacatgaatgtccccattggaaataagacaggaaactcaaaactaggtgctgtagtcccagctatttaggaggataaggcaggaggatcactgtagcccaggagttcaagaccagcctgggcaacgtagcaagatcctgtctcttaaaaataataataataaatttaaaaaaaaaaaagcctgggtgcagtggctcatgcctattattccaacactttgggaggctgaggtgggaggatcacttgaggttaggagttcgagatcagcctggccatcatggtgaaacctcatctctattaaaaataaaaaaaattagccgggtgtggtggtgcacacctgtaatcccagctactcgggaggctgaggcaggagaatcgcttgaacctgggaagcagaggttgcactgagccgagatcgcaccactgcactccaccctgggtaacagagcgaggctctgtctcaaaaataaaaataaaaataaaaaaaataaaaagagagagacagaaaaggaaactcagggggccagggcttaaggggttgggaagatgcgagagtcttaaatttggttccttgcttctttgggccaggactcagagagccccactgacacatatgcccatctgtcttgaaccttaacaaattgcaaaggccacaggctattctacaggccacgggagcccccccaaatgcaatgtcatgggggtgttcctgaagtagaggaccctcataaggcctctgaggcccagagaggggcagctccgggcctaaggtcacacagccagtcaacagagacctaatccagaggtctgcgggcaggagctatgaaaaggacagggagtggtgtttgccctctgggtgagcagtgaaggcatgagtctcacacccccggcttccgctccacagcatgtccagctgggggcccagggcgctgaatgatggccggtcctgtgggctaggggcccagcacagcttcatgagctcgtgaacctgaggggcgggggacagataatggggtcgtgcctgagcagtccaaaggacacaactcccattcagcgtatttgtttttgtttttttgagacggagtctagctctgttgtccaggctggagtgcaatggcatgatctcggctcactgcaacctccgcctcccgggttcaagcaattatcctgcctcagcctcctgagtagctgggattataggcacgtgccaccacgcctggctaattttgtattttgagtagagacagggtttcaccatgttggccaggttggtctcaaattcctgatctcaggtgatccacctgtcttggcctcccaaagtgctgggattataggcatgagccaccgcactcattcagttttaaaacacaaattaaattccatcccatctctgctccaaaaactcccatggctccctatggatcttacttatttatttatttgagataaagtttcgctcttgttgcccaggctggaatgcagtggtgcgatctcggctcactgcaaaccctgcctcctgggttcaagcgattctcctgcctcagcctcccaagtagctgggattacatgcacacaccgccacacctggctaagtctgtatttttagtagagacggggtttcaccatgttggtcaggctggtcttgaactcctgacctcatgtaatccacccacctcggcctcctaaagggctgggattacaggtgtgagccaccgcgcccagcccttatggattttacaacacacttctcctttcgagactaccctgaccaacatggagaaaccccatcttaactaaaaaaaaaaaaaaaaaaaaaaaaaaaaaaaaaaaaaaaaaattacaggtggcgtgtgcctgtaatcccagctactcgggagtctaaggcaggagaattgcttgaacctgggaggcggaagttgtggtgagccgagattgcgccattgcactccagcctggccaacaagagcaaaaccacgtctcaaaaaaaaaaaaacaacaaaaaaacaccacctctccctgatgccctccttcgctcatctccatccctccttccctcatttgttccgggcagtcacatctgcctccatcgcactggtgcttaaaggcacccagctcattacctccccaaggcctttttcccttccgtgtcctccactggaaatttcttctcctagctttactcatgggtaggctcctcctccttccagcgtcggccccgtaagaggccctctttgaccacccccaccccaccatttccctctgttcatctctttcaaggcacttatcactaccataattttgtctttgttttgttttgttttgttttgttttgttttgttttgttttgttttgagacagggtgtcactctgttgtccaggctggagtgcagtggtacaataatggctcactgcagccttaacctcctgggctcaagcaatcctcctgcctcagcctccctggtagctgaaaccacaggtgcatgtcaccacaccggctattgcttgtattgtttgtagagacaaggtctcactatgttgcccaggctggtcttgaactcctgggttccagtgatcctcctgcctcagcctccctagtagctgaaaccacaggtgcatgtcaccacaccggctattgcttgtattgtttgtagagacaaggtctcactacgttgcccaggctggtcttgaactcctgggctccagtgatccttctgcctcagcctcccaaagtgttgggattataggcatgagccatcgtgcccagcctagaatgttcttatcagattttgctagttactgggaggacagggtcttcagcacccaacaagtcctggcacacagttggcactcaataaatgtttttggcctgagcaaattaatttatcaatgaccaactgcatgtcagacacttccacaaaggttatgattatatgattataaaccatgagagggtgggatgtggtggctcacgtctgtaatcccagcactttgggaggccgaggcaggaggatcacttgaccccacgagctcaagaccagcctaggcaacacagagagaccccatctctttaaaaaaattttttaaaattagccaggcacagtggcttatgcctgtaaatctcagcactttgggaggccaaggcaggaggatcgcttgagcccaggagttcaagaccagcctgggcaacatagcgagaccttgtctcttaaaaaaattatttttatcttatttgtttgtttatttatttatttatttattttgagatggaatcttgctctgtcgcccaggctggagtgcagtggcatgatcttggctcactgaaaccttcccctcccaggttcaagcaattctcctgcctcagcctcgcaagtagctgagatcacaggcacccacacatgggtaatttttgtatttttagtagagacagggtgtcaccatgttggccaggctagtctcgaactcctgacctccggtgatctgaccgcctcagccttcaaaagtgctgggtttacaggtgtgagccaccacacctggccaaaattatttttaaattagccaggcatggtgatgtacacctatagtcccagcactttgggaggctgaggcaggagaatcgcttgagcccacgagttcaagaccagcctgggcaatatagtgaggctcccatctctaaaaaattatttttaaattagccaagtgtggtggtgtacacctgtagctcctgctactagagacactgaactaggggaatcacttgagctcaggagttggaggctgcagtgagctataattgcaccccagcctgggcaacagagtgagcccccatctataaaaaagaaagaaagaaagaaaaaaaaaaaccatgaacgtcaccaccatttatggagcatcgactgtgtgctcggctttgagctgagccctcataggcacaggtgttcaggagtctaatcttccctcaccctataaggcattactattctcattttggaaaagggtaaactgaggctctgaaagtgctctgacttgccacacagtgagagagtagccaagtgggggccaggatcctcatcggcctcacactctagcctttcttctcagtacagagactcaggcgccagctggcttgcccgagaccccggcccaatctacagactgggaaactgaggctagccctgcggcgctcacctcagcagggcaggcaggaggcgccggcagcctctggccctcctccagcagttccaagaggcggcagagggcggggacatcccgctcacatcccatcatccgcaggaactcctggagccaaggaggagcgcatgtggtgggggaggagcctccgtgggtggagggggaggggccacccgtggtgggggtaggggccatctgtgatggagcggggaggggctgcctgaaccgtgaaggggtcagaaaggtgaggaagcgtcctccccactggggcctatgatgctgggaccaggtgaccccatgctaaagagggacgcaggcgcagacaggttggagattggccacgaggggcgtggagggagaagaaggctgggggctctgggaagccgactcacggccgaggggctgcagcttttgtcgcagtaggtgaagagctcgtacaggacgaccccgaagctccagacgtctgactggcgagagaagatgttgtccgagagggattcgggggcatacctggagaggggacaaggtcttgagatgcgagggtgtagaaaggacaggaagaggggggcagccttggaatggggaactggtcagggtaggtggggactgtgagcaggtcagtcccgtctccagggtctcggtttccctggctgtgggataggtggattctccagccctgggaggtgcctgggaagagctaaggctgtggggaggaggcgggggcagcacggaggggcggagatgggggcggggccagagccgtgggagggggaggggccagaactgggcggggggaagggcggaactaagagggggccagccctgaggggcggagccagcgtgttggaggggtggggttctgaagcttgggcggggcgagagctgagagaagggcggggctaaggctgggggccgctgacagcagggcagcgggagacagaggagccagtgctgttgagggggcggggctctggggagtgggaggggccaaagctgcagcggaggaagggcggggctaaggctggggagcaaagcagcgggagggggcgggggcatggctgggggcggagccagagccgtggggaataggggcggagcctaggcgcgggttccccaccagaaaatggggctctggcctggctcgcggaccacgtagtagtctttgtcaagcggcagcagcttagctaggccgaagtcagcgatcttgacgtgtgcctcgctctccacgaggatgtttcgggcggccaggtcgcggtgcacgcagcggcgggagcccaggtactccatgccctgcgggcgggcggtgtgagcgtgcagagaggatcccaggataatccggcaggtaccccaagcgtgacctggcaccccaacccagaccccaactataaccctacccccgagccatcctccactgaagttctgatcctgagccctaagccaaccccaccactcccgagacctggaccccaaaccactcctcagccttcaccgcgacctccaagcagacccctgcccaggccgtgccagctgaatccccacaagtcccggggcgccccctcgcaccttgcagatctgcgaggaatagagaaggaggcggctggcatcgaggcgcgcgcggtgccgctgcaggaagtcgcgcaagcagccgctgggcaggtactccatgaccagccgcaggctctggcggcctggagaaggcaggatctgtcacagcagggcccagccctgctcgtccccccattcttcccccctttcacagtgggaccttgtgtccctctcgacctcagttttgctgactgtaatatgggaaccgcaacaatgacacattgctaatatctcttgagtactttctacaacatacattgatgtgtttatatatcacggccaggtgcagtggctcacgcctgtaatcccagcactttggaagcctcacttgaggtcaggagttcaagaccagcctggccaacatggtgaaaacccatctccactaaaaacacaaaaattagccgggtgtggtggcacgctcctgtaatcccagctactctggaggctgaggcaggagaatcacttgaacttggaaggcagaggttgcagtgagccgagattgagccactgcctccagcctgggtgacagagcgagactctgtctcaaaaaaacaaacaaacaacaacaacaacaaagtaaatatcacaatggcccatttttcagctggagaaactgaggctcagaaaagttaaggtttcacaactggtaaggggtagagtcaggattcaaacctgtaacccatgtgaatctggatcaataatcacgttcccagcctacctaaagtggcctggcaggagggtaagaatgtgcactttgaaaagcacccatacgtcttggttcactcatccgggagctggctcacccgggccatagctgacaccacgatacttgacaatgaaatcactgtgcagtgctttgaggatctgaatctcccgctgaaagtccctctgctggtctggcccgctgtgctgcagctgtttcacggccaccagggcacctgtattgtcgcctagcgggtcatagcggcacagctccacgctgccaaagttgccctgggggatagcgggactgatgtccaggcacctggatgctgccctgccctctccaacccaccctggccctgcccaccttaccttgcccagctgtgagatgtacttgaggtgtctctcctcgaagatcgtggggtcttggcaggcatagagctgggcaccattccacagcccatcacgaggtgccagggcaccaggtgtggggtctgagaggagctcatagtctggggtgggggcatgggcagtggtaagcagcgcctctcatcctgggccccactcctgagttgacttgctgtgcaacctccatctgcatattgaccctctctgtgcattatggcagggccattgcaagccaaagggtaccttgtggagactggaaaaaggtgtctcccactctgtcccaggcaaaggaagcctcctcgtgcagtgcacaccctgtgcaactccacatggctacaaagatggaggacataatgagaactcatttccccagttccactgctatgaaatgtggccacatgactgagctcaggctgatggacaagatatgctgggtgcccctccagtcctgacccatggaaacctaatacggggccctccacactctctcttttatctgcagaggatccaacggggacccaacgcctgaggtgagtgcagccactaagtgagaggttcctgtgggcctggacaccctcattgaatgaagactaaatatcacactgggcatggttgtgtgtgcctgtaatcccagctatttgggagactaaggcaggaggattgcttgagccagtaattcaagaccagcctggggaacatagcaaaaccccatcacagaaaaaaaaaaaaaaaaaaaaaaaatccagcctggtgtggtggctcatgcctgtaatcccagcactgggtggctgaggtggacggatctctttgagaccaggagttcaagactagcccggccaacatggcaaaaccctgtctttactaaaaaatacaaaaatttagccgtgtttggtggcacgcccttgtaatcctagctacttgggagtctgaggcgggagaattgcttgaaccagggaggcagaggttgcagtgagccaggatcacgccactgcactccagcctaggtgacagagggagatagtgtctcaaaaatataaaataaaataaaataaaaatgcatacaggcatgcatcaccatgcctggctaattttctgtttgtttgtttgtagagatggagttttgccatgttgcccaggctggtcttgaactcctgggctcaagcgatccacctacctatagctggaactataggcatgagccactgcgcccagccaaacatttttttaaaagaatgaaatagaccagacatggtggctcacacctgaaatcccagcactttaggaggtagaggtgggcggatcacctgaggtcaagagttcgagaccagcctagccaatatggtgaaaccccatatctgccaaaaatacaaaaattagctgggcgtggtggcacacactgtaatcccagctactcaggaggctgaggcaggagaatcgcttgaactagaggttcaaggaggtagaggttgcagtgagccgaaattgtgccactgcactccagcctaggcaacagagcaagactctgtctcaaaaataaataaataaataaaatatcatcatgttgaaccttgaactgaggggactgttcgttacagtagctgttgaagctcacactgactgtcacagtcaccaacccctccaacctcaccagacacacagggcgtggcctgctgcaaaccacgctccttccactgggcccaatatgacatcacagccctccccacccaacccgtcccagcgggcacctgaagagatgaggctattgaggtcacgaatgacggctcggaaggagggcctctggaccggctcataggccatgcactgttgaatcagcagggccagctctgtccacttgggggccggcagctgctgccggtcctcataaaattggagtttctgagggtgagaggagcagtcggtaatccccaacccaatagacccaccccaatctccccagactggatgtcagtctgcccttctgtcaaagtgggggttcggagaccgatgccgggtgaggggctctgaccttagcaggatccagggcactgatgggcatggtgacgccactaaacacttcccagaccgtggcgccgaagccccacttgtcagcttccaagctaagtgtctgcgcctcccggagacactcgggggccacccaggggatcctgtcggtgagcactgagggaatgaaagtgggatcagggatccacttccttgccctgctcagcccctccctcctccacctccaggaacttactctccaggcttaacacagcggggctgaccccagggtcactcagcttgatgaagggcgggctcccatcagccccctcccgagccaggagcaccttccgggcagagacattgccatggggcaggcctttgtcctcctaagggggccagacacaggaaaatgcccgggagggtttgatgaatgaagagtctgtttggcaaactcctatacatccttcaaaacccacttggtactgctcagacatgctccagcatcgtccctgactcctgacatcctgtcttgcccctctagttcaccccctacactgacctggctatgtccctccccttctcaaacaccaccccatcctgtgactccccagtgcctttgacacaaagtgaaagctcctcagcctggcattcaaggcccttgctcaagcttccaatgaacttcccttccacacttgcaccctggtctcctgccaacagaactgcctgataggccccaggggatgcaacacactatctagcctgcaggcctttgcctaggctgttccctcagcctgacattccttccttcctttcttctcttgatgaacttctactcaacttttaaggccctatctccaatgttccttcttctaggaagcctttcttcctgcccagcctcgtcattcaccacacgccctgacatccaagaatgacttgttctcttctagtgttctcacaacctgaacctaaaatgccctcccctcgaacccttaccaaactcctatgcatactacagagcccactcccaattcctcttccacccagagaaagccttccctgggaatggagggtggagcaggcagaggagcactcaccagatagttgagggcgtaggccagctgtttgaccacctgcagcttccagctggctggcaccaggtggccacgttttcgcagatacatgtctatggcccccaggtgtacaaattcctgcaccatggtgcctggttggcagcagggagaggcggggttgggagactgaactgcacttgtgttgaggaggttctgccaacaccctggctctcagggtctctcaaactctcatctctgtctgttccctcccctgctgcctctgttcatacagtactcacctctcctcccacctccatctctgaatgatttgcctggaatgcctggaaggtgttgagccctgtctgtatctgtatctcacttttttttttctcttttcttttgagacagagtcttactctgttgcccaggctggagtgcagtggtgcgatctcggcttactgcaacctctgcctcccgggttcaagtgattctcctgtctcagcctcctaagtagctggaactacaggcgcatgccaccacacccggctgattttgtatttttagtagagacggggtcttgccatgttggccagactggtcttgaactcctgatctcaggtgatccactcgcctcggcttttcaattacaggcatgagccaccacgcccagcctctgtatctcacttctaaccctttgcatattctgtgtcctctgcctagaacacccctcttcctttcctaatccacacttgtccttatctttccaggttagaatgcatctctgtcttcccacaagcattgcccaacccccaggctggcccagcagcctctctgaccatccacagtgctccgtgctgccctcctcacacctcatcacaccctgcctgtcacattctaggctctgtcccagctcctggcccatcctagactcccaaccaatgaaaccaaggctcagaaaggttacgtgacctgtacaaagctgcagagattagaaagccaggtttgtctgacttcaggtcattctggggctggatatgggtgagaacctggagccgctttccaaggagtgatgatggagagacataaataaagggtaatgaacacggctcccatccagggtggcccagtgtgttgctggggctgtcatatagcggctcagaacagaggtgggaagaacagcctagacttgggtgaggcaggggtggggtgggtgggtggggggctctcactgtctccagccatgcacacgccgtggagcagcacgagatgccggtacgacacttggctcatcaagctcgctgcttccaggaatgactggggaaggtgggaagggagagaagatgcgtgggtttcttccactccaataatcccaaattttgtgctcacagacctgccttaggggaacacctggccacaggtcacctttggccctggagtctgccattagtgcacacagcactaccatgattttctgatacgggacagaagttcccactatcatctatggttttttgttttgttttgttttgtttttgagacagagtctccctctgtcacccaggctggagtgcagtggcgcgatcttgactcactgcaacctccgcttcccagattcaagcaattctcctgcctcagcctcccgagtagctgggattacaggcatgcaccaccacgcccggctaattttgtatttttagtagagacggggtttctccatgttggtcaggctggtctcgaactcccgacctcagatgatctgcccgcctcagcctcccaaagtgctgggattacaggcgtgagccaccgcgcccggcctaaaatttttttgtcaagacgaggtctcgctatgttgcctaggctgttcttgaactcctggcttcaaaccatcctcctgcctcagcctcccaaagtgctgggatgacaggcatgagccaccacgcccaggtccctgtgtgtttttaaatttctctgcatccacgaccccctctccagccagccccgactccaaaagtctggtccacattgctctcacctccatgcagttcttgtgcttggcatccatgaccttcagcagcacctctgtctttcgggcctccccatccaccacctcatggcgacagccccggtaaatcttggtgaaggacccatggcccaggttctcatgctgaatggtgaggggacagcagaagaggccagtgagggggttcctgcaggatcccagcccaagcgagacatagctgctggccccattttacagatgggaaaaccgaggcaaggtaaaattatagcatatgcctgaggccacgcatctgagtctctggaccccagactgaggtatcgcctcatttcccagggcctcttacccactccaggctgtcagcagggatcttgtgaaatgtcatctgactcagctggtattgggattggggctgaaccaaggatgatgtgggtgggctgtgacctctctggaccacgatcaggttggacttttctatggggagaggatgagggagaaaaaccagaaatcagaggtgaaaagtccccaagggttagctaactcatgccttagtttgaggtaccctctagaagccgaccctgagatgaagacttcagggcacatggctttttgttgttgtttttgttttgttgttgctgctgctgttgagacggagtctcactctgtcatccaggctgggtgggcagtggtgcgatctcagctcactgcaacctccacctcccaggttcaagcgattttcctgcctcggcctcccgaatagctgggactacaggtgtgtgccaccgtgcccggctaatttttttttttttttttttttgagacagagtctcgctctgtcacccaggctggagtgcagtggtgtgatctcggctcactgcaacctctgcctcctgggttcaagtaattctcctgcctcagcctcccaagtagctgggactacaggagtgtgccagcacacccagctaatttttgtatttttagtagagatggagtttcaccatgttggccacgctggtctcaaactcctgacctcaggtgatccatctgcctcagcctcccgaagtgctggtattacagacgtgagccactgtgcctggctggcacatggtttatttgaaaggagatccagaaagcccccatagggatttgggatgagcgacaaggaaggaaggagccctgcagggggctttaatgagcaagtggcactgtggacaaccagggatcggttctaccagggattctgggagactcagaagaactcacatctcagaattgtcccatcagaggggtttgtccaggagtgaaattcacccagaggaagagctgagagctggagagagactaggtgcagatgacatggctcacatctagctgtgcctagatcaagccagacctaaaggttatatatctctaacttcctgagccaacaaatcaccttttcttccctaacccaccttgacctgcagtttctgccacttgccacccacacaggagctgtcacagacatagaaagccagggtcccagatcagccactcattccaggggaggaaggggctcacctttgggtctggggatacagcaggaagtgagggtcactgccaccccatctacgtgcagccccccatcccagcaggttgccaggagctctcgaagactgctgtggggtcggctgaggccaaccagaaggaaggttcctgtggggctgcgccggatgaggcagcccttataatcaggaccaagggggttctgcaaagaagagtggcccctgagtgggactgagcgacagacactctccttctcagtccttcttccttttttttctttttttttttttttttttggagacggagtctggctctgtcacccaggctggagtgcaatggcgtgaccttggctcactgcaacctccgcctcccaggttcaagcgattctcctgcctcagcctcccgagtagctgggactacagatgcccactaccacgcccagctaagttttatatttttagtagagacagggtttcaccattttggccaggatggtttcgatctcttgatctcttgatctgcctacctcagcctcccaaagtgctgggattacaggcgtaagccactgtgcccagcctcagtcctttctcctaaagcaccatgaactcattccagtctttagacctttgaatatgctgttctgttcaccgggggtgtcttttccctcctattcttcaggaaccaaatgctgactgatcttttaaatctcaattcaaacgtcacctcctccaggcagccctccactacccaccctagcagtagaccgacctggacacagacagtgaggaggaagctgtcaaagtcctgggggctgcggcggagaacataggagccaggacgtgagcccccagtcttgagcttgttgatggcaaagtccagactgtgggggaaggtgagagggaatggggaggagtcagagatagaagaagacagagagacctgggctcaaattcaggtacctctgtagccctgggatccttgccaggtgacaccctccccccatttataaaatcagccatgggccaggcgccgtggctcacgcctgtaatcccagcattttgggaggccgaggcaggtggatcacgaggtcaggagatcaacaccatcctggctaacaccgtgaaaccccgtcgctactgaaaatacaaaaaaatagccgggcgtggtggcgagcacctgtagtcccagctactcgggaggctgaggcaggagaatggcgtgaccctgggaagcagaggttgcattgagccgagatcgtgccactgcactccagcctgggcgacagagccagactccgtctcaaaaaaaaaaagaaaaaagaaaatcagccgtaagtcttggcctcttctgggagattgtttgtttgtttgtttgttttaatagagacagggtcttgcttggttgcccaggctggagtgcaatctcagctcactgcagcctccaactcctgggctcaagtgatcctcctgcctcagcctccggagtcgctgggactacaggtcaaccaccacacccagctatttttttttctttttttgtagagatggggtctctcctgttgcctagacttgtctccaactcctgagttcaaacaatcctcctgccttggcccctcaaagcgctgcgattgcaggtgtgccccactatgcctggcccttcctgggagattaaacaagaggctgtaggtgaaggtgggcgacttgtccatctccaggaaatggccctggggtcagagagagagagagtagtggtcgccctgtgaagcagaaggaatacttcagcttcactgagcgctgactgtgcggcaggtgtggtttgaaaacttgacccctgtccagggctcctggaaggtgaggacactgaggcatagagaaggggaggggccctgagtggccacagaggccgggaatgggggacaggtccttacgtgatggggccgtggcactgctcggccacttcctccagcagcctcggcggtgccacctccttgcagaagaagtgctgggagtccgtggtcagccggaagtagccgtccacgagcgccacgaacgacagagcctcgggcagccctgggaactcggcctcctgcgagggacaagcgtcagagcccagtgaaacccgagggtgccggtcccgccctcggggtaaggctgaaggggaggggaatcctgcacccactaaaatctggttgtctgtcctggtaacagtgaccaggcggtgctctccggccgggccaacgcgcggggcctgcttgatgctaatgtctacgatttctggaaagtcgcagaagggctggaggacctgggaaggagggggagtaccgaagtgggggcccagctggaccccgccaaaccacgcccatgaacccacccccaagccacaccatccactccctatccctttgccattcaacccttccaagccgcgccccctcctatcaactccaacctctcaacacctcccctacccatccccaaacatctcccacccgctctgccaatccccgcctccttctctctgccggaccccgccccttgatccctgccccgcttcgcagcctcccagctctcggagcctcactctgcctcttagtcttgcctcgttccagcgcccacccacccactcctcaacccctcccattttcattcccgggtcgctcagcccaacccttcactcagtttgcccctcccattcccgcagtctcctccctcactaagccccgcccctcattaagcctcgcccacttccccaagtctttcgttttggctccgccccacatcccctaccactctccggcccctccccgagccccgcccccacgttggccccgcccagcgggggagtccgccctcacctcctgttctccctgggtccaggcgatgccgccgtcaccagccacgcggagcagccccagcccgtcgtggccaccaagggccccagggaggcccacgtggaaggtctcggcggccccggctggatccagccgctccaggtccatgatgtacttggccatgagcgagtgccggtctgcctggcaggcggccacgcggcgcagggctctgcgcaccgtcctccgaatacgcctccgcgtcacgaagctcaggccctggatcaggtcgcgcaggcttgggggtaggcaggccttgtagctgcaggggttggaggggagggagccggccctcagcgtcgggaggggtccccgcggggacacacacaaacccaggctttagcccaggggctggggtgcggccctagttggggcaccaggcacacacagactctcattcagggtcaggtatgaggaccggacctcagagtaggggagggccattggcgcccacaggtcggacagggaccccacaggccttttagctgggggaggtcaggtgtctgtccagctggagcctgggggtggagagggctgggttcgtgggaggccctgggtcataggaacaccctgaaagcttgcaggagaactccatggtgggagcccggcaaagccccgatggagcccacgttgctcactcccaagcagaggccgtccccacagcctggtggctctcacctgacagtcttcagcagctctcccggccgctgggcctgctctcgcgccatccgggccaggtccaacacggccaggctgagacactcaccctgctccttgagactgaggcccacggggaggcgcccactcaccaggtcactgcggtgctggggggccgccacagggagcatcagctgaggccacccaacttcaagccctgttgttaacctgcagacccccccaatcctgggctgacccccacccctggactgccacagggagggtcagacgaggccccacctgattgcatgccagtcctcatgttgccccttggacccccaaccccctgggtcaaaccccaggcagaaccccacctgggcaaagaggtgctccaggactggcaggtcaaggatagcactggccaaatccttgcgtagcccgaagcggtggcacttctccagcccaaaccaattggggaagtaaaagctgtgaggagaggagagaaccctgggatgaaagtgcaacccagcctcagtaggagtgacattatggtgggggcgagggacagattctgcggaggcctcacagagcccagcttgtacctttaacttgctgtgtgaccttgggcaagtgacccaccctctctggtctgtttcctcatctgagaaatgggtagtgaccatacctccctggggcaggggtgtgggcacctcgaaatgcaaggagatgataaaattgtacaatccctgggggctggggggcacttcctaccgaatcctgtacagcaggacttgggtgctggcatcctccacggagaagatgtggctcggggggaaccagcaggacaggtcctccgtggccagagcaaagagggagtggtacacaggcaggatgcctacaggggatggtcccatcagctccctcctgagtcaccccatctgtgcccttcaggagtgccagcatcatacccaaccgtccagatccttccatacctcaaggtatgaccagctgttcccttcatgtgccgtcacacctctccgtctgcacaggccattccctctgcctcagaagccaaccctgcacacccttctccattacaaaactcctactcatcccccaaagccccagctccgatgctgacttctgcaggcaactattccagcttccaatcttggccccacacagccccatccttccctctggcccgatccactagggatgcactcaccgctggccttggcagcctgcacgcacaggtcctcagccaagtggtccccaaaggagaaagataggcgctgggggggcccggggccccgagcgggcagcagcacatgcagggcaccagcctccgtggacaagaggctgcatgaacgctgagggatcaggggcgtctcttcacttggaggtgccatgagtgcaacttgcctggggcacagagagaaaaagcccctcagtcctggtcagaggggattggacttctgagcagggagggcatggaaaggagtgctggaggccgggtgcggtggcttatgcctgtaatcacagcattttgggaggccgaggcgggaggatcacttgaggtcaggagtttgagacctgcctggccaacatggcgaaaccctgcctctaaaaagtgcaaaacttagccgggtgtggtggtgcgttcctgtaatcccagcaactcgggaggctgaggcaggacaatcacttgaacctgggaggcagaggttgcagtgagccaagattgtaccactgcactccagcctggacaacagagtcagactctgtctcaaaaaaaaaaaaaaaaagaaagaaagaaagaaagaaagaaggaaagcctccctgggatgggcccaggaggaaactggccccctgcttccagcccccaacacctcccacccgctcgctcacttgccctgagaaacctcagcactcagggccctcagctgggtggggccaggggtggggcttcgagtcccctgagaaaaattggggagaaaaaggaggtcactcaaattgacctgaatgaagaagatctgaagaaagtgttgggaaaaacaaacaaaaacctaagttccagcagggcgcagtggctcatgtctgtaatcccatcatttccggaggccaagaaggaaggatagcttgagaccaggagtttgttttatgttttttgcttttttgagacagagtctcgcgctgtcacccaggctggagtgcagtggcgcaatctcagctcactgcaacctccgcctcccaagttcaagagattctcgtgcctcagccaccccagtagctgggattacaggtgggcaccaccacgcccagctaattttcttgtatttttagtagagatggggtttcactgatctcaaactcctggcctcaagtgatcagcctgcctcagcctcccaaaatgctggattacatgtgtgagccaccgcgcctggccgagaccaggagtttgaaaccagactgggcaatatagtgagacctcctctcaaaaagaaaaaaaagccttgtaatcccagcactttgacaggccgaggcaggtggatcacttgaggctaggattttgagacctcatctctaaaaaattagcagggcatggtggcacacccccatagtcctagctacttgggaggctgagacaggaggatgccttcagctctgcaagttgaggctgcattgagctatgatcacaccactgcactccagcctgggcgacagagcaagaccttatctctagaaaaaaaacacaatacaaaaactatgatccaaaataatgccctgtggctggggtggggcggcattaatgagggtttttttgtttttgttttgagacagagtctagctctgtcatccaggctggagtgcagtggcacaatctcggcttactctgcatcctgggttcaagtgattctcctgcctcagcctcccaagtagctgggattacaggggcacgccaccatgcccggctaatttttgtatttttggtagagacggggtttcaccatgttggcgaggctggtctggaactcctgacctcgagtgatcctcctgcctcggactcccaaagtgctgggattaccggcgtgagaaactgcgcctggcctaatgaggtttaagacaatcagaggactaggacccctaggactcagctttcgcagctgtgaaatgggctgactccccagcatcctcattgaggtggtctgctgagcgcaatccaggcctaaagtgtcaactcaattaatgtgcattaatttgtatatttcttgatgatgtgccggtaagcgatcaacaaacgcctgttaaaccaaacaggaagggcaattggcacagcggtgtggtggttactgtgggaagggaagtcttgtgggggaaagaaccttaccaaagggacactttgatgtcaccgatgcccagaccaagaatgagcacattcctagtcccgggaaccttggaggagccccatctctcccacagagagattgatgtctagttttgccctttatagaaataaaatcacacaccatagcctctctatcgtcccctcaacatcagccaatcaagttttttggtttgtttgtttgtttttttgagacggagtctcgcactgtcacccaggctggagtgcagtcgcacgatcttggctcactgtagcctctgcctcctgggttcaagcgattctcatgcctcagcttcccaagtggctgggattacaggcgcgcaccacagcgcccagctaatttttgtatttttagtagagacggagtttcaccatgttggccaggctggtctcaaactcctggcctcaggtgattcgcctgccttggcctcccaaagtgctgtgattacacacgtgagccacattgcccagcctttttatttatttatttattttgtaggggggaggacggattcttgttctgtctcccaggctggagtgcagtggcatgatctcggctcactgcaaactccacctcccaggttcaagcgattctcctgcctcagcctcctgagtagctggaattacaggcacccgccaccaaacctggctaatttttgtgtttttagtagagatagggtttcaccatgttgaccaggctgatctcgaactcctgacctccagtgatccgctggcctcagcctcccaaagtgttgggattaaaggcatgagccactgtgcccagccccagtcgagtttaaaataaggcttcagtggcagtggcgccccactgcaatcccagctactcagggggctgaggcagcaggatagcttgaggccaggggttagagacctgcctgaacaacatagcaagactcccatctccaaaacaacaaaaaaatcttaacagaatattattattctgtaatactgtaacaaaaaaaaatgaaaagtcagaggtgatgtttggtcccagaaaacgccatagtttttttggttttttaaaaatgtttgtagaaatggaggtctggctatgttgcccaggctggccttgaactcctggcctcaagctatcctcccgcctcggcatcccctgtttataatcctcaacgttctgcatcctggtatggtcgggtaccctgtgtctggaccgggaaggcctggagggtaggggctgggaactccgccccccaatccctccttcccaatccctcctccccacccccaaccccgcagcccccgtcgcgcatgcgcaatgactcctccaggtccgcaaggcaggcatctcccggccttagtcaaagccgaagcccagagaagcgagcgatcggaggatgcgagtctcggctcacgtctgcctcgcagctttcctccgaggcctggaaggcgagctagcctttgccctggcagcaccctgccccagcccagccatcccccgccaccaccatcctcccccagtgtctgggccgagccctgcggcatcgccagctcttacctagcgggcagggaccctggactttcgaagggcgggcagagccgggaggcagcgagaggaaagtcccactcggctccttcctgtgtg

SEQ ID NO: 1836 - DNA, 91114 bp, Homo sapiens
acgtccctcgtggagccgccgacgtcagcagtcgaatggcaacattgtggcgatgctgaggcgcagagtttaggagacgggttcatcagtcaggccggctccgggctttctgcagcagcaccaggggcgggggcggggatcttgacctgggcgagcgaccgggacgcatacagcgccggcctgaccccgcgggacccgcgcctcaccaccggagcgccgcagacgcagctccacggcctcgcgcggggggcggcgggcggccgcgaggcgctgcggcagcgcggagcttgtaaacagatccggccgcaggtgaccatgtgaactacctgctcccgggacgcttattgtccttctctcgatccgcgccacaaaggagctcggcggtcggggcgcggagggacaggcgaacgagccgggagagccggccggcgcactaagatggctgaaggcgcccggcgagggtgagcggggggcgcggcgcagccagcggggagtcctcgggcgggccgggccggcggcccttccccgcggcgagaagccggagccaccatgtcgttcgcgctggaggagacgctcgagtcggactgggtggctgtgcggccccatgtgttcgacgagcgcgagaaacacaaattcgtctttattgtggcctggaacgagattgagggcaagtttgccataacctgccacaaccggacggcccagaggcagaggagcggctcccgggagcaagcgggggcgcgagggggcgccgaggccggcggagctgcgtccgacgggagccgcgggcccggcagcccggcgggcaggggtcggcccgaggccactgcctctgcaactctggttaggagccccgggccccggcggagctcggcctgggcggagggcggctctcctcggagcactcgcagccttctgggggacccgcggctgcggagtcctggcagcaaaggggcggagagtcgtcttaggagcccagtgcgggccaaacccatcccgggtcagaaaacatctgaagccgacgatgcggcgggggcagccgctgcagcagcccggccggcgcccagagaggcccaggtgtcctctgtacggatagtgagcgcctctgggacggtctccgaggagatagaggtgctggaaatggtgaaggaggacgaggcacctctggcgctctcggacgcggagcagccgccgcccgccaccgagctggagtctccggccgaagagtgcagctgggccggactgttttctttccaggacctgcgcgccgtgcaccagcagctgtgctcggtgaactcgcagttggagccgtgcctgccggtgttccccgaggaaccttcgggcatgtggactgtgctgtttgggggcgcccccgagatgaccgagcaggaaatcgacactctgtgttaccagctccaggtctacctgggccacggcctggacacctgcggctggaagatcctctcccaggtgctcttcaccgagaccgatgatcccgaggagtattacgaaagcctcagcgagctgcggcagaagggctacgaagaagtgcttcagcgggccaggaagcgcatccaggaggtgagtgagtgagctcctagtctgggctctactggtcgcttttggtttactggccaaaccaaaggctggagcctcggtgtcgggtgtgcgcagtaggacggttgtttttctggacaagcggaaaccaagaggggttcctgatctaccttgcccttcatccctctcggtggctgcttaattgactctctgaaggaccttcgtctttatttcctcccccatttatcaaaagtagtaagtgcgctctgtgtactactcagtactggtaatgcgcaattaaagccactaagaaaagtgttctgtaagcatgggctacctgagcatttttctacccctaaagctcttccagcaataactgcccagatgtcaactcttctttgtccttgtcacctttatttaaaatagtttgtcttacggagcaaagttgatctgttttgattcttctttgtgcagtgtggcaacctacgcaaattttaaattcatttttaaacgagtgacctaagtgaaaaagcacctagtgactatcggatgcaaatttatttttaaaaggttttttagaagtgttttgtttctttttttttggactacctcaggtctttacagatggctcaggtttcactgctgttttaggtagaaataaagattctgggcaggaatgttcgttgtatttttgtacttactgtagaagtacaaaagccttttcaaactaatccttaaaataacaaaaaaaaagtggaagaaagggtctgaatggatatacatatggggctctagaatgtgtaggaaatgtgtaattcatgcctgctcactagcttctgctgaaggaactttactaaaaaagtcttttaaaatagacccagttttccctaatggatactactacacgtagtttctcaaagcaagttactgtttttactattaatgcaattgagattggtggagaaatgcacccccgccctccgcgccttcttttttttttttttttttggaagcagttttgctccgtctcccaggctggagtacagtggcaccatctgggctcactgcagcctccccctcccgggttcaagcgattctcctgcctcagactcctgagtagctgggactacaggtgcgcgccaccacgcccggctaacacgttagcccggctactttttgtgtttttagtagagacggggtttcaccatcttggccagtatggtctcgatctcctgacctcgtgatccgcccgcctcggcctcccaaagtgctgggattacaggcgtgagccactgtgcccggcctgaaatgccccttttaatggtgtttatattcctaagattgtgttgttatctgcttatgtatatataatagttgaaccttgttgttagattagggagctagagcctcatgtttttttcgtagaatattagatatttttctttattagatttgagtatttaagaaatgtttgtttctcacttataccatagtactctcttacaacttcccgaatccagattttcactgcttcctgttggtttactgtatgctaaatgtcacccactataacatgatcctagagttccagggatctgtttttatttcccttttttatcacctcacttcgggagtctaccttaaattattttgaaggaagtgacaaatcttaagtgaccacatatattctcagaagtgtttggttaatattgacctgtatttctcttaaactgcaagaaccgttagtgcttctttctcttattagatttacagatatattttttaaaatacatattcttaaaaatcccttaatgaatgggcctgtctgattgtaactttttggatactcagaaaaagcgactgtcaggccggtcgcggtggctcatgcctgtaatcccaacactttgggaggccgaggcgggcggatcacgaggtcaggagatcgagaccatcctggctaacacggtgaaaccccgtctctactaaaaatacaaaagaaaaaattagccgggtgtggtggcgggcacctgtagtcctagctactgggaggctgaggcaggagaatggcgtgaacccaggaggcgtagcttgcaatgagctgagatcatgccagtgcactcgagcctgggcgacagagcgagactccgtctcaaaaaaaaaaaagaaaagaaaaagaaaaagagaaaaagcgactatctccggttttttaattcaaatgggtcaaaaataagctctcaaaaaatataattttctagaactctttaaaaaggggattacattttttaaaaaatgtgttcctaattaaggttctcttgaccataatgatttattttctttaacagaaaattatactttttttctttctttttttttttgagatggagtctcgctctgtcgcccaggctgaagtgtagtggcgcgatcttggctcactgcaacctctgcctcccgggttccagtgattctcctccctcagcctcctgagtagctgggattataggcgtgtgccaccttgtccggctaatttttgtatttttagtagagatggggttttaccatgttggccaagctggtctcgaactcctgacctggtgatccgcctgcctcagcttcccaaagtgctagaattacaggcgtgagccaccgcacccagcctccccccgccccctccaaacagagttttgcactattgcccaggctggactgtactggtgcaatctcagctcactgcaacctccacctcccgggttcaagcagttctccttgctcagcctcccaagtagctgtgattacagtcgccgctaccatgcctggctaatttttgtatttttgtagtgacagggtttcccagtgttggccaggctggtcttgaactcctgacctcaggtgatctaactgcctcggcctcccaaagtgctaggattacaggcgtgaaccactgcacccggcaacttcaatatttgaaaaatagccatcaaggacaacaaatagtttcagtaataatgcctatcttgacttctgctggaagattgtgtctttagattatattgggggagggagggaagtgtggtgtgattgattggtgatgtctgccatgggcatgataatgaaagtgtataggatgctagccatgtatttgtcttaagctaattaaatttaactttgctttcttaatagtttgcagtaacattttttaaggtaacatttttatagaagttgtgccatgtttgtgttattctattgacttagtttgtggaattggctatagcttttcaagctaggtttatctgataaatcaaatgcattcttgaggatatgttacttttgaggatatgttagaatgcttagtcctttggtcacttacaatacttagtccttttccttctttaatttctatgaatctattttttggtcttttttcctacagtattcctttccctgtccatttaaaggtttcaacttaaaatcacctgtttttgttcaaaatggttagtaagttgttgaacttttttttgtttgtttttaatagaacagactgtacaactagattgtaagcttttcaaggtccttggctttgacaataccttggaactctcttctttgccacccctagttcaggaccacacatcttgtgagcactcttaattagtggataaaggaaactagagaagtttttaaaattaatttattcttactattgcaagaatttaaaggacttagaagatgtgtccttttaatgtgaagttgtaagtaaaatttttataaattgataagtgtaaattcctcaaaggacagtgtttttaaaacgagaaattttcttttagtacttcaaaggaaaatttcttaaaacataaataaattcctcagtaagaggtttttacttggggatggtgaattccctgtaagaggggctatggatggattttaatggggcgtcctgccgagttttatatctgtgggcatgtgtgcattttagagagaaaggcaataatgtgagtcacaggaatgttttggtttcacagtgcgtttaaaagttatgtttatgctataatgtacattatacttcttaggggctaaatccaagtgaaaggtgaaatttgttactggtatgtttgaatttggacttttacaagagtttactattggaagcagtatttatacagtagacactgaatcagtccttaaatgaatgcaggtgccaccaagacctctttgaacagttttcagcagtagccttggttgttggtcagagctgaggtttgtattagtgtatgtgcgttggtggcccatactgcagcttaggtttgacctggattttataaataatggtttctgtataaggacagctattctcaagatgattaactgtggtgctttagatagtaaaccttaattatgatggtaggcttgattaagatctaatcatcagtgttcattttggaatttattatgtttataaagatgtgctcaattctaacttctcttctgttgaaaccacggtttggaagtagcatgtgttttcaaaattatccgtgtaagccacataataaatagcctgttgagtgagtggagtcagaaacacctaggttgaaaataggactaaccacttctgatgacctgcttagttatttaacctcttttaaaaaggaaggtgggggaaataaaggatgtcttaagatttgagtaagacagtatgagaaagggcctaacaaagtgcctggcacttactaaagaggcttccaggaagtgttattttcccttttttcatgtaacaaggattatctggttttccattcagccctttttgtggggactgtaactaatatttattattcactatctgctgagatcagtgggtgttttatacctattttactgaggcagaaaatgagacttaaagaggtcctgtggacttcaccaaggctaaacagctgagtaaccaagctccgatgaaagcctagatttgtcttaatccaaacgtgtgccttttctgccatgcctgtggcctgttggggttcttaatccaagggactgtattccttccttaaagagaaaggatgtcaatctctactcttgagaattggggagtggtattattttaaaatgcagtcagttcaataatgactttttttttttttttttaaagacagtgtctcactctgttgcccaggctggagtacaatggcagtatctcagctcactgcaacctctgccttccaagttcacgcaattcttttgcttcagcctcccaagtagctgggattacacgtgcatgcaaacactcaataactgcttttgatttaggataactcatttcgaattaattatgacaagcatgaggtagggcagtctgaatgtgatgttttagagaaaggtgttgcctagtggtgcaaggataggtttatgttagagaagagtgcccaattgtggggaagttttttgtttgttttgtttttgtatcttaatggctaagctggaaaacagctcctgacttctgaggttatttaactgaaggggcaaggggcaaggagctctaggaggaagttttgtttaacaggtgtcctcccaaggatacctttgggtccttagaaaataacttttctaattttcttgaaaacctaagattagttttaaaactcaagccctgctgaaaccccaactatatacattagagaaatgacagtactttaggagtcttgggacgccacctgtctttcactgggccagcaagccatgacccatgattacatataaataaatggtggaagcaggctgctatttatagggaaggatataatatgattccaatgaagagagctgctctgtctggcagttcttgactgcattgactggaagtattgaaaaataggatattacatgttgaggacatatgggagctgtagactttcaagacagaagatatgtcaacattgtagcttgatgccttgtctaaccatgttatactcccatgaaaatattgcaaactgctcttttactgtaaaatacagttaaagaataatgaaactaagtgaatttgtgggattcttaaagtattgatgaaagacttgaaagttggaaacatttacaatattttgatgctaatcattttcttcaatcctgtacccaaatgtacttttagacagttttttgcatcactgaaaaagatgtaagtatagaaaaatggatatatgcttctagtttagggcttctataaaacaaaaacatggagactggtagcaggatgtcacccttcttggtaattaatttgtgtaatggtttctctgcttgccacttaacatcacaagatgcccagtccaccagagatttctttcttttttctttttttccttttttttttttttgagacaggcttgctctgtcacccaggctggagtgcagtggtgtgatctcggctcactgcagcctccactgcccggcttctagcgattctcctgcctcagcctcctgagtaactgggattacaagcatgtgccaccacacccagctaacttttgtatttttagtagagatggggtttcaccatgttggccaggctggtctcgaactcctgacctcaggtgatccacctgcttcggcctcccacagtgctgggattacaagcatgagccaccacgcctggcccagatacttcatagacatgaagtctggggatgtttcctccttgctaaaatgaggttaacttagacaacacttcagtgatattattataagggagtgtgtatgtgtgtctgagagagatggggagagaagggagaagatgggtgggaaaattggtttgtcaaacatagcagctgctgtatttgaattagccatcttatctttgcaaattctcacatgtaattttaatcgatctgttaaccttctccattgctgcttcatttgacgtttcattaactgtaaaatatttttgacagtaggtcttgaaagcacaagatgagccctctgttgctccattgatggttaaatgtatgtgtgcctattttttttttttttggtaacgagaagtttcctgtggctcttttcactctctaaaaggccaggacctgcttcctctgaatctgcctgattcactcagttgttggtaggagaaattaagttccaagtgtaagagacataggcactgaaaactaaataatagttcttgtaactatttgttttttttttttttggtagagatagtgaagttcatttggtttttcaggcttcttttaggggacttgataataccaagtagccttaacacagcatatctaagttattaaactgcataggggcagagaagaatttatccagcaaaaggccagaaaatttggagttgttttcctaaatgtgggggattgtcctttatgtttgtccttgaattttaaattaaatataattacaattctatatagtagactctttttcagactgtagcaaaggttctataaaatgggctgtgaaataatggggctgatgggttagacatttcacagaggaggatttttaaggataaatgtatgaagttactttaatgattcggaattttatttgtaactttcaggtttgagggtagtggctagggtcttagtttattcaacaaatagtagtataggcactgggaaaatgcagtgatgaacactgtttctttgggaagaaattttaaataaaattggtcatgaagtcatcctggtgcttggaggtagttgaagcagggtgctttttcagaagcatcccactacactgtcttgagtgcttcatggaaaaaaaaaaattaaatggatatggctcgggaaaaatctgtatttttgtcctgattgtaatatgagttgtttgaccttaggctgttgactagcctttttgggccttagtttttagtttataaagtgaggtaagtatggcctctttttaaaggacccacagcagttgataggcacagtgtggcaagggttgggacctgagcaacttggtttttttctttttttgagatgaggcctcactctgtcgcccagactggagtgcagtggcatgactttggctcactgcaacctccgcctcccaggttcaaatgattattctgcctcagtctcctgggtagctgggattacaggcatctgccaccatacccagctaatttttgtatttttaatagagacgggttttcactgtgttggccaggctggtcttgaactcctaaactcaggtatccatctgcctcagcctcccaaagttctgggattacaggtgtgagccactgcacccagcctgtattcaggtttccatctccttgcagtaagatgactgttgaaatcgcagcacttttaatattgctagtgtttttaggctttgagaaagcctaaattcactttgaagtacaaagggcatttgaatatggcagtagtgtttcattttgtgtgtgtttatccttacatccttaaatcattcattacttatacttcaaattttctgttcttttttcacttctccctgtggtttttagtattaaaactgcttttccgatcagtttttgataactgaaagttatacttgcaaagtgaatgcttacttattaaaattatttctctaggcctatctttctccttgccgtcctatctagatgagtttctatccacacctatggggccataactggagtgtgtataaggatgtatataacaagttttcaataactgcaatagttagttaacctttattgaatgcttactgtaggccaagcactttacaaagatctttgtgtacattatctcagttcacacgtagattagacagtaagaggtaggatgcaagtgagtttgagacctgacttctccttgttaatatctgtgattttgggcaagttacctgatgcagtgccttagcttcttcatctgtagagagattaatactgctgcctcatagagtgatttaaaaataggtatgttggccgggcacagtatctcacgcctgtaatcccagcactttgggaggccgaggcaggcggatcatgaggtcaagagtttgagactagcctggccaacatggtaaaaccctgtctctactaaaaatgcgaaaattagctgggtgtggtgttggacacctgtaatcccagctaacttgggaggctgaggcaggagaatcacttgaacctgggaggtagaggttgcagtgagccaagattgcggcactgcactctagcctgggcgacagagcaagacaccatctcaaaaaaaaaaaagtatgctataaagcactcagaacagtgcctggcatctagtaaacacttgataaatctaaactttgattaatatttgtatctacctaagagataaggattttgcagcagaggtagagaattggtaaatttgcctacataacgtatctattgtatgaaagaaccggattcaaatccaagcctgccttgttaaccactggactgtctgcatccctgtagaaagagagtgaggataagtgataaatttaaatgttgtccaattgaaatatatgttcagtgtctcaacagtggacaaaagcaatagtgcttagctgatgatatttttggaaaatcttaattatatacatatactgtaattacctttttttgtttgggattagagaatgatgcaatccaaaggaggctactttatttttcctttttattttttgagatggagtctcactctgtcacccaggctggagtgtggtggcgtgatctcggttcactgcaacctccacctctcgggttcaagtgattctcccacttcaaccttgtagtctcaagtagttgggactacaggcaggtgccaccacacctggctaattttttgtattttttagttgttgttgaaacagggtttcaccatgttgcccatgcgggtctcagtctcctgagctcaagccatctgcctgcctcagtctcctaaagtattgggattataaacgtgagccaccttgcccggcccctgctatcacttctatttcctttttattttgtttatttatttatttattttttgaggcggagtcttgctctgttgcccaggatggagtatagtggcacaatctctgctcactgcaacttccacctcccaggttcaagcaattctcctgcctcagcctcccaagtagctgggattacaggcacccgccaccatgcctgggtaacttttgtatttttgtattttattttattttattttattttttatattttattttattttattttatattttattttattttattttattttgagacagagtctcgttctgctgctcaggctggagtgcagtggcagaatcttggctcactgcaacctccacctcccaggttcaggtgtttcttctgcctctgcctcctgagtagctgggactacaggtacacaccaccacacctggctaatttttgtatttttagtagagatggggtttcaccatattggcctggctggtctcaaactcctgacctcatgatccgcccacctcggcctcccaaagtgctgggattacaggcgtgagccaccgcatctggccttttaacttttgtatttttagtagagacgggatttcaccaagttggccaggctggtctcgaactcctggccttatttccattttaaatagtccataacattgaatttagtcttgtactttcctcccttttttttgagacagagtctccctctgtcacccaggctggagtgcagtggcacgatctcggctcactgcagcctctgcctcccaggtgcaagcaattctcctgcctcagcctcccaagtagctggggttacaggtgcgtgctaccacacccagctaagttttttgtatttttagtagagatggggtttcaccatgttggccaggctgatctcaaactcctgacctcaggtgatccacccgcctcagcctcccaaagtgctgggattataagcttgagccaccgcgccggcctccttcttataattatagtaaataattacctcacctcagtcccatatagaaaaaaaaaaaagtttcttactaacaatttttctgactagtccagaagggaggacagttaaggatgttaatttcttactttattttcagtttagaaatcctacatctgtatgtttaagagagggtcttgttctgtcagcgcaggctggaatgcagtggtgccgtcatggctcactgtatgtagccttgatctcctgggctctagtgatcctcccgcctcagtctctggagtagctggaactacaggtgtgtaccaccacgtctggctgactttttaatttttattttgtagagaagaggtctcactgtgtcacctaggctggtctcaaactcctgagttcaacttatcctcccgccttgccctcccaaagttctgagactgcagacatgagccactgtgcctgcccttttttttccctcttgttaggtgatgtgaattttggtagtggggttgctaatgaaaagtttatgaaaagtagggttaaagaaatgaaggactaagaaaaacggtgtgaattaacttcattattgttattttgtgtttttagtagaaatggagttttgccatattggccaggctggtctcaaactcctgagctcaagcagtcctcctgcattggcctcccaaagtgctgggattacaggtgtgagccaccgtgcctgcccttgtgaattaattttagagtagcagtatttacacttgaaaatttcatgggaatgaataacattagtttaccaaaaggaaatgatatgccagctcatagtgaagctgcctagatgcttgcttttgtaaacagtatgttatcaagtcactggctccctgtatagccttggagttggctcttgagcaggttttactctgcattgagccttatgagacccataacttgaagtaagactgttctatttcttggtagaaattatcttaaaggagatgaatggaggaacaggtatttatctgaagtatcagcatgtttttgggtttaaaaattgaaaactggaaggaatttcaaaattgagtaatgtttttctcttttcattttgtctaactgcaccattccccagttactctattcaagttttccttttgtattaaatttcatcgtattttcagtctcccttgactcaagattgggatctttcccttaaggaaagatgaattgactggccttgagtagaggccatgtggggcagtggttccagagtttgagttaggctacaggggttcatacctcacttctactttccactagcttaactcttggtagtaactgagctttctgcccgtggttcttcatctctaaaatggcataataactatatacctacatcataagattgttaggaagaatgaaagaatgtacgtgaagtgcctagcgtggtatctaatatagaaaccgtcataaatgtcagctgctattgtgatactttctcatctactttttcctgaagcaactcatactgatgctgggttcctcctaaacccaaacttgtttgtactaaaaaccgtgtttgtaatggaagctggtgctgtacaggtaaaatatttccaagccaaaacaatgtcaaaacaacaagaaaaatctaacgggttgatcttcagcctcctgtaccctccataggaactcctagtacgtgctttcccaagtcccttgttgctgcttcgtgtatacattattatattcgttgacatcacaggacaggtggtccttttgatacagtcagttaaaacggtgattctagtattttttcttgtcaattttattgatagctcttctccatttttttctgtatttacctttactttgtttgtaggcgtcccagacaaccctgatcacaattgatttgcaaatattccagttgaaataactattaaagaaatggtaagcattaacctctggaagcccttaaaaatacctttaaatctccttcaacaattgtttatttaataaatagatcttgtgttaggtattttttaatttttaattatttttcttttttttttttttttttggcatatgaagtaagagctatccaggtgcttttaacagcctctcacacttcactagaaattttaccccactattaattctttctaattatacctactttttttttaatgttggcatttctgattagtattttcatacttactctagcaagatgttgtattttaatatctttcattgcacttttacatgtttactgtggtttggggtagctttgcaaagtctaaccataacttaaaatattgtctatggtaaaaaacaaagttaaatgtgcctttagggtacaatatatttaataattgagaactgcctataattcttcacttttatttcattagtgtgattttcaaaggatccagatttatatttcttaagaagagtatgtaggtatttgtatatgctgatttttttaacaagccaatttatttgactgtggagggtggggagaaagattggaaaaaagtcaagttatttgaaaatgcccattcctgtttggttgggaaggagggaaaaatgaatgtgatttaagatagctgggcatatctgtagttatttctttattataaatatattttattatactttgagacagaatatccctccatcacccaggctggagtacagtggcacaatcatggctcattgcagcctcaacctcctaggctcaagtgatcctcccatctcaggctcctgagttactgggactacagccatgcgccaccatgcccagctaatttttaacttaattttggggggtacatagtaggtgtatatatttatggaatacataagatgttttgatacagatatgtaatgcataataatcaaatcatgaaacatagggaatccgtcccctcaagcatttgtcctttgttttgcaaacaatccaattacactattaaattattattgactgttgtcacccagttatgctatcaaataccgggtctcattcattctattttttttttttttacccattagccgcccccacctccccctcaacttccttcctacccttcccacactctggtaaccatcattctactctctatttcaattgtctatttcaatgagttcaattgttgtgatttttatttttttatttttatttatttatttattttttgagacagtttcactcttgttgcccaggctggagtgcaatggcaagatatcagctcactggaacctctgcctcctggattcaagcgattcttctgcctcagcctcccgagtagctgggattacaggcatgtgccaccacgcccggctaattttttgtatttttagtagagatggggtttctccatgttggtcaggctgttcttgaactcccgacctcaggtgatctgcctgcctcggcctctcaaagtgctgggattacaggcatgagccaccatgcccagccttttcttctttttgatataggcacttatagctataagtttccctcttggtactgcttttgctgtatcccataggttttggtatgttgtgtttccattatgatttgttttaataaattttccttcttaatttcttcattgacctactggtcattcaggagcatattgtttaatttccatgtatttgtatagtttccataattcctcttgttagtgatttctagtttatctcattttggtcagagaaaatgcttgatagtcaggtttttttttttttttttaatgttttaaggcttgctttgtgacataacatggcctatccttgagagtgatagatatgctaaggaaaagaacatgtattctgtatctgttggatgaaatgttctgtaagtttttgttaggtctgtttgacctatgatgcaaattaagtccagtgtttctttgttgattttctgtctggaagatctgtcctgcgctgaaagtgggatgttgaagtctccaggtattactgtattgaggcctctctctctttagctctaatatttgctttatatgtctgggtgctccagtgttaggtgcatatatatttaaaattgctataccctcttgctaaattgacccctttatcactatataatgaccttctttgtctctagttgttgtcttgaaatctattttgtctaagtatagctattcctgctttgtttccattgacatggaataactttttcatgtatgtcttcataggtgaatgtgtttcttgtaggtaacagatcattgggtcttgttttttaatccattcagtccatctgtgtctaacaattggagagtttagtccatttgcattcagtgttattgataagtaccttattcctgccattttgttgttttctgtttgttttgtggtctcctctctctttcttcatgtcttttattgaaggtgattttttctggtgatactatttaatttcttgatctttttctttttgcgaatccattgtatgttttttatgttttttggtttgaggttaccatgaagcttgcaaatactatctcatgacccagtattttaagctgataacaacttaccactaataaagactctaatcttaactttgtctccccactttttaactttttgttgtttcttttgttgttgttgttgtttctatatatcttattgtaagttgtctaaccgttatttttgattggttcatcatttaatcttttttttttggagatggagtctcgctctgtcgcccaggctggagtgcagtggcgcaatctcgggtcactacaacctccgcctcctgggttcaagcgattcttctgcctcagcctcctgagtagttgggattacaggcatccgccaccaagcccagctggttttttgtgtttttagtagagatggggtttcaccgtgttagccaggatagtcttgatctcctgacctcatgatctgcccaccgcagcctcccaaagtgctgggattataggcgtgagccaccgcccagcctggttcatcatttaatctttctaagataagagtagcttacacaccacagttacagtgttataatctgtttttctgtttacttactattatcagtgagttttgtactttcagatgatttttcttttttgagacagggtctcactctgtctaggctggagtacagtggcatgcagtggagtgcaggctcaagcagtgcccccatctcaacctccctagtagctggggccacaagtgtatgccaccactctttatttttttgtagaaatggggttttgccatgttgcccaggctggtctcgaaatactgggctcaagtgatccacccatcctgtcccctgaaagtgctggtagatgacttttttttttttttttttttaaagacagagtcttgctctgtcacacaggctacagtgcagtggcttgatcttggctcactgcaacctcctcctcccaggttcaaatgatgctcctgcctcagcctcctgagtagctggattacaggtgcccaccaccacgcccagctattttttttttttttgtatttttagtagagacggggtttcgcgatgttgggaaggcttgtctcaaactcctgacctcgttcgtgatctgcccgcctcagccttccaaagtgctgggattacaggcatgagccatcacgccccagcttggtagatgacttttttattgctcattaatgtccttttctttctgattgaagtactccctttagcatttcttgtagagcaggtctggtgttaatgaaattcctcagcttttgtcagggaaagtctttattttctccttcaagtttgaaaggatatttttgctggtattctattctagggtaaaagatttttctttcagcactttatgtcatgccgctctctcctggcctgtaaggcttctactgaaaagtctgctaccagatgtattggagcctcattgtatgttatttgtttcttttctctcacttcttttaggatcttttctttatctttgactgttggaagtttgattattaaatgccttgtagtctttagttaagtcttcttggtgttctataataaccttcttttacttggatattggtatctttctctaggtttgggaagttctgtgttattatccctttgaataaactttctaccccatctctctacctcctcattaaggccaataactcttagatttgccctttcgaggctattttttaaatcctgcagtcacacttcattgttttctcttttttttttcctcttgactgtattttcaaatagtctgtcttcaagctcactatttctttcttctgcttgatcagttctgtcattaaaagcctctgatgcattcattcttcaatatgccaattgtgttttttagctctggaatttctgcttggttcttttatttcaatctctttattaagtttgtctgatagaaatctgaattcctcctctgtgttatcttgaaattcttttagtttccccccaaaaaagctactttgaattctctgtctgaaaggtcacatatctctctctccttttttttgagacagggtcttgtagtggtgccatctcgactcactgcaacttccacctcccaggttcaagggattctcctgcctccgcctcctgagtacctgggattacaggcacccaccaccacgcctggctaatttttgtatttttagtagagatggggtttcgccatgttggccaggctggtctggaactcctgacctcaattgatctgcttgcctcggcctcccaaagttctggtattacaggagtgtgccactgcacctggccacatatctctgtttctataggattggttcctggtggcttatttattaatagttcatttagtgatgtcatgttttcctagatcatcttggtacttgtagatgttcatctgtgtctgagcattgaagagttaggtatttactgtgatctgcactgtctgggtttgtttgtacctgtccttcttgggaaggctttccacatattctaaaggacttgggtgttgtgatgtaagctgtatctgttttaggggacaccccaagcccaatattgctgtggttgttgcagactcataaaggtaccaccttgatggtcttggtcaagatgtgaaagaattcactggattaccaggcaaagactcttgttctcttcccttactttatccttaacaacagagtttctctctctgttctgagccatctagacctgggggtggagggacacaagcactcctgtggccatcaccactgggactgtgctgagtcagacctgaagccagcacagcactgggtctcccccaaggcctgctataaccactccctggctaccgcctacgttcattcaaggccctagggctctacaatcagcaagtggcaaagccagccagccaggcctgtgcccttcccttcagagggaagaattcccccaggtccctgatgggtcctttctggaagccagggactagaatcagaaaccttggaagtctacctggtgttctattgtatggcagctgagctggcactcacaccactaggtggagtccttcccacttttccctccccttcccagtggcagaggaacctcatcccagaggaacaagcccagggggagtactggcagactgctgctgatgttcccttcaggcccaagggctcttaagtcagtttgtggtgaatgttgcctggcctgggactcacctttcaaccacccttcagggcagtagcttctcctatagtccagggcaggttcagaaatgccatccaagagtcaagtcctggaatcagggaccccatgagcccacttggtgttctaccccaccgtggctgacctgatagctaacctggtgccaggaatcaagcagaagtagtctcgccccaccccatagctaccacagctgagaatgtgcagagtctcgtaaagggtaatttgcatcatcttgctctgtcctattccccttagctaacttaaaaaatgttttttagggatggagtctgtgttatccaggctggtctcgaactgttggcctcaagtgattgttcctttttggcctccaaaagtggtgggattacagacctgaaccactgcacctgtccttctttctttcttttctgcacctgttcccattgtgctgaccttcctgccttcctccctcccccacccttcctttcatttctttcttgcttgacaggttctccatcgcctagggttgcgatcatagttcactgcagtctcaagtcttgagctcaattcatcctcccacctcagcctccctagtaactagccgatattacaggcatgagccaccaggcccagccatagccaagccttttaaatgcattatttgctgaagtcactatacacagtcctatttttgctccattatgtacaccatcaccactgccttttttttttggttaagttccacattccttattttattattattattattttatttgattttatttttttttttgagatggagtctcactcactctgtcacccaggctggagtgcagtggtgcgatctcggctcactgcaatctttacctcccaggttcaagtgattctcctgcctcagcctcccaagtagccgtgattacaggcgtgagctaccatgcccggctaagttccatacttctttctaggtagggccagatcaggtcccttccctatagaaagtcatttctgaccactgtaagaaatcagaggctggacatggtggctcatgtctataatcctagtactttgggaggctgaggtgagcggattgcttgagtccaagagttcaagagcagcgtggtgaacatggtgaaaccctgtctctacaaaaactacaaaaatttgccaggcatggtgatgtaagcctgtggtctcagctgcttgtgaggctgaggtgggaggatcacctgaaaccaggaatgtcgaggctgcagtaggccatgattgcaccactgcatgctagcgtgggcagcagcgtgaccctgtctcaaacaaacaagaaaaaatcagaaattgtgttagaaattcagaaatcaaagaggctttatgttgacagctgatatcatccataactgccaccctggtttttctctttacggacccctcatgccccttaaagtgcattgtaagtccctaagagatgaaaacagattatcttttttttttggagacggagtcttactcttgttgcccaggctggagtgcagtggtgcagtctcgactcactgcaacttctgcctcctgtgttcaagcaattctcctgcctcagcctcctgagtagctgggattataggcatgcaccccaacacctggctaatttttgtgtttttagtagagacagggtttcaccatgttggccaggctggtcttgaactcctaacctcaagtggtccgcctgcctcagactcccaaagtgctgggattacagtcatgagccactgtgcccggcctttgattttttatacataacatgtatgtacagagtgtgtatgtacattttaatgagaggtatgtattttcccaggggtagaacacagtcaaatttactgaaatttactacttatctacaaaggaaagaatctgaaaatcattttaaatatcagtttctacaatatttatctttgaactaaaaagaaataaaaatatcagtttggagcattactttataaattcagatattagggctttttttgtttttgttgttttttttttttttttgacagggtctccctctggctggagtacagtggtgttacgggatccttggggtgtcgcctcaccagccagaaacttgtgtggccagtggtgcctttgcctgagttttcctctggcctgctgggctcattctacccactcagcctggcaggctgtgctcagctcctgctaccagtctgggtcccatgcctgccaagggagagccagtcatggagcggtgaggggtgtgttagtgagcgtggggtctggccactgcatacaaccaggcactctggcggtggtggggcgggcagctccaggtgccagtactggcaccagctccctatgaggctgtggctggaccagggataccataagcagtttccatggctgacaccagggaatgcagtgtggtgcctggaagcttggagactccaggaactgcagcgccttaaagagggtgtcaccgctctggcttggggagctcctaggtctgggctccccagagggccacagctcttctgtcctcttgttggctgtaacattgtgggcaaggggtgtttcagccctgtttgtgttacagctcttttagccctgccattccctgggtcttgagttcttgtcctgcatccagcaagaatgaagtacacagacaagagacaagtggagagtgagcaagacaaagaggagctttattgagcaatagaacaactcagaggagacctgtagtgggcagctcctctccgtagccagcatgtcccgatgagtgttcagctttcagcagagagggtagctcctctctgaagctggttgtcccatcatttcttcagctctcagtagagagggtagcttttctctgctgggcaggtcatcccgacgagtgtccagctctcagaagagagggtagttcatctctccagctggctatctggtcgtctcttcagccctcagcagagaggagaccctggggtgggcagcttctctctgcagctgctctcccatcatctggctgaatatggggcttttatgggcctcaggggaggaagtgtgtgcgaaatggtccgtgggcaaacatgggcgggcctggaaaaggcaccacaagttcccaccccagtcagtaggatcagcagtctgacacccaggcttcaggccctccccgacttgaaggtggtgcttcaccaaggactcacccactcctgcccaggagcttgtctgcctcctgctgccatttatggtgcccaggctgtttgtgccaaggagtgtctgtgggccagcgctgagctgccctcagcacccccttggcctctcttctgtgctcattggtgcccaaagtccgcagcaggctgaagtggcaggggctggtgtgtcagcactgcccccgagcctgtgcacacccagccaggttgtgacagacctagggttggcctcaactttgccttgtgagtggaacaggcgctgatattgaggaaagtccaggcagtgggagcagacacctccgagcctgcaggggcaaggtggggccttcccaggccccggagagtgcagagatgcctggatctgcagctgtagcttgggcagctgtagccacccctgggagggtgggaatcctgcatgcccctggctcccactggctccatggagcatggcatatgcacatcctgggcccacctctgcctcagggcccctctctgcctgcccctcagtgcccgactgtactgctaccctgctggcaggcaactcagcctggccccattgcagtgtctcccaggacagtggtcgaggtacaggtggcatggcagccctggccagcgccacacaaatgaacctgacgcacccagggctggcctcacaagtcctagctgtacccttcagccaggtgctcacagacccttgggatgcggtaggaagcaaggttgaggctgtggcggagactccaggcctgggagtggttcctgcctggccctgtgatggtgggggtggttcagtcaggtgcctccaggacatggggcacaggaaacccactgccaccactgccgctcccacagctgctcttgccaccaccgcttatgcctccccactgcaactgatgtgatggcagcagccagtctagatggcccgccactgccatgagtggcttgatcttgcctcactgcagcctcaacctcctgggagcaagcgatcctcccacgtcagcctcctgagtagctgggaatatgggcatgaaccaccatacccagctgatttttgtgggttttttttttttttgtagagacggggttttgccatgttgcccaggctggtctcaaacccttgagctcaagtgatccacccaccttggcctcccaaagtgctgggattgcaggcatgagcgaccacacctggccccagattttttttttcttttttgatttcatgtcccttgagtctttttttttctcagattttagtattaacaagtaataattagcaggaataatataaaaataattcagtagttttacaaagcaagaacagagatgggcagtgtaaatgtggaaatgtatggcactggtccttatttctcagtaggggaaacagaccaaatggacctaaaggcagttcccagggccacagatgcagtatcattgctggggtaggttccttccatccaagtatcctaagtcactccctttcacagtaattatttgcatgttttaataattaatggtaaagatattacttatagattttgtgaaaggaaaataaatctagggaccccaaactcattaagccaaagggaaaagttaagctgggaactgggtcacacaaacctgtcccttttggttcctaaataagatggctacaagatgaaaagctacatgcttccgccatattttgcccacaagcaaattcatagtgagctccaagatctttaccctgaggtttttctgctaaaattttaccatggcaatgtaaattgatagcatatccttacaggtgcagtcacccccctgcccaccagacaaatgcatatctgattgttctcctgccccattttgtttgggttatcttatgtaaaagtgccgtctctacaaataataataataataataatcaaaaaattagccaggcatagtggcacgtgactgtagtcccagctactcaggaggctgagacaggaagatcacttaagccctggaggttgaggttataatgagccatgatggagccactgtactccagcatgggtgaaaaagcgagaggctgtctctaaaaaaataaagtgcagattcactgggccagacaaaggcgtgaattactattttccctaaccccccttacatgaaaattgtgtacttctcagtaacctgccctttcccctttaaatttggagccctcaaaattatcttcagagaaaggcgtagacctgtctcccgggcatatttccttaactttggcaaataaccctgctgggattacaggcgtgcactaccatgcccggctaatttttgtatttttagtagagacagggtttcaccatgttggccaagctgctgtcaaactcctggcctcaagtgatctgcccgtctaggcctcccaaagtgctgggattacaggcgtgagccaccatgcccaacctctgcttcatgtttcttaagtgaatcaatagagcaaaatcattttctaaaatcctacaagagatatgtcagattttgaagcagaaattatcaaagctttactttccaggcccctgctctttgtccttcctttctgctgaatcctgctgtggccgtttttatgttgtgctggttgagcttcagcacttctgaaaccctttgtggttgtattctcattcagatccatctgcgttcttattcagtgtggctctcagtgaatcttctcaaatttagcaaaatgcatctttcacattttaggtgcatctgctgcattttaaattaaggccttccctcttcatctcaaatatccttaatcctaaataattcgactttctttataattccttttagtcttttatatgcattatttatagtaccttacacattttgcagtttataacctgcaaatgcccatagctcagtttatttattccctggactttgtcagtttttagttagcaaaatcaaaaattaagttttataattatatcaagttagtgattattttttcacctgttgaattcttttatcatgaattataggaaacggtttacacgaaagtctaatgcttagtaaattgtatcttttgaaatgaagttataaaatgcattccctgtattttaagattatttgccaatacttagattaaaatagtttgaccaattgaaattaaaattgtttttaaggtagtctagtattggaaaaacatgaaactttataggaaagaaggcagattaataaattagcagtgttaggtgagatggcttgggcttctctgcaagagtattaagtttaggtgctgcataatagctttgtaaagtactattctgtctgaggacaaaaagcatggtggaaataatagataaaaatgttaatgtttggatagagtaactgatattctgtcctcagttattgtacatatttgtgtacagtggtattgtgacttaattaataatcatataatgacttgatgtttttgtgttggcagaaaatagtatctaaactttgtattacatttactttattgaccctgtaagaagagcccaaagaagcctagtgtttgagggttcgcttactgttgaattgtggcatttgatcacttgtaaatgactcagggggattttactattgaaagatgttggcaccatttttttcccctcattcttttaacacttttgctattcctgaaacctggtagaaaaccattatctcgaagaaagtgttagttttcaagcgaagtataagataaagggcttctttgtatgtacatattcttggaagaagggaattattgcctttgacctaaaaggaagaggctgaggcacaaaatatatttgaagagtttacttgggccaaagtaaggacagctgccgagaagactcagacccaagtatccttgaatatgcacggtctttgttacaaacaggttttttgattttttttttcttttcaggcaggatgtgctctgtcacccaggctagtgtgcagtagcgtgatctcaactcactgcaacctccatctcccgggctcaagtgatcctgcagcctcaacttcctgactagctgggtcaacaggtgtgcgccactacgcctggctgatttttcacttttttgtggagacagggttttcaccatgtggcccaggctggtcttgaactcctgacctcaaggtgttccaaagtgctgggattgtaggtgtgagccaccgcctgtggccactaaaatttttttttatagagtcttgcctttttgtctaggctggagtacaccggtgcaatcatggcttactacagcatcagcctcctgctttggcatcctgatgtgtgccaccatgtccgtctttttttttttttgaaacagagtttcactcttgtcgcccaggctggagtgcagtggtacgatctcggctcactgcagtctccgcctcccaggtgcaagcaattctcctgcctcagcctccagagtagctgggattacaggcgcctgccaccacacccagctaattagtagagacggggtttcaccatgttggccaggctggtctcaaactcctgacctctggtgatctgcctgcctcagcctcccaaagtgctgggattacaggcgcgagtcactgtgcttggcctttttgtttttttttaaagatagggtctcactctggttgcccagggtagagtacagtgatgtgatcttggctcactgcagcctggccctcccgggctcaggtgattctttcacctcaacctcctgagtagctgggactacagctgtgtgccaccacacctggctaattttttgtgtttttagtagaggtggggttttactgtgttacccaggctggtttcgaactcctgggcttaagcaatccgctgacctcagcctcccagagggctggaattacaggtgtgagccacttcacctggccataatttttaattttttttttttgtagagacatggtctcactatgttgcccaggctggtcttgaactcctgagctcaagtgatcctcctacctcactgtaggaggtaaagcctgccaaagtgctggaattacaggtgtgagccactgcgcctggcataaatcatgatttttaaaagcaaataatatttcatcagaatgaaaagagttaatataattttaatggccattgcattaaggccaactttgttgaatgacccatgcactggagataagaccctggccaatgctggagagaaactaggctgattttgtcactctgtgcctgccttctaacgctgaagatcattctgtgattcagtaataacagtgttttttcttagaataactaaaaatgcttcagtagaggaactgaaccataagaaatgagttttggctcaattttagtttaaatagtagtcattaatctaacatagaatgacagtaaatgcagtgagagaaagagtgggaaaagttattttattttattttatttatttatgtaattttttgaggcagagtcttgcgctatcactgtcacccacgctggagtgagtggcacgatcttggcttactataagccctgcctcccaggttcatgccattcattctcctgcctcagcctcctgagtagctgggactacaggcgcccgccaccatgcctggctaattttttgtattttcagtagagacaggtttcaccttgttagccaggatggtcttgatctcctgacctcgtgatccgcccgccttggcctcccaaagtgctgggattacaggcgtgagctactgcacccggccaaaaaactgttttagattcaagaaaaatgttatatgttttaattttatagataagtaaattgactacataatttatataacttcagagatacttgcctcactaactgatggttaatatggggatattaagatatttattaaagcagtgcttctcaaagtttaatgtatacacttatcacttggcagtcttaactacaattcagagtcccattctgcagatctaaaggtgaggttctggtttcatttgtaacaagttcctaggtgacaccaatgttgctggtcccagaccatactttgagtagcaaggtaccgtcactttgatatggccatttagttagttgaattgaactctgtagactaaagattaaacaggacggattgaccacatgcaatgttctttttcccccactctgtagatgggcttactgcttattagaatgtgctgcatttatggactcagtgtgatgtcccactccctcctatgaactttctcagggagcatgatgacacggcctcacccactgtttcccacccagattgctcatctgtgatgattcttttttttttttttttttttgaggcagaatttcactcttgtccaggctggagtgcagtggcacgatctcggctcactgcaacctccgcctcccaggttcaagtgattcttctgcttcagcctcccgagtagctgggattactggcatatgcgccaccacactcggctagtactgtatttttagtagagacagggtttcaccatgttggccatgctggtctcgaactcctgacctcaggtgatccacccaacttggcctcccaaagtgctgggattataggtgtgagccaccgtgcctggccaacttttcttagctttcatcacaagcaaaatcccatgtggcctgtcctctgtccatgtgtgtagtcttatttgcaaggtatttgcctctcattcacagaggcgttcagttttaaatttgtttgggagtttgattaatgtctctacagattaagtaagctctttagaagcagagacgatgtctgtttggttcaccattgtgtccctagtgtctggtagaatgtctacctagtggtagaatcacagaaatatttgttggataaatcaatgctgggcacagagtgagcagtccacaaatatcgttctttcttgactagttaagtatgtaaatcatgtattaatacttgttaaatgaccaaggtcaggggcgttttgtatttttaattgatatagttgtacatatttaggtggtacatgtgatattttgatatgcatatacaatgtataatgatcacgtcaggtaattgcaatatccatcacctcaaccatttatcctgtttttgtgttgggtacattacagttcttccaactgttttgaaataaacaataaattactgttaactataattttcctactatactgttgaataccagaatttattccttctaactgtatttttgtatccattaaccaacttctcttcaccaaaccccacactgatgtttgaattgcttctttttgctctagttgactattaaaaacaaataatagaaccaaccaaaaaaccgcctgttaacaaagtagaaagacagacacagctttgatcagcttacaaaaaataggtgtcagcaggtatgaaaatcagtgttaattggttattatggctttattttgaatgatttctttgttttacttttatgatagtttaacacatacaatgaaatataacatgtctttaggcttgtgtcatctgtttttaaaaattaatagacttgagtttttacatcagttttaggtttacagaaaaattgagcagatagtacagagattccatacttcatacctctctcctgccttcagtcttccctattattaacattttgcattggtgtggtacatttgttataatttatgaaccagtatccatagattattgagtaatccatagtttatattaaaattaattttttgtacagttctgggtttgttttccttttttataaaatgtagaaccctagagtttctatgttttgacaaatgcataatgtcctgctgtcctgtgtacaccattataatatacaaaatagtttaactgctctgaaaatcccctgggccccatctgttgattggagtgctccatctgttcattggagtgctccatctctcctagcctctggcaaccagtggtctttttactctctgtagtttggcatttccaggatgttatgtagttggaatcatatatagccttttcagattagttgtttcagttagcaatatacatataaggtgttccatatctttttgcagcttgatagttcatttcttttcccttttaaaaaatatttattttttatacagatgggatctccctgtgttgcccaggctggtctcaaactcccagggtcaagcaatcctcttaccttgctctcacaaagtgctgggattacaggcctgggccacagtgcccacccagctcatttctttttcttgccgaacatttcattgtatggatgtactacaatttgcttatccattcacctgttgaaagacatcttggttgcattcatgttttggtagttaaaattaagcttctataaactttagtgtgcaggtttttgtgtagataaaagtttccaactcatttggataaatattaatgatccatgatttctggattaggtggtaaggtatgtgtagttttgtaagaaactgtcagagtgggctggacatagtggcccatgcctgtaatgcaaacactttgggagagactgaggtgggaagattgaagccaggagttcaagatgagcctgagcaacacagtgagacccatcgctacaaaaaatttaaaaaattagtgggtgtggtggtgcgcacctgtagtttcagctcctcaggaggctacggtgggaaaatcacttgagcccaggagttccaggctgcagggagttacgaatgtgccactgcactccagcctgggcaagagtgagatcctgcctgtctatctctcagtcatctatcaaagtaaataaaaaataagactgttatggtgtctcccaatgtagctgtacagttgcatttccatcaacagtgaatgagttctggttgttccgcatcctctagcattttctgatgtcagggttttggattttcactattttaataggtatgtattggtatctcattttgatttataattccctaatgctatgtgatgttgagcatctttttatttattttttatttatttatttatttatttcttgagatggcgtctcgctctgtcgcccaggctggagtgtgatggcgtgatctcggctcactgcaacctccacctcccgggttcaagcgattcttctgcctcagcctcccgagtagctgggactacaggcgcccaccaccatgcccggctaatttttttatacttttaatagagacggggtttcaccatgttggccaggatggtctcgatctcttgaccttatgatccacccgcctcggcttcccaaagtgctgggattacaggcgtgagccaccgcgcccggtgagcatcttttcacatgcttatttgtcatctgtatattttcaatgagatattttgcccatttgtaaattggatctttttttactgttgagcttcaggagttctttgtatacttttggtaacagtcttttatcagatatgtcttttgcaaatgttttttctccatctgtagcctgtcttttcattcttaatagtgtcttttgcagagcagaagttaaatgaagtcccactcaccaattttttaatggattgtgtttttggtgtcatatctaaagtcaaggccaaaggcaaggtcagctggattttcttccatgttatcttctagaagttttatagttttcagttttacatttaattccatgatcaattttgagttaatttttgtgaagagtgcaaggtctgtgtctagattcttttttaagactcttctattgaattgtctttgctctctgttaaaagatcatttaactgtatttgtgtggatttatttttggactctattctgttccattggtctacttgtctgttctttcacagataccctactgtcttgactactgtagctttagagtgtctgaaagaggttgaggagtgtcagaccttcaacattcttcaatattgtgttagctattctgagtcttttcacctctgtataaactttagaatttattttttgatacccacaaaataacttgcagagattttgattaggattgcattgaatttatagatcaagttaggaagaactaataccttgttagtattgagtcttcctatgcatacacatggaatatttccttagatctactttgatttcctttgtcagagttttatagctttcttgttaaagatcttgtacatatattgttagatttatacctaatttttggtgtgctaatagaaataacatttggaattttttttgaaattaatgtattttattttttatttatttttttttttagagacagggtattgccctgtcacctaggctggagtgcagtggcgcaatcatagctcactgcaaccttgaactcctaggttcaaggattcctgcctcagcctctgcagtagctaggactgcaggcatgtgctaccgtgtccagctaattaaaaaatttttttttgtatacatgatgtcctactatgttgcccaggtgggtcttgaactcctgggctgaagtgattctcctgcctctgcctcccagaggggtgagattgccagacatgaaccactgcacctggcctggaggagtgtgtgggtgtgtgtacgtgagttcattttctacatggacaaataggtcatctgcaagcagagacagttttactgcttcccagtctacacattttaaatttccttttcttttgttattgcattaattaggactttcagtactatgttaaataggagtagtaaaggggacatccttgctttttgcctcatcatagtgggaacaccattaaatataaatgcatatataaaaatttatatgtttatataaaatatatatttacataaatatttaaaatatatatttacataaatatttaaaatatatatttacataaatatttaaaatgtatatttacataaatatttacataaaatatatatttacataaatatttaaaatatatatttacataaatatttaaaatatatatttacataaatatttaaaatgtatatttacataaatatttacataaaatatatatttacataaatatttaaaatatatatttacataaatatttaaaatgtatatttacataaatatttaaaatgtatatttacataaatatttaaaatgtatatttacataaatgtttatataaaatatatttacataaatatttatataaaatatatatttacataaatataaaatatatttatattaatatatttatatattatatatttattattataaatatatatacaccataaatactttctcaccattaaatatgttagctcaaggtttttttttatcaaggtgaaggaggttttccattcctagtttgctgagagttttatcatgaattgagtgttggattttgtgaaatgcattttctgcatctgttgatatgatcatgtgatttttcttgtttagcctgtttttgtagtagatgacaattgattattgactgttgagctagccttttgtatacttggaataaatcacattcagttatggtatataattctttttacattggttggatttgctaaatattttgtggaggatttttgtgtctgtgctaatgggagatgtcagtctgtagtttttttaagacagggccttgctgtgttgcccaggctggagggcagtggcatgatcaggactcactgcagccttgacttcacagggtcaagcaagtctcccaccacacctggctatttttttttttttttaaattttagtagagagagtctcgctatgttgctcaggctggccttgaattcctgagctcaagtgattctcctccctaggctttccaaagtgctggggttacaggtgcaatccatcatgctcagcctgtagtttttctttcttgtagtgtttgtctgtttttgctgttaggctaaacctggcctcacaaaacgagttaggaagtattccctctacttctattttctagaagatatttgagagaactggtataatttctttcttaaatatctggtagaattcacctatgaacctatctgggcctgatgcattctgttttggaagggtatagttattgattcaatcacttgcatggatataggtctgttcagattacctgttgtttctactgaatttttttgtacatttgtgtctcattttcttttactcaccgttatgctaacgaggatgttgtgactgaggagtgttaaaatcaccaactctgtcaactttcttccttctttttaaaaattctttccattataacttaatgtactttgaagttccattattaggtatgtacacatatgattgttgtgtcttcctgatgaattgactctttcgtgtttataaaatgttctgggctgggcgcagtggctcacgcctgtaatcctaagtgctttgggaggccgaggcaggcggattatctgagctcaggagttcaagaccatccagggggcaacatggtgaaactctgtctctactaaaatacaaaaaaattagccaggcttggtggtgcacacctgtaatcccagctacttgggaggctgaggcaggagaattgcttgaacccgggaggtggaggttgcagtgagctgagatcacaccactgcactccagcctgtgtcatagagtgagattctgtctttaaaaaaaaaaaaaaaaagaagttctgcattatctccagtaatactctatatcttacagtctatctactctttgatattaaaatagtccctccaggcttcttatgctttactgtttgctttcaacttatttgtgtctttgttttcaatatttatctcttctaggcaacatataattgtggcttccttttatatccattccaacaactctacctttaaattaaagagtttagtccatttatatttcatataattcttgacaaggttggatttaggtctatttgttttctgtttatatcttctgttttggtttccttttttttcttttcttttttttgacatagaggtatgtatatgaaaatagcgtgtagtttttacttcttttttctcctcttcttttcctgatttcttttgggttaatttaataacttgaatatattggggcttatagcataccttcttaaattattattcttttagtggttgccatagggattaaaccatacttggagttaatattgtaccacttcatctctttttaagagacagggctttgttctttctcccaggttagagtgcagtggctcagtcatagctcactgcagcctcaaactcgtgagttcaagtgattctcgtgcctcagcttcccgagtagctgggattgcaggtgtgtgctgccatgcttggctaatttttgtatttctagtagtgagacagggttttgccatgttggccaggctggtctcaaactcccaacctcaagtgatccacctgcctcggcctcccaaagtgctgggattacaggcacgagccactgcacccagcccatcttatacttaagaacccatatgtgtctgtatagattcatctctaaccctgttctttatgctttaggtttcatatttattatagtcagatacattataaacttcagtacagtcgtatgatttttgctttgaacactcctgtgtattttatagaaattaagaggaaaaatagtctattttcctactaatatcatttccagcaatctttattcctttatgaaaatctaagtttccatgtgtatcattttccttcaatctgaacacattttaaagaacatttcttatggtgtccatctgctggtgatgagttctcttttaatttaactgtttattttttctttgttcaggagggatatttgcttggaaatggaattctgggttgacagatgttttgttgtgttttgtttattcctcatctgttctctattgtttctagtttgtagtcagcattcataggtgtacttgttcctcctatgttatttttctctagctgttttcaggaatttctcttttatttttgagttccagtagtttgactataatatgataaacctacttgtgggtaactgcatttatctgcttggagctattagagcttcttgcatgtgtagatttatgtctttcgccaaatttgggatttttcttgtaatattttgttctgaatcattttctcttctcctctggaacttcagttcaatatatgttaagaccttttggccaggtacaatggcgtacgcctataatcctaacactttgggaggctgaggcactaggattgcttgaatccaagagttcgagaccagcctaagcaatatagtgagacctcatctcgggttgtgggggaagaccttttaatattgccccatgagtccctgaggctttcttttttgtttttttttcttttttctttttgagatggagtctcgctctgttgcccatcctggagtgcaatggcgctatctcggctcactgcaagctccgcctcccgggttcatgccattcttctgcctcagcctcccgagtagctgggactacaggtgcccgccaccatgcctggctaatttttgtatttttagtagagatggggtttcaccatgttaaccaggatggtctccatctcctgacctcgtgatctgcccgccttgacctccctaagtgctgggattacaggagtgaaccaccacacccagcactttcttttttttctataagattggataatttatctttatcttcaagttcattgactgttattagaaccatactctatacccatacagcgaattttctatcctagaattagtttctattttttgagatttcctgtttattcttgttgagtgtatttcttttatgtccaattagcgttataatagctgctttgaaatatttgtctgttaaatccatatctgtttcatcttatgattggtcttcattgattgctttttttaaaaatagtgtttttttttgtttgtttgtttgtttttaattgagacagagttgctctgtcacccaggctgtagtgcagtggcatgatctcagctcattgcaacctctgcctcctgggttcaagtgattctcctgcctcagcctccccagtagctgggactgtaggtgtgctcctccacacctggctaatttttgtattttcagtagaaactgtttcaccatgttgccaaggctggtctcgaactcctgacctcaagtgatctgcctgcctttgcctcccaaagtgctgggattataggcttgatccaccgcacctgccccattgattgctttttgatgactgagttttgttttcctatttctttgttggtctgttaatcttggattatataatagacattgtgaatgataaattgtagagcctctggattctgttatgttccctcagagtgttgatttttacagtcttgtcttcagcagtcaagttgattggattcagatgtcaaactctacctccttcacggaaggcagcagatgaaatatttattgttttgttttatctggattgtttagtacctgtcctgtgcatgtatagttccagtgatcagccagaaatttgagtagagtttatatatgaatttggactttcttcttcttaggctgtctccctttcatcactgttctctggctttctagctgctgtggttgtcctgaactctatcctcagattcttcaagccagcaagccaacaagactgtgggtttctgagggttttttttttttttttttggagatggagtcttgctctgttgcccaccaggctggagtgcagtggcgcgatctcagctcactgcaagctccgcctcccaggttcacaccatcctcctgcctcagcctcccgagcagctgggactacaggtgcccgccaccacgcctggctaatttttttgtatttttagtagagacggggtttcaccatgttagccaggatgttgtcgatctcctgacctcgtgatccacccatcttggcctcccacagtgctgggattacaggcgtgagccaccgtgcctggcaagggtttctgagtttttagtcatacctctccccttcttttggcatccactggggcacaccctcaggctgaaaggcatgaataaaccgtctagagccctccctgcttccaaggtattgttgatgtcccttccattttatagctattttggtcactctgtagtgcctacaggcagttgttttgtgatattttgccccacggtttgttgttgttatcagtggcaaaagttgctctgatagaactgcttagctaatactagagaagtcaaaattctccatattagttttaacagtagccttaaaaaaacagaatgatagctaatatttgtttggcactttttttgttataaaagcactttaatgtagattgtctgatttatcatgattgttaataatacagtgctgctacatgttgtgccaaaaatatgaacaggaaatgagtctgaagtctcaattcagcatgattacacatatgaactgatacaacaactaaaatgaaaataagtggggagaaagatagtagtggaaactataggtatgaaaaggaatagaagaattttgtgcctttggggaggtgatactgccagcaggtaaatggagtccatgtatgcatatataaattactgtcttctgtattagttcttttcatttgttatttttatgtatttacttgccttttgagatggagtctcactctgtcacccaggctggagtgcaatggtacagtcttggctcactgcaacctctgcctacccggttcaagtgattctcctgcctcagcctcccaaggagctgggattatgggtgtgtgccaccacgcctggctgatttttgtaattttagtagaggtggggtttcaccatgttggccaagactgctctcaaactcctgacctcaagtgatctgcctgcctcggcctcccaaagtgctgggagtacaggcatgagccactgtgcctggctgctttttgttttgtttgttcttttttttgagacaaggtctcacttcgtcacctaggctgcagttctgtggcacaatcacagctcactgcagacccgtcctcctgggctcaattctcatgcctcagcctcccatagctgggactatcagctaatttttacattttttctcccaagaaatcttgcctaagattaaattattgtttttttgagacgagtctcactctgtcgccaggctggagttcagtggcgtgatctcggctcactgcaacctctgcctcccgggttcaattgattctcctgcctcagcctcccgagtggctgggactacaggtgcacgccactacacccagctaatttttgtatttttagtagagacggggtttcaccatgttggccaggatcatttcaattactggaccttgtgatccaccccccacggcctcccaaagtgctaggattacaggcttcagccaccatgcctggccgattattgtttttatacatacaaggtctcactacattgcccaggcctgcctcaaactcttggcctcaagcaatcctcttactttggccttccaaagtgttgggattacaggcatgagccactgcacctggcctcattcttttataaaacttttatttataattttaataatatttatcacagtttgaaattctttgtctctaaaagaaccatggggaaaagaataattttttataaaatttaaattatttaaaaattgttttctgtttattcactacactgtaagctgtgaggaccaggaccatgtttttgtatgtccagctcgtaggccagtgcctgacatgattttgaaggaggtgacaggtagaaattgaagaaatttattggaaatgttccagatttggatggttttcattctactagatagcagaaaattttttgggctgggtccagtggctcacgcctgtaatcttagcactttgggaggccgaggcgggtggctgtcttgagccaaggagttcaagaccagcctgggcaacatggtgagaccccgtctctacaaaaaaaaaaaaatatatacaataactagccaggtgtggtggtgtgtgcctgtagtcccagctacttgggaggctaatgcaggagaatcacttcagcccaggaggtggaggttgcagcaagctgagatcgcaccattgcactccagcctgggtgacaggagtgaaaccctgtctcaaaaacaaaaaaaaaaggaaaataaaaaatgggaagtgttaaggctaagctcaatactttgagcctcaaaagaaatattcaggccatggtcttgagtagtgagacaccagaagtatggagatagtgatgaaaagcagtcaatgcttttcattccctcttgcttctgtgttttagggttccgaggtcctggcatgatagggagagttcaaagcaagtatttataggttattagaattgattttcttagttgtgaaactgtcttgttccacagctcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaaggtatttttttattaatcctaactagtagcctgcctgtttcatagttctcagcctgaaaggccatgcgttatccacaagaggaactttaaaaaaaaaaaaaaaaagaaggtacctggtcctatttctgcaaagtttcttgtttggtagaatagggttgtagcctgagtatccattctaaagcacctcaaaaggcaattctgctgagtagccagggttgaggatagcccagaaagtaatgtgttcaagttagcacaaagttgtaaatacattgggaggattcctattttctccctttcctgcactttccttcctcctctagtcatgtctcctctttaatgttttggagactgtgtactcttagacttcattaccagaaattttgggcaggctgagcgtggtgcctcacacccgtagtctcaacattttgggatgctgaggcaagaggatcacttgagctccgagcttgagaccagcctgggcaacacggagaacccgtctctacaaaaaaaaaaaaaaaaaaaaaaaaaaaatcaaactagctggatgtggtggcacatgcctatagtctcagctacttaggaggctgaggtaggcggaagattgcttgaacccaggaggtcatggctgcaatgagccatgattgtgccactgcactccagcctaggcaacaccttgtctccaagaagaagaaaaagttttgggaacatttcttttttttttttttttttcgagatgggatctcgccatgttgcccaggctggtctggaactcctgggctcaagcgatttgcccacctcggcctcccgaagttctgggactacaggtgtgtgaaccaccatgcccagccagttttgggaacatttgttttagaagaacttgttaggaaagttttaagtttttaatgacagaactttaaatacatgaaattttttattagtgtgtgacaaagtatattacaaaaaatttttttcagccaggcatggatcatgcctgtaatcccagcactttgggaggctgaggcaggtggatcacctgaggtcaggagttcaagaccagcctagtcaacatggtgaaaacccatctctactaaaaatacaaaaattagctgagcatggtagtgcatgcctgtagtcccagctactcgaagggctgaggcaggagaatcactttaacctgggaggtggaggttgcagtgagccgagattgcaccactgcactccagcctgggcgacacagcaagactctgtctcaaaaataaaattaaattttttcccccacaacatgggtgaaaaagcattttttgaggcaagcatttaagggtttgattttatagctgaccttaaatgttatgtgtaattcatatataaatgttgctgaactagaacattaaaattgtctttttacctaataggttaagttggaatatcattatgtaagattgagtatttgagaaaattagcaattactttgagaaccttatgcgtggggacaggggtgagtatatttgaaaaggtatgagaaagtaaggttgtctgtgtgtcttattttctctttactaacgtatcagggtggagagtaggacagtcacacgacttagacatactcctttatcaatacttttggaaaatagctgtgctgtcagctttttgagggggggatttgttttggtcagtcagttttatcataaatttggcatttgggttaaaacagcaacatggaacaaataatttttagatgttggaaattcctggttttttttgttttgttttgttttgtttttttgagacagcgtctttgtcacctgggctggagtacagtggcatgatctcagctcactgcagtctcgatgtcctgggttcaagcagtcttcccacctcagccccacaagtagctgggactatgggcgcatgccaccacgcccagctgttttttgtcgtagtttttgtgcggaggtctccatctgttgcccaggctggtccagaactcttgaactccagcaatctgcccaccttgattgcccaaagtgctgggattataggcatgagccactgcccagcctggaaattcctgtttctttaaatgaatcatggatatttgtctgctaagaacttgactagaaggccaggaataaactggacgacctggatacccacctactttagactgctgcattgtttagcagacataatctctatagcacagcactgactatccagaatctgtacacattcttttacataattatatcatgatttgtattgggtattaatattagcaaattggttgaccctacttgtcagcctatattgtccactagcatcacttaactgctacatttttcctgggaagtagaatgtaggtgaagaggaacagaaaacatattttgaaaatttgtgtcttttctgacagtaaaaatggtatttcactgcatttctttttctaagacattgagaaaatgccccatcaatcatgactattcttttattcttgatcctacttgtgaatttgcagatataagtttttgttagccaacaactagatttagttagcaactcatacattacattagattgagtgtgttgtattgctttaaaaagatccgctaatttaattatcacacaaccttgtaagttgggtactcttattatttgtattttcctacttcatagataagaaaactaatattgggataattatgtacttgttcacagctaatttgtaagtggtagaactgatacagtactcaaatcaggcatttctgattccaaagattttttttttttaactgcattactggttacttgttacttctaagttaaaaaatctactcagactttttaaatctggaggagctaaaaaaaaaaaagcaagtataattgattagcaaagtagttgttttaagtattactaagatgtattagtaatagaaaaaaagaaaataatttatttttatttttatttttatttatttatttttttgagacagagtctcgctctgttgcccaggctggagtgcagtggcgcgattttggctcactgcaagctccgcctcccgggttcgtgccattctcctgcctcagcttcccgagtagctgggactacaggcacctgccaccacacccggctaattttttgtatttttagtagagacggggtttcactgtgttggccaggatggtctcgatctcctgacctcgtgatccacccacctcggcctcccaaagtgctgggattacaggcgtgagtcactgtgcccagccaagaaattaattttttttttttttttttttttttttacttttaaaacctttttgttaaaaactggagcacaatcacacatctagggcctacccaggatcaggatcatcgagatgtcactaggccaatcaaacagatttttcagctccaatataattttatcaaacccctattgtatatgtgtttcattgttgactgaaacatcattacgcagcacgtgactataatagaataatttttggcaatgcaaaggaatgaactgatggacacagcatgggtaaatcttaaaatcatgctaagtcaaagaagccaaatacaaaagaatatataatgcataaagggggatggacttaaaaggggcacgaagaatcttttggagttgatggaaatggtcagtatttgattaatgttgtttcagaggtgtatacagctgtcaaaactcattgagttgaccactctaaatggattcacttggttgtatataaattaagccatagtaaaattgcttacaggaaatatgctgaggaaaagacatctaacacaaagagcataaactttgtgatacctttatttgaaattctaggccaggtgtagtggctcatgcctgtaatcccagcactttgggaggccgaggcgggcggatcacaaggtcaggagatggagaccacactggctaacacggtgaaaccctgtctctactaaaaatacaaaaaaaattggccgggcatggtggtggccacctgtagtcccagctacttgggaggctgaggtgggagaatgacatgaacctgggaggtggagcttgcagtgagccgagatcatgccactgcattccaacctgggtgacagagcgagacactgtctcaaaaaataaaaaaaaaataagaaattctagaaatgatgattttgatctgtactaacagaaagctaaataattgttgccttgggtggcttaggggaaattgacagggagcaagcaccacagacaactttggagtgattctttaaatctagattttagtgataaaaatgaatgtacacatttgtcaaaatcaatcacaatttacattcaaaatgttgccttttgtaggcaagttatatctcaataaacgtgattttttaaaaaaagttaaatgtgaagaatgtacacacttatataagaagcacacaaaatggggtgatcagtgcctaaagatatatgtgaaaagagggactatctagtgcttcactattgaagaatgaataagaattttcagtaggaagtgggtacgttacaatctctgtcagagattggaatagagaatattcctgatgaagagatgtacaaagaggaatggtttagtgcttatacttagtgcttgtgctttaaccaggtaatgtggtattggcactaacttaattgaatcttcacaccaatccagcaccattgatggttgccagaaagtagcgtggttgggattgaacacgtgtttgatagcaaaacctgctgttatccacagggtgtgaattgtttggtatgcttttagtctaaggatttatagaagatgagaggaaagatggttggaatgttattatattctatggacagttgtgtctgttgggttctaatcaaaatatcaaaccggttatttcaacagagaatgataataataataataattattattattttgagacggagtttcactcttgttgcccaggctggagtgcagtggtgcagtctcaccgcaacctctgcttcccgggttcaagcaattctcctgcctcagcctcccggagtagctgggattacaggcatgtgccgcaatgcctggctaattttgtattttttagtagaggggggtttcctccatgttaggctggtcttgaactcccgacctcaggtgatccacccgcctctgcctcccaaagtgctgggattacaggtgtgagccactgcacccagccgtcaacagagagaatttaatataaagaatttgttaactaggtataaagtagttaaccaaataattgaccttttctctttatgaagagcttgatttccaatggtttcattaacctaggtattaaagtatgataggaaagaagagaacttggcatcccaaatgtataatgtatttatatttgtttttacatttaatatttatgatattaacataatatctcacctgttaagtattaagcagctcctgcctacccagcattattttaggccaggaagtctttctgagatagacacccctttagggagctcacagattctaagtctactacattgggtctcaaaaatgtgatcacctgactagtagtatcagtataacctggaatcctgtagaaatacagattcttgggcttcacctcagatcttctctactgaaactctaggaatggacctcagcaatctttgttttgacaagctttccaggtgattatgatacacacttaagtttgagaaccactagcctaataaaacaggacttgaaacagcttagggatttcacatactgaactgaaggttacaatttttctgggtctgagtttttctgggtcttaccaaattgactgcagtattaaatctacaaaacttcaaaagtcagttagaaacagcattaaaaagtgcaaaaagcgtgtttgtattctttgtatttgtagctataaacacattttgaaggtaaagatattaatccaacagcaaggtacaaattactttcttttttttatttttttattttatttttattttttttcacaaatagcactttttatttgccactatttgaagtctgaactttaaacagattcttggactggtggttcaaaaccatcagctcgttcaactttagcacctctctcgtccccagtggcttttccagaactactgccttcaccatgaagctccatgagctttcccaattcaaacttgggcttcttcagcatttttacttttctaacgaagacatcatggagaggatagattggcaagccttttctatgtcttttccaatgctgtctggaatcaatttattgaccacttctttcaaggcatttgtctgcacctctcgggtcatgatttccatcatcttcttccggatttggcggacccgttggtgctgggcataagaggtcttctgtatctgattgttgcgttttttagtaaaaccaacacagaacagacgaagcaagtaaccatcaatagtcctgacgtcaacgtgagcttcaatcattgtctgccattttttgaccatggaacacattttgtcacaggtaagatccatgccatggaagttaggcagtttttaccctgaacatcttcagtaatcagcttgaattttctaagtgcaacttcatcattctgcaaatcagcaagactcacttcaaacacacgacccttgagaccatcagatgcaattttggttccttgggtcctggtgatgagcatctttccaatatttcttatattgaacatagcaggtgctttcacatcataccaatctttcttagaaaatggatcaaccactttcttcttggccccctttttgctgcctttcgtaaggtgcttgttcttgccaaccgccatggtgctggtcagagagccaaaaggaagttactttcaaatgaaagtaaaatgaagttgaaactagacgaacctctagatttttaaatccagtgtctttaatgagtcagagccagctggactatactcatcatcttgatcaaccataagcacttcagacagattgtccaacttatttttaaatacttcctgaaagtaaataagctagaaactggaaggcacttgcatttctttctgttgtagccagtcacctcattttgccagttgtctcctagtaaattcttgaatgtgcatttcattcttatcccaacccccagggcaagtctgtaggtgcctttctgtgaaatagaaaactgcaccccctgccccccacccgcccactgccagtcacccatcaaacaaattaggaaagagccctttttcatcaagtgtagaaatacacatggcctggcaaagcatgggctgcatttcagtatctactccatccccttggctgggtgctatttattgtgcagggtgcagtttttaccactgtatgcatccaccgcatgcacactgtgaactaggtagtgccaccattatacattaagatactcatatctcacctgagctatactttcctttagttcacttgagtttcgatttctctctttttttttttttaagcatagtttctcacacttggcttagctataagaatctctcaacaatatttgctctgaatataaaaacccatgaatagatactaagctaatcatgttgttagatcattcaagagtcatcttcaggcaactccagggtctggaatatttgcattgtgggtgctgttacattagtatattcacagttttttccccctcatcttcttcatgatggtacattcacagatttatcttggcattgttttaccaaagaatctaaggtggatttcccccctactgtgtttcttacataaaagccagtatccaagtgctgtgcttcataataattccacgtcaggtaatttgtatttataaactagtttcgctatcctagctgacacgcgctttttttccgtgttaaaaacaggcactgttttctttctagcactgaaattgaaaacagaggtgtcattgtttttagcacatgatccatctaaccagtgctgcacatcttcaaatttgccaagttaggaaaagtacttagtacccttgtttaatgtcttaggtacaataaactattaaacaagttgcttacgagttggctgcaacattaaagctacgaaacttcaaaaatcagttaaaagacagcattaaaaagcatagaaagcatgtttatgttctttgtatttgtagctgtactcataaaggtaaagacattaatccacaacaaagtacaagttactttcaaataacttgccacaggttaaaaaaaaattttttttgcctcttcaaaaagcctcaaggctgggcgcagtggctcacacctgtaatcccagcacttcgagaggccgaggtgggcaaatcacctgaggtcaggagttcaagaccagcctggccaacgtcgtgaaaccccatctctactaaaaataaaaataaattagccgggtgtggtggcgtgctcgtgcaatcccaactactcaggaagctgaggcaggagacttgcttgagaccgggagttggaggttgcagtgagctgagattgcaccactgcactccagtgtgggtgacagagcaagactccataaaaaaaaaaaaaaatccataatgcaagttttacacttttctttcgataaatggtacatggacttaaccatgcaagtaagaatgatttttgtattaagatttttgaattctgaacactattaaatttctgttccatagttgtatctgttgagagctaatcagaaaaactagttatttcaacagagagaatctaatataaagaatttgttaattaggtataaagttgttaaccagataattgagaaggcaagaaagtaactctaaggtacttccagaggaagcaattgtaaaaacagctaccactcctagggttggagaaacaaagagaagggattggaattattaaaactgaagcatagaggaggaaccccgtggagctgacctgaaaaagagggcattgcttgcctggtgctcaatggagagacctagttctcagaggattcagtactgaggggttggtttgtcttgggggttgtactatgagcctagggttgaaaaaactgcaaattagattccgttactgcttcagaaaggaactgccgatgctggggtgaaataaggcttgggtgatgctgacaggaacagccaccagttgaagtcaagggatgcagatagaagcatatctcctccctcttccaaactcttctattggcaaaggctaaatgtgatttgcactctcaaacctagcatcacaagacagaaggatgaacttggagatgaatagacaagaatgtacacacatcttcagactttcaaagttagggggaactagcttaaggttttaggtacaatcgactaattacggatctttaacctttggacagatgttacagctgctgagttttaaaagtcagttaaaggctgggcatggtggtgtgcacttgtagtgtcagcttgctgggagactgaggcaggaggacacttgaggctgagagtttgaggctgcagtgcgctaatgattgtgcctgtgactagcccctgcactccagcctgggcaacatagtgagacccccatctctaaagaaaagaaaaatttaaagtcagttaaacagcagcttaaaagaaaagcatactgggcattcgagtatttcaccttctgtatatttgaatatattaaggtagcaaactatgttatcttcacataattgtcaaaggatttagacttttcaaaaaaggtataacttcactaatttccatttgtcttttctttgtattgttaaataaagtgtaatcatgtcattgagaagaacttctattataatatcctgagtaagggatttaagttttgacttgtatcattattaaatttctatcccatacttgtaaatactaattgtatgcttttaaacctgtatgttttaaattcagaggtaattgcaataaaagaaagcacacataccaattttcttatagcaaacaactccaccagaatccttaaatctaagatgaagtctaaatatgtcacttagtgcatagaatcccacagtggtttcctgtcaaattaaatacacggtccttagcctgacattttaaatgtcttttaagacaacctcatatgataacaacctactttcctagtatctctcattactttcatttttctctcctgaaagcaagcaggctggactgctttccatcccttagcaggcacaaaaatttttaggcttttgctcagattgctcctcacctctcgcatgccttttcagtggtttttctctctttatgtacccgtcaaaatcctaccccttcttcaaagccatctgcagttaatgaacctcaatgaagtttgtcctcatctacacaaatgatactctttccccacaataccttttatttttctcataggtgttttacccagagacacacttaaccatctttagtatctggctaaaattctgttaatataaaattctactcttaatatttccagatattactcattattccctttcgaaagtctgcccagactttgcacccagatttctacacctgatgctccccttgatgtcttaggcatgctcactcatgacttttttttttgtttttttggtattctaattctttttgttttgttttgtttttttttgtttgtttgtttgtttgtttttagtagagatggggtcttgctatggtacccacgctggtctcccaactcctggtcacaagcaatcctccctgtctgtctgggagcaaaaggaaagcagtttttgcgtgactcagctcccaagcttatcttgccctttgatatagtgagtttggggtcttgagattttattttcctttcacagcattgtttagagactatgggttgtaggccaggtgtggtggctcaagcctgtaatcccagcactttgggaggctgtggcggtcggatcatttgaggtcaggagttcgagaccaggctggccaacatgacaaaaccccatctataataaaaatacaaaaattagccgagtgtggtggcgggcatctgtaatcccagctactcaggaggctgaggcaggagaatcacttgaacctgggaggcggaggttgcagcaagccaagatcgcactactgtactccaacctggacaacaaagcgagacgccgtctcaaaaaaaaaaaaaaaaaaaggagaatatgggttgtattatttctaccttcagaattcattactagctttttagtggcttaattatacttgatcagtgtttttttaagtgtgtcatgggtgggttaacattttgcctgttttttttttaatttatcctaataaagttgtcattggcttcatatataacttgctgatagctatttctctgtatatggtaaagcaagattgtatgtataagtgatccattgcagttcttgattgtacctttcttccatgttaaaacatacttatgtagtgttttgaaatatacttttaatattatcacttctttaaattttgttttagcattcacctggttcattcctgtccatcctttgattttcagctatctgagccaccgtgcctggccttcctctgttattgttatctaaagtcttttcagtatgcctataggctggtttttatattgtcattgtgaaaatccaggttttcaattgttttatatagtggctgttaaggaaataaacaatttaagtaatttgggggggggcataaataagtcttaaccaaaaaagatattttatcatagaggaggaaataaattcctcatcgagacacctaaaaacaatcagtcttaacatattggtatatattctttgcctacgtatggagtgagagggggatggaagaaagggcaaaatggggaataggtttctatgtcaaatatcttcagtattattgttaattcacttgttttgtaaactaatagcttatcctcttgagcagggaagaacaagtattctttgtggtatataaactttaaatgtttgaggaatgagtagaagaaagacttgaacttcttaattttttctttttctctctgaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaaggtaggtttctcagtaaatttatcctttaggtatttttgaaaatgagtggttaagtattttatgttcagaaaaattacatagaaaagtatataaagatcactcataatcccagcaattagagaaaaccactattagcaaattaaggcacatcctatcagtcttttcatagatacatatatttaaatatatataatttaaatatgaatagtaaataattgtgtttctactaacatactgaggaaaaaaccataaaacctcacagaattaatgctttcctggaaactttgaaagttaataacaccggacatgtgagagtatttttaaagtttctgaaagctaattttataagtgttttaactgcagaacgttatttctgaggacagattgaagacattagaatctaagatactctcaaattatgttttagaaatgtcggccgggcacggtggctcacgcctgtaatcctagcactttgggaggccgaggcaggtggatcacaaggtcaagagttcaagaccagcctggccaagatggtgaaaccccatctctactaaaaatacaaaaattagccgggcatggtggtgggtgcctgtaatcccagctactcgggaggctgaggcagagaattgcttgaacccgggaggcggaggttgcagtgagctgaaatcgcgccactgcactccagcctgggcaacagagcgagactccatctcataaaagaaaaaaagaaaaaagttataagcagtttatcatgacagcaggatttgtttctctttgtgtggtcagtgaaatctttttcaaatgcttcagtattaagttgttatttgtcttaatttctctttaaaaaattattaatagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagaggtaacaaaaatcatcagaaatataaaatcagaaaaagttacagtttgtcattttaatctttgcacaagacatttttttgattcgataggcagtgattttatgccatcttcatgagatgaaaacacttagaataggtcctgtgacttaagttgtcattagaagagttagacgtagcgtatttcacagcatcacagtgtgatggttggcagcactgcactgttgatcagaggggccagcatcagaatttcttagttgctgtaaagtttttaatactgtaaaaacgtaaagctttccagcaattattaagaaagtatcactgaccagagaaattcagtaaaatttctaaggcagtggcattttgttaggattgattatataatgcttttataccattacattttggaacttcccattttattcctactggaacacactggtctcccccatctcccaccacctctgtacccgctacagtcactgtctatccttttttactattgacagttataaatattcatacccattttgtgggctgccctcattggcttgaaaacactgagtacatatttattaaagtagcacattttagttgctagagaagaacaaatcatcatctctgctttagttataagaatacagcattatgtaaaatatgtatttttttggcttaggttgtacagcaagatggttctcattgacatttttgaagtgcttatgctcatatacactttttgttgatggatttttatcattatttcatttcccccttatttttatttgctggttattagaaggtaaaattggaacttggcttatccgggaaattgttcacactttatattcagaatcgctgtgcatggatttcatccccatctcatgttcccctgaggcatttctactataatatccttttctaattagcttgttcccctcatgttactggctctctggagttgtcttaaattctagaacttttaaacttaagtccctctttttgcttataatagagtaccacctttatcttcatctttgttgttgttgttgaaacagtgtctcattctgtcacccaggctggagtgcgatcacaactcactgcagccctgacctcttggggctcaagcagtcctacctcaggctcctgagtagcaggcacgcaccccccccaacaccttgcaaatttttatttatttacttatttttttgtagagacgaggtctccctatattgcccaggctcatcttgaactcctgggctcaagcagtccttctgcatctgtctcccaaggtgctggagttaaggtccatgcccagcccgtcttcattatattatctagcattattgttctaacctggctaacactgagttattctgtcagtggacagctgcctaagagagcaggggagggtaagatttctgactactcttactgtagttggtctagagtagtagaggaaaaacgagcatgaaatgggtcctgagagtttgagatgattatcttggggagtggggggggtcctattccctggggctgtcccattaatgtaatagtctggattgtatttgaattcttcacagtatttgttaaaactgccagctgtcattcttgccaggtttatgcttgttttgtgtataatttagataggtattgtgctttgtatctatgtgtggtgatgtaccaattttattagcattaatttaacatgcccacattactcatgagaaagagagtaaatgtgaattattaagcccattccagaacagttctttgccagtagaggttttgcaaaacagtactaccctgtgatttgtccccataggttatttttaaaacaaagttcttcttgatgtgacaaaattaagacaaccctaaaaatgaaaatgtttttaatttaaatttaatttaaaaattaaatgtaaagtatttcagaatatttgccacaagcgtaataccatacttgaaataaatgttctgaattaacactgaaatattaaatattacctaagcaggcaaaattctgtttgacttgaaagaattaactgctcttaggagttgatactgttccttttaatttataccccctttaactttttaactttttttaacttttttttttttttaaattaatttagttagttaaaatagagacagagtcttgctgtgttgcctaggctgttctctaactcatggcctcaagagacccctcatgtcatggactcccaaagttctgagattataggtgtgagccactgcgtctggcgctgagtcttaattataatcattcttaccccttttaggtcattcttgcccctttaagaatatgacaaccctgtactcagagtaatgtacatatatatgcaattttgcacacaattttagtaggttctcaaattatctatatctgagcctcttatttcagaatgactgcccatgttctgatttcctcatcaaaactgctgaaaatactgtgtttttagcccaatacctgtgaaagaatcctttgtgagtttaactagttgtagctactttattctactctttcaatagtatactccccatctagatttggaaataatagcataatctgaccatgcaagtaagtctttattttcagttctatattgttaatccaggttatcagatatagcttacgttttttgttttaaactattggacaagattaaaatacatacaaccacacaggattaggagtagagtatatgctggaagtgttattaaaataaggattaatgttgaaataaggagattttctatatagttattaattgaaatagatgatgataaaattaaaatgccatcatgaggttgggcatggtggctcacgcctgtaatctcagcactttgggaggctgaggcgggtagatcacctgaggtcaggagttcaagaccagcctgaccaatatggcaaaaccctgtctctactaaaaatacaaaaaattagccaggtgggtggcgtgctcctgtagtcccagctactctggaggctgaggcaggagaatcgcttgaacctgggaggcagaggctgcagtgagccgagattgtgccactgcactccaacagcttgggcgacagagtgagactccgtctaaaataaaataaaattaaattaaaatgaaatgaaataaagccatcatgaagcaaatcatgaaacatctggattaaattgtagacttctattttgtggttaaccgggattaaccagaaaaccctttagattccaattcgtgtggctgaaagactttaaaaagtatatcagggccaggcgcagtggcttatgcctgtaatcctagcactttgggaggccaagacgggcggatcatctgaggtcaggagttcgagaccagcctggccaagatgacgaaattctgtctccactaaaaataccaaaaattagccagatgtggtggtgagcacctataatcccagctactcgggaggctgaagcaggagaatagcttgaactcaggaggcacaggttgcagtgagtcgagatgatgccactgcactcaagcctgtgcgacaagagtgaaactctgtctcaaaaaaaaaaaaaaaggtatatcagtgtgctttctttccctggcagaggattttaacaattccccatctatttataattccttgataatttctctgaacatacataatctaatagaatatgaatgcatactagtcttgaagattagctacttatttttgtctttctcctacaagcatgtagctaaattatgattaactaaggttatattcccctctttcagttttaattcgtcaagtatttattgagcattgattatataccatggtggatatgagcttaggatttggacagtgctgtccagcagaacgccctgtaatcatggaaatgttctatgtttaccctctccagtagggtagttttcagccatatgtggctaatgagcttttgaaatgaggcttatgcaacagaggaacagcattttaaattaaatttaaataaccacatgtggcttgtggctaccttactgaacagagcacctctatagatctcagttctgcaaacttaactctttaggaaagcttcagtgagttccttaacctgtctttgaaatgtaaatattatataccttctggaatgttatgatttcatgagttaatgcatataaagcatttgctatagcacttgacatagagtaagacctggataaatattagtgattattactataattgtatgttatgttttgtgccagtatcccagaagggaatacagagaagaaaaagatacataatttccatgcttaagatgtttacttgcctcaaccaacatttcagggttcacaaagcatgctgttgactaggtgatgtgacattttgtatgggccttgccagaaacttccaatagtaagaagctgtgatgtggtagacacagcctgagtctgagctgaggtggggtttttgaggtccttgtccaggcaaggagattggtttttagttttcattttatttgtcaataagtagattattccataggtgcacactatatatttcaaagagtctaaatacaaaaaggtaggttccactctaaaggccttagtttatcttaaattctgttttcaccatatgaattctgttttggcagcagttaaagtttaaaatgttttagtccctgtccttagtgctttatgtgtattatcttgttaaattctcaaacataaccttttatgctataagcccaaaaccattatctgaattccctgaagacagatatatttcagaatcccagggtttttttagattttagaaaggtaagatagagcatataacttcagacaagtgttattagtccactaatgaaacacatggtcacattaaatggaatacctaaggattaaaaatagtttatgaaaagttcagatcacatttttccacaaatggattgtgagatttggtttgacattaaattatgggaattttccattttccaggatttctgacatgtggaattcagataattctgtcaacttgtgttacccatatttgtgcagttgttactggtgaaacctgtatttatactcaggcttgtctgttactaattctcatgttcattctttctacataatagggctagttttggttgaaaacttgcccttaacatcattcaccttatgctgtccaaggtttttatgaccctttaaaaaaaagatatagccttgccctgtcaccgatgctggagtgcagtggcacgatcatagctcaccacaagctcaaactcctgggactcagagtccctactgtctcagcctcctaagtcactaggattacaggcacatgccactatgcctagctatgacttattttcgaaccctcatttcatttcttgttgactgcatattttctgtaactcaaacagtggtggatgctcagtgagtattttttgaatgaatgattcagtccacaggtagctcttttaatagttcctctaatgtcattggaattttctagcacagtagggtaaaaggcagaacaagggcataattcatttgcatagtttgcaaaaagtgccatctggtttcatgataaagtacagtcaaaataggtatacatgaaaactactttatcattattacacatggtgagaatgattgtggagtcagcagggtatgttgtacttacatggatgtatggacatgaattggtacttcatccccttactagatttgctgtaaaacaataacaataacactttgatatttttccgtctttttgggctggtaatccctaattttttctagtggaaagagcactcttgtaggaatcaggagaactgagtctagctcaaactttgctagtcattacctggatcacattgggaggttacaatttggtttggggtactggtatcctgatacttgaagtatgtttaggagagtaaaagttgagctaagttaaattttaagatggccaatttttcctttgagtatttaaactactttcagggcttctttcttcttgcccagggaagcactgctctcagatataaaaaagacaccccattgtggcacccaccttccctgcactgctccattatctggaattagttctcttttcaccctggattctgtttctcttagttctgtggctgtcagctgaggacaggaaaactcagtctggaaatttcagatgttaaaacagggaggaaatttggagcagggtgcccgctccatacctcttcatgccttatactaaggattttgcctccacattgaagattagatagacctcagagtattattttgccctcacagatttctctgagtcatagcatccttttctcctttgctgatctcataaaagtcctgtatgttctggttctacaaccctttagcttttcccaaagtccaccactgacctattgtttgtcctttcagaggttgggatttaacagactccttcactgcttgtctgcctctgatgaggttttggttatctttagaccacagcccttggcaaatccacgtctggactcttggtctagatagaactcaccgaaccaaaaaattgagggtgaggtcactgcttgtaagagaatacctacttcctttctcagtttgatttttgatattgagtgtgtgctggtagcactgcgcttctcaagtgcttttaaagtaccctggctctgggctgcagtcagagtactgttctctttgtggttgagaaagctgacagcgtaaaggcatgtcactgggggactttcaacttttttccttagccaagagattgggcaggagagagaaacttacagagtgctaggggaagaacttagcagagcatcatgaacgtagcagaaaatggtcacttagttgggtagaaccagagtagtgaaaatgaactcacagcctggatctgaacaatatcactggaaagtaatcttagattaaggtttttagactggtttacactaaggttttaacttaacgattccccacttgagaataaagccttctaacattagatatcttacctgtttgtatgctgtggtaatagagagtgtgggtgcagatactggaacaatgtatatcctacagctgtgtttgcagagctgggcaagagccccaagagagtatgaaaagggatgtttatcatctaaagtggcgagtccacgagtctcaaggtagacattattccttggttcttattttatgacttaggacaaaaacaacagttcatattgttcacattcccctccctagctgctataattaaacccactttggggttatatacgttgtttgtcacccataaaatatttcctaacacagcgggatcactcacagtcttacacttagataatctattaagtatccgtttataaaatattcataaaacaaagtaccactgtatttaattcacctggttatttttaaatttttacaactgcacgtttagactggagcctaaccattgcttttcagttcaaaattcttgtgaaagggatttgaaattatattttaaggaaaaatattctaattattgggtaagactgtgtagatatatagactgtaaagcaaaagctggaattttctttaaaacgtattctttttatgtgctgacaggttttaccaacctcgccagacaaaagggatcatttaggaaaataagaattcactgtctttttccctgtaggttgtccctgtacagccagtcaagtatttctttggtattctgggaccccagtgatgtctcacatgagctcgtaaacaatactcttaataattttcccttttgttcctctcgtctcctcctttgaaggtcactccttgggaagccacttgaatccagggctcctcactattgctcctttggctctgagggcacactgatgcccgtatcggggctttcctggagctgctaagcatgaacctttaaactaccaaagcagtggtgctatgttcttggaagaatgcttactgtctcactctagagaactatgcttgtccttcacatctcactgactcttgaaaagccattcctttggcttcttttatctgcctttttccgtacagccaaatagaaagccatagaaatagtagggttaggaaccagttatctaaagtacactttccccttggtggtttccttcattcctggcaaaaattttcccactccagcaccgagaactgaccaaccaagcaaacctcacagaagaccatccttcactttatgagccatgcccagaaatttctggatctcactttaagttcagcctaggacgttgattacatttacctaaagtgacaccttacggattgcaaggatttccatctaaagcaattgtcttctgctgttccagtcacatattctcacctcactctatagtcagcagatcccagaacctagccagtctgtgaccatggagcaaagcaaaaccccagatatgtggcattaaccagcttttaccattcttgtaaatatctgagaatagccccgtcattttcatatatctctgtgaaaagaacaactacataacttagcatccacttttgagagggaaagcatttatatccagatgatacatatattattaccataaatatgcataagtataacataaacattaaaaccttatttttaccatgtttgcctacttccaccatataatatgacttgattattactgttttatacatatatatatatatatttttaaagtctagattccatgcctacaagtttctttctgagaggaattacttaataggtttatgctatctgattagtattaatttttaatactaactcaattttcttgtccccaccagctagaaattttttaatttgtattttcaatgcagatgcagagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcaggtatggcgtgcatttaaccacataagttcaccaaagattgaatacatgagaaaatacttatggactaggtatgtttcttttgttaagacatttaaaaaattgttttctgtagggatagagtgtgggggggtgatttctagcatttattgagcacttactgtttgccagatactgctaaacactttgcatacattcactctatgaggtgtattaaataataatcaccacttacaaagaagcttaagagataatggctttgcctgaggttgcagagccagtaatgagattagaaccttgttctttccaaaccctagcccatattctttaccactactcttttttgctgttctgtaacagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaaggtatttaaatattgcttttgttcattatttagtcttttatccgtatctactaatctcatctgttttgtctttaaaacttgcttatgttttaaaactaagtaagcactatctcttatcagtgctcaatgcgtttatagtgctctgagaattgccctcttaaacacattggaacagccaatagtgatgttctctttacctctagaaacactaatggtgactctgctaaaggccttgactacaggatccctgataatgtgattcctggctccctttttatttaaggaggcccagcgatgttttttacaagccctgattctgaccttaaagaattttatagattgttatttctttatttaactttgattacattttagaatgtttgattcttgatatttggaatgactcattttgtggaaatgtgattcttcctgtgtcttaaaaaatgttttgcactctagtccagatgttaactatcgtggagctgtttctagtcactgtaagtgtagagttggaatctggaactagctctccaacctagaccaaactgatgactgtgtggtactgattcgctttaagctcaagtattataaaagtatgtcatgttctctgagaacccaccttcctgctcttcaccacattccaaggctaccacttcctcattccacagaaaatcaatacctttgctttttgaaatagatagctcttgcacattaaagaaactcagacaggcatgtatccacagtaagtcaagaacccaggaccttctatcacgttgtccatcaacagaacagttaccttgccatccagagccctggctttcacataattatgtgcctttgctatttccccgtgacagtggtaattgaaacccactgctgtgtcagccctggttgtgagcttcatttcacgttccaatctgcaccaaccaggtaaacattgcaggctgggcgcggtggctcatgcctgtaatcccagcactttgggaggctgaggtgggtggatcacctgaggtcaggagttcgagaccagccaacatggtgaaaccctgtctctactaaaaatacaaaaaattagccaggcatggtggcacgcgcctgtaatcccagctactcgggaggctgaggcaggagaatcgcttgaacccagaaggtggaggttgcagtgagccaagatggcaccattgcactccagcctggacaacaagagtgaaactccgtctcaaaaaaaaaaaaaaaaaaacattgcagtgatttcagcaggtcttatagaacagttttaggggagaatgaaaagtaaataagatttcagaagagcacatttttgaggaatattaggagtattttatatattacttttaggtgtatagtgcagtacttttgagactcggaatttgcaaacctgcaagtttttgaaaatgctatgcaattcagacttaattgaaagtctgatttcattttaattcaccagtatgctaggcacattgttagacttaggatacaaagatgagcaaggcatagtccctgctcctcctagtcttttagagaaggcaaaccaggtgaacagatgagtgttctgccggccaaaaacagcaagagcagggagtgaggaaaggcttctctgaagagatgacacttgtactggcttttaacatctgaatagaaattggccagattgatggtgttggggtaattacaagcaggacagaatagtttttagcaaagacactgaagcagaaaacagcatggtttgtcagagcattctacattgtaagacatgctgcagggcggggaccaagttatgggaaattttacataccacattaacaagcctgagctttgtctgtagtataagttaagcaaaggggtagtatgaacagattcacattttagcaagataaggcagcatgaaaaataggttagagggagaagagatggaaaggttctgattggaaggtgtcattatcctccacctcaataaggttgagaggttaagactatgaagtaagtgggtgcctgtgcagggtaagagatggacaaatcttgaactgtctagatctgacactttgcagaaaaagttagtaggatttagtgatgtggtgaaggagggaggaagagccattctctatcaaccctctggtttctggattgggcattgaggtagatgatggtgtcaccaaccaagatggaaaacccagaggaagagcacatatgggtgggaggtgataagctgagttttagacttgcatataagaggtcttgggcatccaggtagagatggctgtgagacagttgagacaattgggcacctgggtcttataagagtgtatgagatggtctcagaacaacatactgagcaggtgatttttaaaatattttatttatttttttatagagacaggggctcactatgttgcccaggctggtctcaaactcctgagctcaagcaatcctcagcctcccaaagtgctgggattgcaggtgtgagccactgtgcccagcctgaggagggtgttcttaggaatgatgaggtggaggtgggaggctgataggaaagagcaagggaaggtggtggagcaggatagatacatagtttgaggaagaaaaaccttcattgtatttaatatttgtaattcaggaagcaaaacgttcttggctaggggtgagaaagcattgtaaagggcacaggctatgaaagactgagctgctgtgatgtagtgcgaggagaaaggctctaaggaaagaacactggggaacatttgaaagtgtgtgcagaagaacgggatcaaagagaaagggtaatcgaagttggaagaagcaggagagctcgaagtcatagaagtgaagatgatgattccacacaacaggatggtcagtaggctcaggtgctccagaaaggtaaaggaagaaagaaatgactccatgacatccaatattgggagactattggggccttatgttcagagtttcgagaaaagttgtgggcaaggagtagatcttggtggtctgagaagggagtgcagcagaggtttaaagcagtgactgacggaatagcaaaggaaactgtacaggtgaggggtgaagaggagcaaccttggtgaccatggcccacagagctgtgtactcttctagcagtattaagagcttcaggctgaacttaataccggcttaataccagctcttcccttgttgataagtgttagctcatagcaatttaatcagtattcttcagtcttcatttctgtgttaatctaaatctgaagtagggaaacccagccttggagaatctctccatttacacttgtgtgcctgtaccccaagcccagcaactgaggtggcagaactgcagagggaaggagtagtgaaataaggaagggtggtgaaaagataggaaatgcaaaacactaagtcctaaaaagaaaagctactgagaagatcaaatatacaaggaaaaacaaatgtctccctatgtaacataatcctatattcccttgtttacatatcaacatgcccaaggtcactggcttcttggtttctctggcactcatcttaagattgcatacacagttcatgtcctgcctcaccccttgaaagagtggagataggtggtccccggctgtgctggtgaagtcaatgctttgtgattaaacatttcaagaagagtaacaaaaataacaattttctttgttttttatcttctttaattctcccagtagtcaaatgaaatccagagagctcagaaaattagaatcattttcatacttcatttggtggcaaaaccagacctgagctaacatgaagttatttattatcttattctcactttgacaattcatttaactattactgcttattatgggatatggtttcagatcttgcttattaggatatatatggtatatacaacttaacaccattctctaaattatcaaaaaactttgaatttcaaaacatgtctgacctctgttctagataagggattgtggacctgtatcctcatttataagcaagggaaccaacgcttctggtagtgacataaatcacctaaggaaaagcagctaatatggagcaggggtaggattctgtcctagacactcagagacctgagttactgtatcaccaagtcatgacattatctaacacgccctttgttttccccattgcactggatagattcttgataggcaatagagtgaaccagagtgggtaaagaacatgaagtaaaaaatgacattttgctttaaaataacagtttactgacttcaaaggttattatttgactttctctaattgaaagagtgatcattttaggctgggcatggtggctcacacctgtaatcccagcactttgggaggtcaaggtgggcagatcacttgaggtcaggagttcaaccaatctggccaacatggtgaaaccccgtctctactaaaaatacaaaaaaattagccaggcgtgatggcatgcgcctgtagtcccagctgcttgggaggctgagatgggagaatctcttgaacctgggaggcggaggttgcagtaagccagagatcatgccaccacactccagcctgggcaacagtgagactccatctcaaaaaaaaaaagtgatcattttagtatagctttggaatgttggagactaacccttttatctggaaaacttctccaaatagtttccttaggaaaggacacagggtaaatgaagatttagcttggtactggtaaaaagttaccagaatatagtgcataattttataaagtagtgcatatctcacagttattgcaaaaatcctgttttatatggtgattggaaaatatatgcttttttttcatagtttctaaataattttgataattttgactttctagtcttccaggtctcttgcagctcttatgtctgcgaccaaaagattcagatctcatattgtttaagccagtctggacaaaaaattcatggtctttaacttgtcagagggagcttaacaatacatattttatataagtaaatactttcatattcttttttgcccagacatgtttaaagagcataatgaagccaggtgccatgactcatgcctgtaatcccagtaactcaggaggctgagccagggggattacttgaggccaggagttcaagaccagtctgggcaacatagtgagacccccatctctcagaaaaaagtataatgagatgtggaatcttctggatgcagacttcagatctgaaagagacctttcaggacaacccccttcagtccaccttgccccatccctcctccttcaaaaaagagaaaccaggaggtctatagaagttaatagtttcatagaggagtcttttcgtaagatcctgattacttggcttttacagcttcagttgtccaaataagaaacaagaggtggtcaatgtgatactttgttctgtaggtggtatatattaagatcaaaatttaaccttggtgtggtgttcagagtctttcaagtttcacttgtattaaaacacattttatgtatttacaggaaatatgtattgcaaaacacaatgaaaaaatccaacagcgcactcggattgaagatgaatatagaacccatcacacagtacaactagtaagtttggattcgaagattttgaacaaaacttaatttttttgcatgttttagagtggataaaatctgtagagaatgataaaaaaacttataactgcatgttaacattagttcagtttatataatgagcagtttttaggcaaaattgattggagaatacagagttcctataccctcaacccgcacacgtagcctcccctaccgtcaacatctcctatactcctgtccccacacttgatagcctttccactgtcaacatcccccagagtggaatatttgttaaaatcagtgaaacattgaacatcaccattccccaaaatctgttgcttatgttagggttctttcttggtgttttgtgttctgttggttttgacagtgtataatgacatgaatctgctattatagtatcatatggaataatttcactgctccaaaaatccctttgttccgctactcatccctctctctccccaagcccctagcaaacactgatctttttatagtcttcatagttttgcctttaccaatgtatagttggaatgatacagtatgtaacctattcagttggcctctttaacatagtaacgtgcatttaaggttgctccatgtcttcatggcttgatagctcattttaacaccaaataatgttccattgtgtggatgtctcagtttgtttatccatgtgcctattgaaggacatcttggttgcttctaagctttggcagcaattagtaaagctgctataaacacccatggagggctttttgtgcacataaatttcagccaatttgggtaaataacaaggagcatgaatgctggagagtatggtaagagtgtatttagttttgtgagaaactgcaaaactgtcttccatagtggctgttccattttgaactcccaccagcaatgagtgagagttcaggtttttccacatcctctatagcattttgctgttgttacgtttttgaattttagccattctgacaggtgtatagtggtatcttttggtgtgtgtgggtgcgtgtgtgtgtttaagagatggagtcttgataggttgcccaggttagccgcaaactcctgggctcaagcagtcctcctgctttaacctcctgggactacaggtatggactcctgtgcctggcttttactgttgttttaatttgcaaatctttaatgcagatatatagataaatagatacatatacagagagcgaaagagcgcatctgtccaaatgcctacttgcccctctatatatctctagtaaggtgtctgttcagatcttttgctcttttgttttttggagtcttattctgtcaccaaggctggagtgcagtggcgcgatctcggctcactgcaacgtccatctcctgggttcaagcaattctcctgtctcagcctcctgagtagctgggactacagacatgcatcaccacgcccagctaatttttgtttttagtagagatggggtttcaccatgttggccaggctggtcttgaactcctgacctcaagtgatctgccctccttggcctccaaatgtgctgggattacaggcatgagccaccgtgcctagcctttttgctcattttttaaattggatttttattttcttattgttgagttttaggagttcttcatatattttggcttacactcctttatcagatatgtccctttgttttgcaaatattttctcatgatctgtggcttgttttctcattcttttgacagtgtctgttgcagaacagaagtgttttaacaaagtccaatttaccagcactttctatcatggttcattcctttggtgttgcatctaaaaagtcattgccagtccccaaatcagctagatttgctcctatgttatcttttaggagttttatagttttgtgttttatatttaagtctgtgatccattttgaggtaatttttgtgaagggtataaggtttgtgtctagtttaggcttgtggacttcctgttgttccagcaccatttgtttaaaagactgtcctttctccattgaattgtcttgttcctttgtcaaagatcagatgattctgtctcttcagtctatttttgggtgtcctattttgttttgttcatctaggtcttttgcctctccatataagctttagaatcagcttgtcagtagccacaaaaaaattgctgggattttgattgggacagtgttgaatttataagtcaagtagggatgacctaatatcttttttgtttttttcattttaaaatacttcttcttttagtttttttgctttttaattattatgtttattttagcctctaccgccttctcctacacctaacatcttaacattgaatattcctatccatgaacaaagaatatttttcatctatttaattctttgattctttcatcagagttttataattttcctcataaagatcttgtacaccttttgtaagatttatacctaagatacctaagtctttcttcctcttctttgtcagggaggtggtaatataaatagtattatgtttttaattgaaaactccagttgttcattgctggtgtattacaaaacaattgacttttgttaattaagctttttcttaataatctataatctagattttttttgtcagttttctttcagattttctacatctgtcttcagacagttttatttctgtatagcttttatttctctttcttattgcattagctagcacttcagtataatggtgaaaggagtggtaagggggacatctttgtcttgttcctgatcttagcaagaaagctctagtttctcaccagtaagtgtgatgttacctgtaggttttgggatagatgttctttatcaagtagaggaagttccccctctattcctagtttgctaagaatattaggaagttccccctctattcctaggttgctgagaatattagttcactttatataaagttacattagaaaccttctcctactcccatattgctgtgccgcatcccacacaatatatattatcctgacagtcatctttacagatgtgtcttaaattagttaacaccagtaatttgtacttaaatatcagaaatgccaacatgaccatatctctgtatttggatatttctaaaattttctgtctttagcatcatactaaaggccaaagggcttaaatttgtctccattactccttaaggcacattcttagctaatgctgccccttactcttcattttaaccacataaaattagccaaactacccataaactataagattacctttctcctagaatctagaaatagattaattaatgtacttttatttttcattactgtttctgtgggtcagaaactgctttataagattagtcaggggaccagcatgacagtgaggtaagttgctccctgctataaccatttgtacttgcattatcagtttacttatgaaggttccacacttccaatatatttctttttataaaacataagattttggtggaggggaagaactaattaactttttagaatgaatgagtatcagatctttttcccagatctattttttgggggcaacaggagtaaaaattagtaaatcgattatctttcttttccttttttttttttttttttttttttttgagatggagtcttactctacccaggctgaagtgcagtggtgccatctctgctcactgcaacctctacctcctggctttgagccattctcctgcctcagcctcccatgtagctgggattacaggcacatgccaccacacctggctaatttttgtatttttagtagatggggtttcaccatgttggccagggtggtctcaaactgctgcccttgagttatctgcccgcctcgccttcccaaagtgctgggattacaggtgtgagccaccactcctggccaagaaattgattcttaaggtaatcccaaagataaatgtcatctgccttagaattttgcctaatatcttggttggaatatataattgtcagagaatgaatccattaaataactagtcatctttaacacatacagataaagcataatgaaagttagcttagatcaaaatagatcattgtttttcaatgctagttttaaaccaccagtgtcagaacctcttatgtggtggattgtttaaaatacagattcttagatgttaaccttattattgcaacagtttcccctggacatccttgtgaattaaatatgcaagactaaggaagtttattttaatatttgatagtaaactctctaaaacaaaatatgaggattacttattaatactactattttaaattgttattagctcaaattggataagagaattctgttttccccattaaagaatgaactcttattttttgtaagtacactcaaaactccaggctttcacttcaagaaaacatacatggtggctcctgtctgtaatcctagcctttgggaggccgaagcaggaggatcacttgggcccaggagttcgagaccaggctgaccctgtctctataaaaaatttttaaaatagctgggcatggtggcgtatgcttgtcttgggcacatgctaacttatttcaggctctaagagcccttttgaattgtgttcatgtgtggtgtatctttgtgtccttttgtgtaaattagtagtatattactagattgcattttattcagaaaattagcctaccacaccttctttttttttttttttttggtagagatagggtctcactgtgttgctcaggctggtcttcaactcctggcctcaagcaatcctcctgcctcagcctcccaaagtgcagggattataggcatgagccaccacacttggctttattttccagtttcctgttgtctccctgccacccttacgtccctgctcatactttcttgttagagtttatgatacaatcacccaatgcaaatgcaacagtaattctcattagaaattatattgtttagggaaagctggtggggaagaggagagaaatgatagaagaatagaatggggggttggatctgaaaaggacaggagaacaatggaagagagggtagttaatttccatttgaaattatctggtctggtcttctgggaggtatctctaattttttaaaacaaagcaagaaaatagacaacccatttacctatatagaaagccttttcatttatttaactaaaattaattttaccaaatgagattttattatatagcttttagatgattcaactctatagggaaaattaaaagtttgtttagataactgccaaaaataagctgtgatactaaaccagatgattcatggataatgcttgaaaaatatttttctaactgctggttatattggttgttgatttgattgcttttgttcgtttgtttttttgagacagagtcccactctgttgcccaggctggagtacagtggcactatctcggctcactgcaacctctgcctcccaggttcaagcgattctcctgcctcagcctcccaagtagctgggattacaggcatgcatcaccacgaccggctaatttttgtattttgggtagagatagggtttcaccatgttggcctggctggtctcgaacccctgacctgaggtgatccacccgcctcagcctcccaaagtgctaggattataggtgtgagccaccgtgtctggctggttgctgattttattttttaaagtcatctacatttaagttagcataatatagcagctagaagtattttacactaaaactgtgtattaaaaatatttcatgtttcatgctttcatatttcatgtttcatgaagtattaaaaatatttcatgtttcatgaacaaaaaaaaattttgttcagtgaatcatcccctttggcccacattaggataacttctcatcttttttcctattaatgataaaaattgggacacagcataatggaattattattaattttttaccagaagagagaaaaattacatgatgaagaagaaagaaaaagtgcctgggttagccaagagagacagagaacactggatagacttcgaacatttaaacaggtattaaaagtaatggtccatttattgtttttcttttttttttttttttaacagagctacatatacacctgtaggatttctttgtgggaaaaacttggttttcccttatttataaactattataaccatggaagtcctttttaaaattgttttaatggcatggctccatttcctctggtggttttccgaatttagtattcttgtgacctttgacccacagcttcagtagtataagaggaatgataagggcctctgggaaacctagattcctcttgagtttaaaaaattagttaaatcacaactgactatccagctcaagcatcagcatgttatttattccacatacatcagcctgtggtggtaatacatcaaatgaccattggcagaattagaggtggaggggagcagcatatttgagaaatgcttcagcagttctcttgccagggtaagccatgaccacacactgataccacagtatccacacatctcctcagaactgtgctgaagcctcacagttctcatttttaaagtactctggagccttacttcagttatgcatgctgaaggatcactttgtaggtgaagtaggcttttgaacaagtgttacagtggaaaaaaaggaggtgaggcaggggaaaagccttgttattaagtaaatgtggctcacgcctgtaatcccagcactttatgaggctgaggcaggtggattgcttgagccggggagttcaagaccagcctgggtaacatggcgaaaccctgtctctatacaaattagcctggcatggtggaacatgcctgtggttccggccatttgggtggctgaagtgggaggattacctgagccagggaggtcatggctgcagtgagctgtgatcataccactgcactccagtctgggcaacagagtgagaccctgtctcaaaaacaaacaaacaaacaaaaggtcttaccatggtaaaatatatataagagttctaccagtaagtactgaaaaaaatgtatttctctcttcattctgtcataaaatggatatatagttgatggagctttttaaaaatgccaagtaacctgttaaagaatattttaattttctcgtgtgtgcatttgaaaacataggaaactttttgcataccagtagcatttatacatttgacatcacttatgttttgcattttacatgctatttgttttatacatttagtagttttattcactaaaaatctttttttaatcataattttgaatatttgaattatcaatcgtggatttgataggcaaataataaattcataattgtttgtaagctattattaggtactttcggattttctgtataactttaagggtgaaataaccaataagccaacataacatttttgagatggaatctcactctgtcactcaggctggagtgcggtggcacaatctcggctcactgcaacttccgcctcccgggttcaagcaattctcctgcctcagcctcctgagtagctgggactacaggtgcctgccaccacacccagctaatttttgtatttttagtagtgacggggtttcaccatgtcggccaggctggtctcaaactcctgatctcaggtgatccacccgcctcggcctcccaaagtgctgggattacaggcgtgagccaccacacccggccacataacatcttttatttgaaggagaaaataaataggcatgtgctcataaattgtttcaataacatttaaccagttccaataacttctggtattttagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagaggtacgtcaacatattttcatggtccatctgttgtatgacatcaggcatagtaaaaaactatattttttgacgttgcaaagcttaaaacactttatttttgacattatttgatagtaaacaggttttcaaagtcacactagaggagaattcttagtgcataaagtacacagaaatgtatgccttcttgggctgttaggcatgttttaaaaacagatcttctaaagtgatacattcatgtttggtaatgtataatgggtggctccttttgtgttagggaaaaagttttgattttaaacctgagatttttaaaaaaatactcatatcagaaagggtaagatatctggtaaggactgtcaccacagggaagacattggcaggatcatgtaacatttgttcatacatttgttgaggacttttgtgtatttgtataaagaagcaaagaagaacagggagtaatctgttcaacttacaatgtgacagatgtgcctcaataaggttactatttttttttctaattttttttgttaagagagattcaagcacaaataaaattatttctaaaaagagcagagaataacccttgccttttgcctttaaggaatttgcattttgcatggggagaacattatataaatgttacatattacttgtatattacattttaacctgaaggaccattctataaaacatttcttgatgtaatctgagtaggatttcacatgtaaaacaactaaatgaaaaaagcacagtctccataataaacaaaaattaatttttaaaaacaaaatgtgtaaccccatcactctgaatttgggtggagcaactgcaatatggaaatcctttgggaatcacacccataatactactaagaccacctcccagttcccaatctggtcacttctctcatgtaggaaatgataggaataccaacagtacccaccatggattgggtcttgggattttctaaaaagaaggataattaggatcccttgtgttctgatcaccttctgcacacatttcatgatccattttgaagatggtgtttcagcgtcctgtgctttcacagttgcgaacggtagaggttatacagtttcattctaattaagtgcagtcctaactgtaatactgttctgtttcattttccaaagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtaaacggccttattgtctttagtagcattcagtaatacaggttttatatcggatgatgaggtttggggtattttttattgagcctgaggcatatcgtttgttttataacccaattttagcatggatcacaaatttatgaacttcaggttttacttaattctgtagtttctagaaacttaagataactttttaatgattattgctatgtaaatactatttttaaaaatgtcctcctcattaaaaatttctgctatacagctgtaattgcaagtaaagtgacagtctcattcttgccctaaaaaaacagaaaagggcctggcacagtggctcacacctgtagttctagcactttgggaggctgaagcaggcagatcacttgaggtcaggagttcaagactagcctggccaacatggtgaaacctcttctctactaaaaatataaaaattagccgggcgtggtggcgggcatctgtaatcccagctactcgagaggctgaggcaagagaatcacttgaacccaggaggcggaggttgcagtgagctgagatcgtgccactgccctgggcaacagagtgagactcagtcttaaaaaaaaaaaaaaaaaaaaaaaaggctttccaggttcagtggttcgcttctgtagtcccagttactcagaggttgaggcatgaggatctcttgagcccaggcgttcaaatccggcctgggcaatatagcaataccccgtctgtaaaaagaaatcaatacgtcaattttttttttaatgcaaagccttttctgacaaagtatttcagtaacaaactgttatgcacactgaattttgatgtcatgttagctgacctcaaaggagttttctaagatcattctggaaaaattgttgcattgtctgattatttaactttctaaacccttaaaaaaaactacttattgtcacagttactgtattatctagacaaatttgcaggtatcattaatatataaaaattatctacatatctaatgaatactcctatacatattaagattctctttggttacacatgtagcattctcctaatataatagagagctatagtctactacattttaatatactaattatagagtaatatggcacagattacaccaaatatatagaaacattaaagataacatggtataaattaaacagtatatcaaatttataatgatggtaactgaaatgttgtaatttgtataaaatttatagagtatacaaacatgttctattaattattattctttcttgatggaatatgtttctctaggcttcaaacattcaccaaagtagggaagacttgagtcctagaagggaataagtaaaggaataattaattcatgtgttagccctgtgaattatttttgttgaatttctttttttattttagagacagagtctccctctgttgctcaggctggagtgcagtggcacgttcatggctcactgcagcctcaaccttctgggatcaagcatcccaagtagctgggactccagacacatgccaccatgccgggctaattttttaatttctttgtagagacagggtctccttatggttgccccgattagcataataattcttaaaacatgtttgatcataagaattaacttggggagcttattaaaaatggacattctgtccttgacttaagaattctgagtagaacaacaaagaaaaaaaatctttttttgacagggtttcactctctcacccagggtggagtgcagtgacatgatctcggctcgctgcaagctccacctcgtgggttcaagtgaatctcgtgcctcagcctcctgagtagctgggattacaggcgactgccatgatgcccggctcttttttcttttttttttttgtatttttagtagagatagggtttcaccatcttggccaggctggtctcgaactcctgacctcaaatgatctacccacctcagcctcccaaagtgctgggattacaggtgtgagccaccatgcctggcccaaaaaaaagaattctgagtagatctaatgtatatgcaagtacacatctagattttgaagacataatataaaaatgtaatgtatgtcagtttttaaacaactgattacatattgaaagattctattagttacattaggtaaaatattactgaaagcagtttcacctgttcctttgggtatgggttcattaggtaaatattcctgtagtacctctccaccagcatctgcatcaatcaataacttaaaaagggtaatattacattcaccatgattcagccaacattcagtagtagcattatcctgctttttttcctattatgtatacagttacatgtaacagtcactttgtatgacttatgtttttggatcccaaagtaacttcgagttatttttgcttgtacatatgtccactatgctttgtaaaggaatatatatatatatatatatagagagagagagagagagagagagagagagagagagagagagggatgcatatcagtttgtgaatgtctagactctcaggtatgtctaactgggaatcttttccatagtggatatttgtaggttgtctcccactttacagttcttactaccatgtgttgtttccttctgctgtagcttctcaggaagctgcttaagcttgtgcctaaaactaccatctttgcactgactaattccacagctggaccttcacataaatgtgtgtttagctctttcattacagatggtccacagtggcccattcacagcacaccagcagctgctcaagtcagcctatccttgtctgtctcctcccatcccaccatatcctgcctaaccctagacattgcatcagcattttgtatactcaagtggctgggatgttactcatagcttctggctactaatttagccttagtatcagatgttaacatggtgcatggtgtatacactttgaaaattgcttaaaacttttttcgggggtgtgggagacggctgatggctggaatatgtggtacaatgttgagagagaaacagtgaaacacttagaaaatatatgagcttggaagtttgcagtctccctttactaaatgtgtgctaacccagaagcaaaccatagactagtatggactgattaggcagtgatgaagtagctgtgtatcactactttgtgatcatggagactaaaaggctgtgaactttttatctacaaatggctaagaaggctttaccgcaatttgtatttcccattaatttattagattccttttttttttctctctctctttttttcttttcttcaagactgagtttcactcttgttgcccaagctggagtgcagtggtgtgatcttgactcactgcaacctgtgcctcgtgattcaagagattctcctgcctcagcctccggagtagctgggattataggcgtgtgttaccactcccagctaatttttgtatttttgtagagatggggtttcaccatgttggccaggctggtctcaaactcctgatctcaggtgatccacctgcttctgcctccctaagtgctgggattacaggtgtgagccactgtgcctggccagatttcttgattatagattttgtcattaatgtacttatatacttttaagagctaatttcttgaatattcataaagtaggtaatgaaggtcccttgttctgccttgttcgttcccctctgaaactcttctctttccagagatagccatagtcatgctcaaggaaatttcttaaaatgtatgtaattacatagaggtttaaaataagtttcaggctgagtgtgaactttaagtttcaggcctgtaattctgcagtacttcaggaggctgggggtgggtggatcacttgagcccaggaattcaagactagcctgggcaacatgacgaaacacatctccactaaaaatacaaaaagtagctgggcgtggtggctcacacctgtagtcccagctacttgggaggctgaggcaggaggaaatctgtctcaataaataaataagcttctagtttgtttcctgtgagagtcttttttttttttttgagatggagtctcactgtgtcagccaggctggagtgcagtggcgccgtatttggctcgctgcaatctccatctcccgggttcaatctgggattacaggcgcaccaccatgcccagctaatttttttgaagttttagtagagaggggtttcaccatgttggccagactggtctcgaactcctgacctcaactgatccaccctcctcagcctcccaaagtgctgggattacaggcgtgagccactgtgctaggcccctgtaggagtcttctaaagtaactatagcaatgtagttcaaaggaaatatagtttgagacatgtaattttaaaatgtccaatagtcacatcaaaaatgaaaaggaacatgtgaaactgatgtttgtaatattttatttgacacaatgtagccaaagtagtatccttcaacacataatcaacattaaaaactaaggacattgctttctatttctttttttcacactaagtcttcaaaattcagtgtatgttttatatatactagtagcacatctcagtttgaatgctaaggatctgatacttaatgagaaatgtcctaccaaaacagcaaaattgtatttaatggaaaaatagtacttactgttttagatttttaaatcaaactggatttaaatcaaactagatcagtcacactagacacatatcaagtgctcattagccacatgtagctacagtattagaaaatgcagaactgtattaagttggtactttattcatgttcctgtcagcttttatctgaagagtatgtcttttatataaatgctcctgtgctttgggtacgccccatagatcttaagcacaacacttttcaataaaatgcccgggtgaagtatccatttaaagattggtattaatcctgtcctctaaatgttagtctaacaaaaacagtttctactgcattttgaagacaccatttagttgttcttactctagtagcagtttatggggcaaatagtttagactgaatttacctttttagtatatagttttcatacagtgttagagtaaaaataataaaaatgaaaatctaatagtcttttaaaagtgatcaaaatctgtatttagattattttgttttcatttttactgctttaagaatacagtcatggccttttgtaaaaaatgtcttttttacactttttgagggaacgtaaatacactgtatctttaaagggtcttttttttaatggtctgtattattttgtttgtaaacaggtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggcgtgagcctctgtgcccagcctgacaaaatcttttatttatttaaatgttagtaatacgtttattgatgagactaggagcttctctgcagcatcttcataatacattggttttagttcccacactattcccacatcttatctgggaagattagaaatacagatgtaatatggaagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataagtctctagcaaagagtggagggtggagggtgtgtagaactccactcagcctcatggatacatctacaagtctctcaacccatcctgttacagttctccatgagagtcacctcacacttggaaaagaaggaggttaaagcagagtattgttggcagccagctatgcccatcctcttgtaaataactttccaacacacccatttccttgccttaaggtgcaggttcctacttctacaaaatttcaaatgattgcaggtcaaaaacctttggagttactcacaaataataataaaatttcaaataactagggtctacttgtccatcaagatgacattaccagtggaacccacctgttaattttaaagtagcttcagaacccaacaaaaattatgtaagcctggttaaatgtccttttttcttcttgcctctaataaaatcaggatcttcggccttgatactaaatatgtgtatatttagttatgatggtacttgtagatgctcacatttccagttccaaactcgcccgtactttttatgtgcttcaaaatattggacacatttctgttaatatatgatttctgtatccacaaaccgctgtttgcttatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggattttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaattaa

SEQ ID NO: 1837 - DNA, 3323 bp, Homo sapiens
ttggtatttgaatacatttattgtgacaagaatgctgttataaatattcataagcaaaggccatctttttatctaggaattgtcaaagagaagattccaaattggaaggatacatcttttgtaaaatctgccaccaattcctgctttgagaataagcacctattgtaaaatttctactaacattataaatggtcacagcacatgccacttgatacaatccaaactttgaaatgtttgacttctcagtgggctgtccctctccactgcaaccccccttcctccagcctcctgaaacatcgcactatcctttggtaagcaattccatatagatagctgggggaggaggagtataacctgaccatagcatcaggtacatcaggtacatttatttctaaagtctaatagagaacagtttttactgcttaatagtaagaagcactgagagtgattttaatcgacattcttaactctttcaactccacctagatagctagtatctacagatgatgcagaaaagaggttaggggagtactttccaatagtttattgtattttcttaaatatcctttctggaattttcagaaacaaaacataaaaaaattatatactttattacaaatggtaaactcagagtgctccaaatctcttatttacaaacaacactgggcaggatacccaaacaaacaaacaagaaataacttacaaaggcatgaagctgtttattgacagtaatcagctttcatcaaattaaaaaatatatatatgtacatacacagttaacgaaggcaggccagaaagagttcatctgtaggctcagcctcgctctcacaaacctccctcctgccgcccctccccaaccctccccccgctttgtgttcttaaggagtactacagaagcaatctacagtctctattgcagtttgtaaccccctccccctcccccctttaatactgaatgagatcgaatgttaggtccatgcagttcttggtcaatgttaacgaaaagtccaacgttccgttcgcgcggggacagcccgtccgcaaagcggggcagcccgcaggcggccgctccctggctccacgccaagggagggcgcgccaagtccttcccactcgtgcacactgggggcgccgtcaggacgcaacccagtccaacttggatacccttggctttagttctcggacacttcttttttctctccgtcgcaacttgtcaagttctcaagtctgtctctctgtgttattttttttcttcgttgcccctcagcccccgacggtctctcttcaaaatgtttgcaactgctgcgttagcatgagttggcacccactgttaacgtggttcatgactttctgtttaagctgtgccacctgttccctgagcatgttggccgtggacgccagctccgagttctgagctttcaaggttttcactttttcctccagccgggcgattctctccagcttcctttttcggcacttggaggcagcgatgcggttcctcatgcgcttcctctccgccttgatccgctcctgggactccatgtcgatgggggacaggggcggtgtctcgccgggcatctcgggcactgtctgaggctcctccttcagggcctgcagccgcgggtgctgcacgggcatctgctggggcaggtggtgcggcggctgctgctgctgctggggttgcgcgggaaaggccaggccggccgcgccgtaggagggcgccccgccgccgctgctcagcgcgcctgggttgaagttgctgaggtttgcgtagaccggcggctcgctgtgcaggctggcgctgaagccgccgctgccgctgccccctgccaccgaggctaccgcgggagccaccatgcctgccccgttgaccggctgcgccgccgacgtgacgctgggcagcgtgttctggctgtgcagttcggccagggcgcgcacgaagccctcggcgaagccctcctgctcatctgtcacgttcttggggcacaggaactgggtgggggtcggcgtggtggtgatgtgcccgttgctggactggattatcaggcgctccagctcgggcgacgccagcttgagcagccccacgtcgggcgaggtgaggaggtccgagttcttggcgcggaggtgcggcttcaggctccccactgggtcggccaggttcagggtcatgctctgtttcaggatcttggggttactgtagccataaggtccgctctcggacgggaggaacgaggcgttgagggcatcgtcatagaaggtcgtttccatctttgcagtcatagaacagtccgtcacttcacgtgaggttagtttgggctgcgcgcacaagtttcggggccgcaacagggctgtggcaagcgggggacacccgcgccccccggagcctttgacagggaaagtttctctaagagcgcacgcacccgctggctgtcgtccccgctgcgccctcctcaccagctcgctccagggagcgcagggttaattaagatgcctcccgcactcttacttgtcgactcgcgcgcgctacccggctttgaaaagtcgcggtcactcactgagcgctcttcgtgcgcagcggttcctcggagtccgcaggcgaactcacttcccagagcagcggctctccccgcggagcggatcagtgcggaccctgcagtggccggccggcggcgggtcttggccgcccggactccgacgacttgtcccctcctccgctgctagggggagggggcgcccggcagccgcggctcgcgctcgcccaagttcaacaaccggtgcgagcgaagctgagcgcacgtccttcttctcttgcgtggctctccgccgccttctggtctttaccgccgtggagaagcctaagacgcaggaaaggcttgcaaaagttggctccgggactctgccacttgtctccggtcctcccagccgggaaagttctttgctgctgcagccgctcgccgacttcccccggcgggcgcgtgggtaccgctgctttccgccgctgtcaacagcgcctgggcagcagggctctcctcccgggggcggctggagaccaggctctctggacactcccgaaacaccagcccgggagccacaggcgctagctctgggcagttagagagaaggtgaaaagaaaataagatttgcagttcggactatactgccgacctggctggctggctgtgtctgtctgtctgcctgactccgcgcacctccactcccgcctcgctgcttcagccacactcagtgcaactctgagcccttatccagcccgagctcaacacttatctgctaccagtcaacccctaaaaatagcccatgatgtc

SEQ ID NO: 1838 - DNA, 87681 bp, Homo sapiens
tgagagtgcataaaattctttatttagaacaataaagtatatgtatatatcatgtaattttaaattcaaacctgtataaaaaagggttgggacatacacctattttaaaaagtacacatacagtatatacacatacacatcacattttacaaccttttttatttaattaaatttcagtcataatagaactatttagaatagtgtcgacatacatttacattattatatgcaaactccaatctatgactgaactgagggtatatctgcgcatccatctaaattaatacttttcaagtccattgatttaaaaaaatggtggcaagtggacactataatcacatattaacccttagaatatagaatagaatattttgattggaaaattatatttagtgagtattgtagctcagagatcaagtactggaaaacggtgtggtttttagtttaacagttgttttaattttattgttaaaaacatcataaggatgtagttggagatggcagttataaataaatttacaatgcttagtaaacatttcaggatcacaaatatccattttagcatggattatttcttgaaaaaaacaccttgttataaaatgaaagtaccattattttatttttacaaacaaaggcatttcaagactagttaatggaaagcagcaacattatgaattgtgtgatcaaactccacaaatgagctaattagaatttcaatctgaatggttttattttaaagccaatttcaaaataatattgtttcaaagataagctggtttactttagatttcttatcccactttccaattttaaagtgtaattaatgaattacccctttataaattgattctaaaatatcttttggcattcaaaaccttcatgagcattttacattttctgctcttagttttcaataaaatgagaagatttaaacgctcactttggtgcatttccaaatgttacacacatcttatagtttctcatcctgactaatatgactaaaacgtactactggttttcattctttggaggtgatccaaaatgtttattcaagcaaaggaaaaagccatctcttgtgtaaatggtgatccaattcaccctacttaagactgaatttcacttttactaatggacactatttacattagaaacaagaacagcaatgactttttatggtcaagatacttattcacagaatccagagttggatattttgtatgggttagtttcaatgctattttgtcttctttgtcggtcatattgcaataggactcacccctaaggagtgatctctgagtttaccatatagataaataaaaaattgagacccaaagaagagaggtgatttaccatatcagttaatgacagactggaggctccggatatcttttgcaacatccatcccaccatgccaaaatgcatttttgaagaatatattttttaaatatacataatgcctaaaagctccaaactgaaattacattttgaaatgaaaacttggctgcagtaaaatatttttaaaatccatgatttctgaatgagtttttctctttatttataactttagttgaattagagtaggaaaacgtgccccaaagtttctccaaagtactttaaagctcaatgaaatgtatttaattcttactaaaaccaatacttcattaggtatgcatattttttcataattttcttttcacatactttttaagagaataggctacttgttctattattgtattgaagaaaaattaatttttctctgactcattaaaatgtggcagtgtggtaagcacattaaattacaatacaatatccaggaacacttcattatcactcaggaggcaacatttatcataaagccattttctaaatagacctggtttctaccaaagaggtgcaaagctttcagtatcattgagaatctacagacttctgagatcattttaaaaggtaattttgaaaccttccaagatggaactgtcagatacatggcaccaactgaaaaggcgatttcatggtttactatctcagcagtgagttttccatgatttatgaagaaggatattcagaacacatctgggataaaataagcaaagataaatatatattttcatctcaaagcagaaataacacagttaatgtccaagcagctagcatccaaaataatgttcagcatttttctattgttcatgcattttattcaactttagtgttttaaaaattggcaatccatgtaactttcaatggaccaacacatttaataagcaggacacatctcccctctcctaccatgtcagatttaataacttgctgaatttgtttatttaactccattgattaagaccatgtccatgagtgttaaaacccagctactaggtttgaggacaaaagtacacatttattatactcttaagcacattaagcaggattttcatatgctcaagcaaactgaaaccattggttaaataaatcaaactactagattgagaagtatctatcttctcaatctatacacaacctacacgcataactcatattaatctgtatctattttcctgaaaacagtcaatgccacacactgagacaggacctatcagcaatttaaattgatctctggttttattactaatcaagtgtaccatgtgatatctgagggcctgaacaccttaatgcagcttctcaaagcacctgggttatatcttagagaaattactcatatttaaggaaccacagcatgttagagaagaaagggactgtaggaatcatctgggctctttggtacaaaaaagagcaaaggccacttactggagttgcatctggatttgctttgaacagaagctaaaatccaaatatactagaaattcttggacttttgaaatgaaaggaaagctagcagttagtttttcatgcccttttgtgtcactacattgaaaactgtcatcttacggttgtagaacatggcaataatgttatcacaaagattaagttagaatggaaagctttggattcctttatgtgtacattcaagacatgttaaaagaactttcatcaaaataaaccataagaaatcattctttgactttagtcagatgttttcttattataaaaaaaattggcaagggatattcacataatgtcttacaagttctagtttaaaagcacaatgtccatcttgggaattcctgccaaattcactcttaatatgacaaacactgtcacacattttaaatagcaaactgacatgcataactacataaagctttctttttaattcataaaccttaatgaatatagagtgcccgattttaactaaatggatcctttaaacagataatggtgattatactataaataactaaagtttcctgattccttgcattataagtaacctagttttcaacacccatattagcatgtgggcgtggttttctaaccttagatactaaatgtcataatttatttttaggctctcccatggtggaaattgaaatgggaccatcttacattcagcattttctcctaagtccctttacatagctctgtaatagttttagaatataaacacatcataacacattttgcaaacacgatttatacaccctatagtggtcaagggaaaaggcggactttcccaggatgccaatgtccttcttggcagactgttctgatgttcagtgttcttaacttcttcctgcgatgactcttttggagtctcccctctgccaaggcataattcagtactggctcccttgcataaatggaaccaggcaaccatttgcatttgtatagtgggatatgggtgagcatggtttacatcaggaagagatcgaaatcagacccatatcactaatcggcaactataaagctgacatgttgccaaatccaatcacagttcccactgctttctacactgtacagtggctgacactactgagttttaaacattttttccagatccctttgagaaaaattgttaccctcactatccaagctgaaatctacttgcagagaccaggataactacaggctgcagtttgtatctgaagaataaagctaggtgttttttcagcatttagacatttctggagccatgcaaatggtacatgcagtctgagacacgtgctttctcttccaacatcagctgcaagttctaaatgagacccaagtcccgcagtccttaaaatagagtcctgctccatgcaagttcttctttatagatgattaattcagtgccagtttcacagtaaaacattctgttccaatttctgaatcatccatataaagtcatgggtagcaagaacagataaagatgtggtctgtcactccagacagaatatgaatttgtttaaagctgcttcatttatgaagcaaacatgaactgttaccagcctagaaaggaaggaagaaaagagagattatggtgtatctgccttctgcctttttaaaaatctcaatagccgaaatcatatatgaccacagaatgagtaacaaatttgcaatgtatgcttcacttatatagcagaaaagaacttcataaatattttcttagatgcagtgatcagtcattttctatgatctccttggtaacacattatctgaaacaatcttactttttgtttattatctatgtcctcccattaaaatgtaagctccatgagggcagggagcttctctatctcttttactgctgtacctccactcttataataatgtctggcacttaatagacactcaataaatatttcaccctgtgactttcatacctcctgacattctaccaatgatctcagtttgtgataatataattatcaacttagttagctttgaatttctctagcaagattataaaaggtagtaaacaggggtgaagggagaaggattgacgaacaaagtgtctggagagtggagattagagaaatggagatagatggagtagcatgaaagagatccctaagacaggtggagaagctggtcaatggccaccaacaagtaatagcctcacatggccactgagccgctctagtatcttgactatctagttaggttctagcaatcatttcttccagctgaggaaatagcagcagaaagatttcgttcaatacttccaaccaaaaaaagaaagactgtaatcttggcaccgcatcccaacaaagttctggggaaagttcgtttggcctcagcatagcttattgtacttgttgaagcatgaaagccatattttgttttagttattcagtacttgtgttaatctactagctttcagatgtttcaactttccagtaaagtatttgtatttccttctctacttaaaaaaaatacatatagatggtatcatcccatcttcaatcccagtctctaaataaatgtgttttgcatttctcgtcttctctgctcaatctctttcactacttttgtccttgtttatcaacccagcatcacagatcactgtttttaaagtattgagatcattacacagattagccataaaattccatagtgtaataagaattgcaatatttttccagtctctctaaatgtaatatattaaaaactgtcttatacaacaatttaccaagcagagaactctagaagctagacaacctgtatttaggaaatcagaattaaatctagaacaaaaattaagagatactaagataaaacttcagaaatccaaaatatatagaagatattttaaaagcatggttagaaagcaaaagggaatcacaaaaagcaaaaggatgtattttttaaatgtataaataattggaaacacaaagcttaatatagagaattaaatataggacaggcatggtggctcacacctgtaatcccagcactttgagaggctgaggtaggcggatcatctgaagtcaggagtttgagaccagcctggccaacatggtgaaaccctgtctctactaaaaatacaaaaattagctgggtgtgttagtgcacatctgtagtcccagctactctgggggtgaggcacaaaacccccttcaacccaggaggcggaggttgcagtgagctgagatcacgccactgcactccagcctgggctacagagcaagactcttaagaaagaaagactctcaagaaagaaagagagagagagagaattaaatgtagagaagattggaaatctatttttgatttttgtccccgggtcacttagcaaagaaaataaacgtaaagactggcacctgttttcccatagaacaaaactacaatttttataatgataacctgggttcttgcaagaacccttgtgaaataagaagagtacatttatcactaaccctcattacacatgaaaaaccagggtttaaaagacatgaactgataactgatataaattcatctagtattctacaccaaagagtcaaggcttgaatccaagcctaatcctttctaatcatctgctttacaatgtatctacagaaaccaaactcccaaagctttgaaagtcttaggaaacatctagcaaagaatcacaggtcttgctatttggtaaccaaccattgccaagccttgaggcctaaatttccaagcttgtcttcagcttgtcctttattccaattctaagatttattttcttcccccttagctcagatataccaaaattttgtttgtatttctttagtgaacctctccacaatcaaacccatgctatttactatcaaccacacggggccatttctgtgactaagcaatttctctttcaaggtctcaaataagattctttgcagataactctcaaattgcaaatcattctttccaggcctgactgttatctgaagttccagtctaacatatttggccactggttagtttcaataatatttaccaacagcttcttctcctgattttccatttcctgttaatgccaccgcactctggtaagtcccatagtctccaaatcattcttgagttctgcctgtgatgccaagtctcacatcccattagtaactaggatttgttgattcttttactgcaatgtcttcaaatggtctatgctttcttatttcctggccctgatgctaattcagttgtcattctctctcacatcttatttaaagactggcctggtaagtggactcaatttctctagttaaccactcccgtacatcttgccataccaacacccgattagttttctcacacctcagctttgattgtcacccacatctttcctacaccattttctcccaatacctccttatgtgacacaaggcatttaagccccattcctggaattcaaaccctttctcaaaccgatgctcaccctttcttctcagcatttaactctttatatgtgacttccactggaatccaactgtccaaactgacccttgaacacagtttctactttgggactatactgacttagtttacgccatgtgctcagtacagatgctacctccaccacttacaaagtgaagcttttctcctattgttagtgatttctctctcctttcaaaaataggtaactgtatttgggtgtgctcaattctaatatgtcattcattccagtatctagaactgtgttgaattcacaacttgtatgaacatatgcagaggcctggactttgatcaaagtaactctgtaaacttttagttcacttttaaaaattggttattatgtatatgtctgatttccttttgtaggctataaacaatttgaggacacaacaaagttatattaagctttgcatccatcaatgcacctgctagagtttgttggaatcacatttgtgggaagagtaaagagcaaaagtttcctgtaacgtattaacataaagtttttaatgtaatccatctgttttatttatctatcttaatctttgctatccacaacccaatatgaaaaaggtttttgtaggatgctactatggatatttggcataagctatgtgaccaagtaaatttttaacttttcacatagctgttctcacgcatggtgtcaaataaacacacttcagttaattttttatttttatattttgagaccaggccttgctctatcacccaggttggaatgctgtgatttgatcatggcttattacagcctcaacctctcgggctcaggcaatcctcctgcctcagcctcctgagtagctgagaccataggtgcataccactatgcccacccaatttttaaattatttgtagagatggggtcttcctatgtttcccaggctggtctcgaactcctgggctcaagtgatcctcccacctcagccccccaaggtactgggattacaggaatgagctaccactcctggcctatttattcctaggtgcaactttttttgttgttgtttctagttcaatacattccttccacgtttgttccttgtagttaagatattaaaccctccttcttttcattttccaattataggttatttccttaagagaactagcccatatgttctctattctagtgttccaatatttgtcttgatttaatttgttttagttggtgaaacttccatttcagggagaaatccttgccataaacctgagtcattccttgtatttttccccttccttgttaaccaagaaaatgattataatccaaattatatctattttttaaatgtataattgcaactccacattttatttctgtcttggcattttttactacggttattcttattttttagaagattttctctccaaccacatcacagtttgttctcccagaccttccctctactacacacctatctaggaactagacttaagagttccttggagggttttccatctctgctggtagaaggccaaatgtaagggtttacttcatataatgggtagtcaatagatgattacaaatgatatacacacatttttactttggggttttcagattctgaggacgaactggcccttttctacctcttttcctacttttccctcagcatttgaattcttatgtactcatagacacatacaagtttatttctgtttttattttcatatattttattctcatcttattgtaattctgagatattcattcatctttccattaatttattcaacaaatagttattcatcatttatatgtgcacagtataagtgacattgtttagtggggctccaaaactaaattaagaaaaaaaaatcctgccccctaagagtttatggttttgaaaagggcacaaaatgttcatttaggtgactgtgatgtcctaccaagtgtcatatgaaatctatttagagggccagaaatagagattattttcatttgggaagtcaggtttttgtaggtggcagtatgtgacctgagccttggtggagctttgcagagatgacgagtaaggcactttgtgaaggagaatgagtcatgttttcattcattctgccatctatttcccattgactactgaataagtgagctgggtttttttctggataattctggcttctttaacctggctaatgtgattcattttatacatgagtaataattcataccttaagaaaaataatttattagttaatttctcatgtgattatattcccccttgatatgcataccttgctgtctcattaatccaacccaatacattaaatacacacattcacacaaaagataaaaacaaaccctacttcagaagaacaatcttctttgccatttgcttaaactttcatttagggctgagtcactcactcagtctctcattcaacaaacatttatagagagccaacaatgcacgggcagcaagttaggtgttgagggtacagcaagaaacagaaagacctaactcttttcttggaatgctaactgactattcaacacattcataagttgtttgactatggttgctttaaaataccatcttttttcctcctaaacaaatggcctgggtttccgtatcctaatccactcccaaatgtcatgggacgaatgtcgtaattaaaaccacatgattaaagacctgtgtgccaaaacaggatcccagcaatgcaatcccaaaccaaacaacagaggacattacttgagcatttgagcatttaagactcaattaaccatttaatgtgtggtttgtgaatgccacttgagagaactgaaatggctgtcaagaagaagaaaaggaaggaaaaaaaaaagaaaacagtgaatctcatcttatggttcaaaggcaaaaaaatgaatttctaggaaaaagcatggtttcagcttgggaaatattgcttcggaaaataaaaagtgtcaagcaaacggtctatccatttacattatttgacaggaagaatgagcctagaaagaagtggcaatgggcagcagaaaatagagggtgctattcatgctacggacatgttaatcaagagtatgattgaaggtaaaagtgacagagtgtgtagaataaagtattacagtgttagagaaatgtgcaacataattatatcatgttatcttgagttgttaaaaaatgttgctgtataaccataaaagtaagctcatacaggaggcaagataatttatgactcagttccactgaagaagattaagtctagagacaaatctctgaacctgggacaggagttaaagctggaagggcagtgacttgcagggtaaagaaggaatccaccacagactatctaggtaataaagaggagagtaaataatcctttgacaatgagggaatgcacagaagaaatgaggaatttgaaagaggagagaatattcgcatgcaactgtggtaaatgctctcaggattccatgccagtaacaaaaataacagccaattagcagaagcaaaagtgagggacagcatgaatcaatactgattaagttaatgcagctgtgggtcttcccgcaacagtatctgcagcaagggagcagagaaagcagacgggacaggagataatgataccagtaccttctagccacatcttactctcctttctcccacaatccctccgcagacccacacagtcacagcacctgtctgccatgcgtttatgttccgtgcatcctgggctctgaactattataatgcataattattactagtcatgtggaaggtggcaattgacctggaaaatcttactctcctgactctaagatatttggatgttttctctttttcctgaaaatggcagggaaacattctggttttctcttgtttcagcatctaacacatgggatacagtcatgttatagtggtcacacctaaataaaattgattccatatatttttattctattagtaatacttaattttagtcctaatttgctatatttcccttgtctaattaattttctggtctcaaaaacagtctaagtaaacatacaactgttaatttttgtgcatatcccacactagatgaatccactagtcaggacaaacactgcttacctttcaaaactggagaatacacaatgaattagatatgcacatttcaattatgtaacagcttcagccaacatactgacatctgcttgatagaagacttactaatgaagtttgtttctaaactttggcatctcatatgctgtatagttcttgctaaatatttcagtttgaattaaaatttttacaatctacccatctgacaaaggactaatatccagaatctgcaaagaacttaaacaaatttacaagaaaaaatcaaacaaccccatcaaaaagtgggcgaaggatatgaacagacacttctcaaaagaagatatttatgcagccaacagacacgtgaaaaaatgctcatcatcactggccatcagagaaatgcaaatcaaaaccacaatgagataaccatctcacaccagttagaatggtgatcattaaaaagtcaggaaacaacaggtgctgcagaggatgtggagaaataggaacacttttacactgttggtgggactgtaaagtagttcaaccattgtggaagtcagtgtggtgattcctcagggatctagaactagaaacaccatttgacccaggcatcccattactgggtatatacccaaaggattataaaattataaatcatgctgctctaaagacacatgcacatgtatgactgaggctggaaaccatcattctgagcaaactatcgcaaggacagaaaaccaaacactgcgtgttctcactcataggtgggaattgaacaatgagaacacttggacacagggtagggaacaccacacaatggagcctgtcatggggtggggggagggggaagggatagcattaggagatatacctaatgtaaatgacgagttaatgggtgcagcacaccaacatggcacatgtaaacatacgtaacaaacctgcacattgtgcacatgtaccctagaacttaaagtataataaaaaaaagaaaaaaaaaggaaagaagaaaaaaacttaccaatgtacgaaagtaacagtgttgatacaagccacaattacacttcttgaaactctctctctttctcttgcaacatactgaaaaacaataagaaaaaatgcttatttgctcttggtcagagattctgaggtacaccatgatctcggcattgtaaaaggcagcttttctgtaaatatagtagcagaagattgcaaaattgaatggggagcctaccttcttattactatagggaagagggaagacttcatttgtcttaaggtagtctttccaagtagttaaaacatttctttctctgtatatgcatatacacataccaagcatgcctatatgcatttcatatgtgtctgtgtatacatacaggcatgacatgagagaaggcaacacaccaaatgaaaattataatcaaaggtaagggaacatatgagtgctgggcagtatagggtaaggtgaaagaatgacaagagccagctacagtgaatggaaagtcatcttacagcaaattttgtattcagctttagagaaaacaacgagtatgttgagaatagttaagggctctgaaagccagagtaaaataaaagatatataaaatatacaagagaaaatcactgaacgtattttgaataagaagtcacactatgaaccagggtttacagaagagtgtgactaaaggttgagtttagaagggctaaagaaaagatcagtggcagcaactcatgagatcataaagatgtcagtgatgataatgcttcctactgaaagaactaagcttaggaagacgctccaagagctgaatcagtatgttttgataaaagtgtggaaaagacagaacatgagcaaatgtgcctccagagttccacaaccaggagtctgagaagattctgctgccttacttaaataagaaagcagaggtaacccctttacaaaccctaagaagagtcatgaagacaattatgtgaaggtattctgtaggtaaatggagatgcagcactgaagagagagtgagacatcagaaacatggatagagttgggactcactggttaggagctactgtcatgagtgaaggacttcttaaagacattatgggcaggtacacagtgtgtgaaatggcaatgtcatgcttgattgggcacacatttagcaaaacaaaataccttatctcattatcctcttcattaatttgtatattttcaactgcccttgtaagacttggctgtctcttctggaaaaagaagaaagacatatactgtaaaataatcaatgaatggtctaatatttaagaggtaagtggactccacttttatcttttatggcaataactccaataacagttttttcagcatgtagcatgcaaaatatctttgtaataaaaaattatgaaagctgcatggtactatcaactcaacatttttaggatgttgggggctaaagagtaataaagaagctgacacttaatcaaattcaaaagacatttcaagaagctgagtcacaatgatttttgcacattttaaaattttagacaggcttcaataagaagagaacaaaagagtagaaatccaaaatagcagataatacaaatgacatttctatttgtcttttaagtatatcatatgattttcgtcagatcttccttttcatatttagttcaggctattaacaccagttcctaattcttaagcgtgaattatcagctagagggattgtctccagacataatgagaaacaggaaactttataaaatttaaattttgtttagattataagctaaggtagaattcactgttttcttaaaggatcatttcttgaggaaaaaaagatgataatttatgtaaacatagcatatttttaaaaaaaggaatggtaccacttaccttccagtataaggctccaaaagcaaagccaattataagagaaaacaatgctggcaatgccatggctgcccagtgtaggctggagtctccagggggatttttggccttccctataatttaaagaacacactgatgaatacagcatatccattctagaagttttgctcttatgctgtggttgtttttaactgtttctgtaacacattctggacctatatctgtttaaagtattcaaaagattgatttttctgctgaatattgcttttgcaaggcaatataaatccatgtagtctccaaaagatgaatgcattaaaaaagaaagaaatcacagagacagaaagagatctggcttgggtaattctgacacatatggaacacagacttaatatatttctggggggaaaatgacttatactatcaagcaaatctatctcccatgcctttatcttctaaaatctttttgctttctcactcttgacagcttgctcagaaattttaaacatgacattttacaacctggatcaagatctgtatgcattcagctatgtttggactgttgaaaatattaaataattgtatgtgcactgtggttatagtatttttaggtatctcatgcttagaatcatggctgtttccacgttcatatcttcaacacacatttgtcggatgccactgtgcaacggactaagagtttggacttttaatgttggaaagcttaagactaacactaaggggaatggttgaaggcactagtgttgtcccatactacgtctaaataagaaactcaatgagagagaacatatatggaattggtttgggacacctttcttgatcctgcctggctcttccatgagaagcaaaatgattcatgaatttaggttggatgtggtggctcacccctgtaatcccagcactttgggaggccgagtcaagcagatcacctgagatccagagttcaagaccagcccagccaacacggtaaaaccccgtctctactaaaaatacaaaaattagctgggtgtggtggcgcatgcctgtaatcccggctactacggaggctgaggcaggagaatcgcatgaacccgggaggcggaagtcgtaatgagccgagatcatgtcactgcactccagcctgggcaacagagcaagactctgtctttaaaaaaaaaaaaggagcagaatgattcacgaattaaataaacaaaacacatctcccacaagggtctcttccaacatgaaacttattttgacagatttttctatatacctatacctatttaacatacaaagtacctagagtacataatataaaataatagatctactatgtgtgtatcaacatcttacagggaaaaattaattcatagatttaacttgataagtcagaaatagattttatctactatggtgaggacaggaacagcccattcctctaccatatgtgaactgagagcaggaaattccctcatcctataaatggtatgtttccaaggagactctaatgatgggatgtatggatgtgtgctcacgtgtgtgtgtgtgtgtgtgtgtgtgtgttgggggaggagacagtgagggatgaacaataaggtgctggtgatccccacgtagggagttgtcagaaatagggtcttccattcacataaccatgaatatcctccttaggattcctcctcctggcccaccccacatcctatagccccatgggagatatgttttaccatctcaagttggagcccaatgtgaattttctcaccaaaataaatctgagtaataaaatgggatttggtataattaaagtactatcattacaataacagagctattttaaggattatgtaagattacgtggactcgtttgggatttaactactatctataaaagtgctctctatatgaaatggattcagggttacaaacaattcgcaccatttgaggaattttaataatactgtttgtaaataaatcatttggctgttttggttctccttgaaggccaatctgctgtggcccccattatctattgggattgctggtatgtaattacaatagatttactaggtaacctccttaagaggccataatcaatgtacacagagagaacaaataaattaattaagattttgtccttaaaatccaatggaaaactctaacaagctaggaagatgctatggagaactccattatctacgttgggtcagccagatgccctgtaatcaaggtagccaaacaccatgttcttcttgttctatacaaagaccaaacctaagtcttgaaattcaccactcagaccaaaggaaagaccagactcaaaagcaaaaagcagcttactaaagagtgagatattctggaatttgctacctaaaacctttctcaggcagaaggatagcatctaaggaaggggcttccaacaaagctgtgtgggaggccttactaaagaaagctcagacttgctctctgagagtgcggtgactaccatgttgacagttccatccctaagactgtgagccaatacacaatcctggagtctgactaagacacagcagcaatcttcctgcaggagacagggagggagagaaacagcaaagactggatggcggggcggcagtggagaggagggttgggggaagcgcccataggttactgagcttcacctcccatagaggtcaatgttacctcactttttttatttcacttgttcatgcgtggggcttaagaaccaggcctttggtccatcagggatactactgtccctcttgcaggcagacaaaaagaactttatcagaagagatttgcttatacctccagggaatgactttcaatactttccactgcagctatcgagtaggaatcaatgagatttgaattgcatgcctcaaggcccaaatgaagggtatttggggacaaaacttaagctgacaacaaagttttgattttatgcaaagatagcctgcagagaatttatgtggagaggaagctcatctgggccggatttgagtaatcccaaattcctgggttattaccatattaattatatctccttattaccaaaactattcactgtccagaaatcttgggaactgacttgtttcatttgactaataataaccaacatctgtagaaatacagaacacaaagaattgtgctataattttgctgaacttctttttagagtgagcatttttaggagcaccatgcctgtgacatggttatcttggtgcttatgaaacaagcaaatgagtattcttccttgattcagatccagagctcactaaaggttcaacataattactgatccaaagtcttattgcatctcattgttctagtacttaatgatgaactcttataagacatcagttatgtctccaagcacatgtgtactaactcacttaaaactcacagaaactctgtgaaggaggtattatgatcttccatttgaccgaagagtcaaaagagtttaacttgactggtatatgagtccaggaaggttgggtcaagactatttctagaaaatgtataagataatgtcaaagttaggatttctttctctatcatttaggtactgtctgcaagaatctcaaacataaaacatcttttaaacattctctttgcttatcataaaggatattactgttatgctataaacataattccctttggataactaataggtttgtatgttattccattctcccatgacttttccttacacactcacatctctgtaataagttttcatatgccctggtactctgacatggccagcttttgagttatccctgaaaactagcatgctttcttcaaatttccctaacccttctcccaaaaaagtcttaccccctttgtgctacacctaaaaacatttgcataattctattatgatacatattgtatactgtactatgagtattttatttacgtctgtttctctctgaatgttagcaccacaaaatcttgtcctgtgcagaggtatctaagtggcatattcatgagtgacatcacctagctaaaagttgctgacaatgcaagactcaaaattttttaaaaaggaagaaaaaagaaacagtgaacaaaaaagaaggctgtccattcatcttgcaatttaaaaagtaatctcagattcagaggcacgggattgaataggtattttatatttagtttgtcttttaaaattagtaggaaagacttttgtttccaaatacgatggtagcagactagcctttccaacctaagtaattataattctagacaaattatgaggcaactcttttcagaaattagtgaacagcagtacaaatgtgtaattcacgagacagggcatccacactaagtgaggctcatgtttgccctggttttctggctttcagctctcctgtctggggtgcactttcagattgaggtgtggaagacagagttcaaacaaggaccaatggcctcactaagctaaggagtcagagattgaagttcagggctgccgatgcagctggagtttctagatctaggttatttggaagaagggagctgtgcaaagaaggagcatcagaaatccctagatgaatctccttaagttactggtccaataataagctgtatatgcaccagtagagaagtcacaaaacctgaccaaaaaataaaattataataaaaaaaaataaccaaacaccaaactcatgggaagctataatcttagtagaggccctagcagacacagaacaatggggacaaaattattaagacaagcaatattggagagattttctgagcactttacagatatctcagatattccatgccttaggaataaggctactttcccttgtacccaagaaagtttaaaaacaaggctgggagaaaagataaacctcatctgctactattcgaacctcctaccaaaacacaattcaatagcctctaaagaaacgctatagaatctgaaagatattcaacagcatagaattcataatatccagcatatattaaacaatcactaaccatttaaaaggaaatgtgacccctaatcagagaggaagaagtcaatagacatcaactctgagatgacctatgtgttgaaatttggagacaagaactttagagcagctattatatttaagtgacaaaaaagaattttttttcataatgagtatgcagatggaaaattccagcagagaaatatgaaatacattaaacaattaactggacattctagaacagaaaatataaattcataaatagaataattcactggatgaaaaattcagcagatcagagatggcagaacaaaaggtcaatgaacttgaaagcagacaagtagaaattactcagaagaacacagagaaaagaggataaataaatgaacaaaacttctgcgacctatgacacactagcaatctgctaacatatatgcaagtagtatctcagaatgagaggatagataaaatggattaaaaaatttgaaaaatttatgactattttttccccaaatttgagggaaaacaaatatatagatccaaaagcttgacaaatctcaagaaagataaatacaaagaaaaccactcataggcatattctagctcaaatgttaaaaaggagaacactttgaaagaacgcagaggaagaaatgaccctgtacatacagggtaaaaataagacaaatggtggctaccttttttatttttttcagaaacaataactgcaggaatactatagtgatatttttaaaagactaaaagaaaaaaaatcctgtgtacccagacttcaatatctagtaaaaagtacctgctacatggaagacaaaacaaagatattttccaattaaaaagaaaaaagaatttgttgccagcagatctgtattataagagatgctatagaatgtttttcagcctgaaggaaattaataccaaatggaaacctggactgacaagagggaatgaagggtacaggaaataataaatatgcaggttaatataaaagacaatatatttcttcttctcttactttaaaatacgtatgacagttcaaagaaataattgaactgcattgtgtattgtagactgtattgtgaaatttataactgatgtagatatgttaatatatgtcaatgatgacacaaaagatgggtatgggtaaataaaactaccctgtttcaaggttcttgcatttttttctcaagtgctacaatagtaactctaagtagaatattacaagttaaagtgtatactttaatttccaaaataaccacaaaataatgcaaaagggtgctgttgaaaatccaacactaattaaacactagaaaaaaaataattaaccaaaaaaaaagggctagaaataaggaacagaaggtcaatacacaaatgggacagataaaaaacaagtaaggaaatggtggattaaaatccaactataccaatgatttattacatagaaatggatgaagcactctaattaacaatcagagatacactaaataaaatagtgaagcccaagtgtatgttgtctactagagatgtactttaaaaatacagacaacagactgaaaataaaggaaagccaaacatataccatgaaaacagtaagcataagaaagatttgctctaatatcagacaaaataaacttcaagacaaaaagcactatcagagataatgagggatatttcagtaagattaaaaggtcaattaaacagggaagatctaacaataatcaatgtataagcccataataataaagctttaaaatatatgaagcaaaaaacccaaaaccaaatggaaaatcagacaaatccacaatcaaaagttaatattttcaattcccttttctcaataattaataaaaattagacaaaaagcttaataaggaagggaagatataaacaacactatcaaccattttggccaaatttgaatgctgcattcaacagttaaataacatacataaaatagtttcagtacatttcaaaaaaattatagagtatgttttctgacaacaaaattcatagactagtaacaataagatatataggaaaatctcaaactttttgacatcaaacaacgcacttttatattatccatgaatcaaagaagaaatcacagttgacaaatatttagaaaaataataaaatcacaacacaaaaatgtgtgaggtgcagctaaagcagtgtatttaagaaaatttatacctttaagtgcttgtaattagcaaaaatagtttaaaatcaatgatctaatttttccacttcgaaaagctagaaaaagtggagtaaatgaaacacaaagcaaatggaaggaaataataaagattagaaatcaatgaaatataagcagagaatttaagaagacaaaagttgctcctttgaaaatgttaataaaatccatagttggtaagaaaacccttaattgactaacacacaaacagggctctagtccctttttgacacattttagaactgatatgctacgtaatttagaattttaggtttcagaagattctgtcctgcacataatgtataacatatactatccccagtgaatcctgggtagcattctgtaatcaaatacattaatatttcattagtaaaatatatattcacttttagaaagataaatagactataaatagcctcaaatcacttcaggtcaggttttggtggcaaaaaattccaaaataagtaaattgtattttagagtttttttaaatgttctgcattgtaacaagctattatgaattagtaataaattgattacttcttttcacagataggtcttctaagtccctgaacaaatgacagtgccccatttataagtcctaagggatgacttttttagcctagatcacaagatggtttttattcttcctgcaccttccatgaggctagagagtatttagtaaatacaataaactttataatgacctttgtctggattttcaaagaaaattgggttcttggcaaaagaggacagaaatttcagaaaaataagcctattctcatcaagcatataattctgtggtaaaataacaaaatcatcaaatttccaaatgcgcaatagtaaatactgatatacacaaatctgaaaatatctttggaattctatacaaccagcatttatacaattaaacttccgtttttgtcagacacattccacacagaatatatgttaacaaccagcatttatacacttaattttaaacttccgtttttgtcagacacattccacacagaatatatgttaatgattcaacaaaaggcataaatcatatttctaaaattaattttatgtcttatttaaaataacctcagcagaaaatttattggcctaattctctaaacattatctccagctctagggaaatttaattctacaaacttaagtctcaagaagaccataaaaggaataacagtaacagaacagtatcaataataataaatgtagaagtttccttgaaagcccatgcaatactcctataggtgctaattggagccatgcatgcattaaatcagatatatgtacttactattactgctactgctgtcattcctaagggagctggctgcaacagggggtaacataaatggttttgtgacactgactctggaatctaaatagaaagcaataatgtgtcagtgttatatggtgatttgtatgagttatagagtccctgaaaggtgaagtgcaataccagattacttgccaggtctgcttcccaaatctagagtattcagatcctatttatttcatactgggtcctgctattctattttactaagaaatccaccattatcaccttgtagaacaaatacttattgaataaatatgttaataaatacaaataatgacacattgatggtaatttctcattaaaaaaagaaagcaatgaatccaggtttgtattatagggacccagtgaagggaaaaaagagtcttaatacagagtaactggggaggatcagaatttgtgacttagagttagatccttaagaaaaaatttgagaaggaccattaagtagactggaggtacagaataatataattgtaattactggcaaatattagatgagaaaaggtatgagtggccatctcatatattgtttactcacaaacagctcactaatttgaaactgatgaatattgctttgggttagaaacccacaaatctacaatcattagtttcttctgtgctattgatatctgcttttttattagacgtacatgcatgtatcttgctacagcttaacacagaggtagattcttactacatagggaagatttaagtttgttgtttacatttgaactggaaatgcttacatgtcttacctttctcaggacttaatgttgaagaaaccacacaatcactagtttcagatgccactacaaagtccttgaaggcatcaatggatctattaaaaattctaaagaattcttcaggagtaaagagcctgggttctgggctcttgaatgatttttttagatcctagaagaaaaaataggattacatttttcaaatagtcttcagacttaactgaggtgaagataatggactataaatatgtctctcaaagattcaagtatttagactcttacaactagcacttttagatggctgttttaacgtatgtaattcagattggtaatgcagggtagtgatcccagtgggatcacaagttgaatctggggcagtgaacacaatgtcatggcaaaaaataaaataaaataaataaccttaaaaacaagctggggatatttttctttagagatgctcattaaaaacatgagggtttatttttaaaagacccctccattacaagaacttccagtctttagaaaaaaaaaaaaaaaaccacaccataatgcatgctctaatatccaaaaattagaaagtcagatgatactaaatattggcaagggaactcttacatactgctgagataatgtaagttggtacatttgatattatccagtaaagttagacatgtgaccatcctgtgactcagaaattccattctcaggtaaataacctactgaaactattgcacatatataccatcagacatataaaaaagtttttttgcagcaatatctgtatcacttatgtcaatccagacagagtggcttaataactagtgatatattgaattagtggagttcaattcaagagaaggttaactacagctatatgctttaaagtggatacatcttctaaacctaaagctgagtgaaagaggcaagtcccaaaataataaaaatggtatgattaattgatataaaattaatataaaattccccaaagcaaatcaaagctatgttgtagggatacataatggattataaagaaaagtaggtaaccaaaataaacaactatctgttacttactatggactattctaagtgctttatatacagtaactcaatctccaaaacaactgagaaatataattggtaatctcctgggttcccaccaaagtgccatgattagtaaatgcacattctttgttgtttgcagtgttcttcccaacatcaccattgacctaactcatttacctaactcatctttaaggctctaatgcacatgttatttcctttgtgacaccttgtgtgatgcactctactttttgtgatctctacttcttttgaatgccattggcacactatatgcagtagtaatatgaaagagtggttaacaccacattctgactttggaaattagaaaataatacaaagattaaaggtagtgattggattattagtatggtaagaattataagataggatagtacaaatgggattgaagttgggtcttacagaatagctggaatttagatgggacacaggaaaaagcatttaggtattaaggtacagaatcctgcttaaaactttgaatttaaacttacataagtctcctaagctaatctttggccatttgaactgtataccaaatcaggtctcctaagcatgattttgctatagacacagtgtgatgaaaaaacatcaaattttattaatatttattttgctaggtagggtgttaaagtactcatggcaaataacctaacgtcgaccctgttagatgaattctggcattgcccccattttaaagataaagaaagtgaggtacaaagaagttacgctcacagaactcattagcgacagagccagaatttaaactccaatatctcactcttattttctggagtacattgcctattccatatgtcatgcccatatcctgaagttggtgatgatcagttatccaatgactttgaggagccaaaatgtattcctttgctgtgacctatggggtgattacattatgcataaaaggatatgtgtttattacagacaattttccatttaaatgaacacttgtaacttaatagaaaggtttcaaggacttcacttatgaagaataaagataaaggcaggactgattttgcattgtaatgtaaataagttttatttttgtattagatgacaacatttaagtttgaatgtgcacttcagtattgcagtataactgcaaatacttgttttctttgctcatctgaacaagatttttaaatttgaagtttatacaatcaaaatatcataaataaaggtgcctcattttccccaacagcaccaagaagcatgggtttttagagaagcgtaatgaaaaataatcccaatgaacacaaagttaccttagatgagttttctttcacgcactccacaaggtcatccactatattcacaagtttgtctatgatggaataattactcaagccttcagaaatatttgaaaacttgtccagaagatcagtcaagctgtctgacaattgtactaccatctcgcttatccaacaatgacttggctgcaagatatgaaaaaagagacaaaacagctattttaataagtaagtgccataaaactcggagtactcttcaaagctatcgttttagttactcaagtgattctcctgcctcagcctctcgagtagctcagattacaagtgcctgccaccatgcctggctacttttttatttttagtagagaggaagtttcaccatgttggccaggctgtctcaaacttcctgacctcaaatgatccacccgtctcagcttcccaatgtgctgggattacaagcatgaaccaccgtgcctggccagatttttaaaattaatattacattacttaaaatgttgtaataggaggacaggggttattgtaacaggaagagaagggactagtgtgacaggaggaggagggactattgtaataggaggagggactcttgtaacaggaggaggaggttgtaagtttgcatgctttatatgattttaatgtgttatcttttctcttataaagatcttttaagtggaaactctgatgtattttgaacactgctgaaatgctgcagtgacaaaaataacattgttattaagaataacattgaattggctcattaaaagcacaaataatttaatacaacttgtaacaaaaatattgtactcagagtaactgatgtcatggaaaataaatcaaactactaagctttatttctctatttaccagcagaatatctctgtgggaaaagtcaagccttttatttatttatttatttatttatgctttaattttttacagagacaggctctctctctgagtcctgggctgtagtgcaggggtgcaatcatggttcactgcaatgttgaattcctgggcccaagtgatcttcccacttcagcctcccaagtagctggcactacaaggcgcatgctaccaagtgtggctaatttttaatttttttatataaatgggatcttgctttgctgctcaggctgctcttgaactcctggcctcaagcaatcctccctcctcagcattctaaaatgctgggattagaggcgtgagtcactgcatctggctcaagtcatttatttattctaaagtatagaagggaccactttatattcatttaacagaactgttttacttaatataatacagccaaaaaggaagcaggtttatctgcagataggtaagccccaattcctggaaccattaaatgtcactcaaaacttttaggattgttggctctggcttcagataagaaggataaacaaatctcaacatgggaatttagttcaagtggccatttcaactcgtcataaccaagttctcaaagaatatgtgtttccaaagtatgtgcagaacagagtctttgttttgttaaatcagtgcttacttcaagcacatgcaagttcctacttgcatcattatcaggtctctttcaaagctgtcagtctttccttggatgctgaattgctctgcaagtttctttccttttagggagtgataattccttatagaccgtcagccctatcaacaatgaacagatttcctaggatatggaacacagcatacactgtaaattgctatttgaatagtatttatgtgatagagtagctttcaccaattcattccgttgaaattgtgcaaatttttctaacaatgaaattccaggtattaatctcttaggactctatttcctcactttatgagtatgcttgcctaggatctctggcaagtaagaaccaaaatcaaattccttgttttgaattaagacattcctttagtttctgtggtagttgtcttatatgaatgggtactttgttcattttgctttttttttgtggttaaagtagaaaatgttttgttgatttgtttcttatttttaagctgaggaattctggggtacttactgccacttctgttgatcactattttcaaccgaactctatgtttacattttatattctagttcctatttagctattaccctacctcctcccattttcacataactaaatcaacagtctaaacaatcaactctttccagtaaaatttccaaccccaatcctgtgctttcttagagttaaaccatggaaattccacaatctaatcctactctaatgtttgcccttctaaagtcatgaacaatttgttgatagttgatataaactacgtgcctacacagctgaaaaatcgtgtatttctaaaacacttgtaatcatgtttcactcattttttatttttgcttgtgctattgtttctttggaaaaggctgaatcataaattcaaagttctatttttcagtaatttgtttaaccatgtatatattggctttttaagattcttgagtttattaaagataaaatgaaggtaaacaaataatattaaatgtcagtcagttttgatctgcctgcttgtaagagaggaaactagttttgactggaatgtctagcagttttgtaatttttaattaaatatcgtcaatgatttgcaaggagaataaaacacaatgaactaagtatttcatttgtgaggtgatagcaggtctttctgtttttcaattcctccacgattatgattatgaaataaatgattaaagattgtcaaatttacaaacgtactttttgtttgccttaataaatgatattatcactgtttcttatttttcagagatattttaaacttaaatagttttatataaatatttactcaatgatattcattagaagaaagtaagatataatgttctctctttcactagaaaatataaaggattaagaaaattgacagtcatacaggatgtcaaaggtgacacaaatgattgcttttaaattcctgatgtgcatgtaatttgatgctttattcgcctgtatgtattgtttccaaaagaagaaacatatagattctgctttgagtgtaaaaacttttttcttgactccatgctctcaatttcttaccttctttcttgatagcttctgtcttatgttttcttggttaattatagcagctctagctaggactactaaaaacatgtgctttctatccctatgtacttataacatgttattattctagaatccaaactgactcaatgatattgactcaatgatattggactgctagcatctcactaccactgacaattcagtcaaaaactgtgaacttccttaggaattttaaagtaccatgaacaccaaatcatgatctcgctaaatgattaaataaaatatataatttaaaatgaataaaattaaaagtattctaaacataactaggaatatgactgtttccaaagaccaacaacagaaatatatgcacattctaagactaagcataaatttttaaaaggtaatatattaattccacagaatatgtgacacagaatctctgtagttccagaaccagtaaatttgagaaaccggctgaaataaaccatgtgttttaaaatcatcctggagacttgctaattctggcatgctttctcctctctatctcctgcctcattcaagaaactgtgctggtttattaggtgaaataatttgacacattattccacattggtattagatgcacagtcttttttttttttttttttttgagacagtcttgctcttctcgcccacgctggagtgcaatggcgtggtctcagctcactgcaacctctgcctcctgggttcaagcgattctcctgcttcagcctcctgagtagttgggattacgggcatctgccaccacgcccagctaacttttgtttttttagtagagatgggatttcaccatgttggctaggctaatcttgaagtcctgactccaggtgatccacccatctcggtttcccaaagtgctgggattacaggagtgagccaccgcgcccaccccacagacagtctttaagagcagtcacggtaagatttacggattaagaagctgaaagtagacaaaataatactgtaacacttcttcactgaagcactttacattactttcaatttggtagctattcacagagagatatctatgttctttcttatagggcctaaagctagtatctacccagtgagaacgttcttttcacaggagttggtgaaataccaattagagattctcagagtgaaaagcctggctcataaactatgaggtttctaagaatattcataaggagtattcacccagccttctaatctgattaatctaaataccagcattaccacccagtttgtttttgttttactttctttaattcgtgtcaaacttcagtcttgctggaattagacgtatgcatgcctagggcacgaagtgtacctttctgtttgtgctttcagcatctacctctgggatgtgcaatcaaaatctagagccatgtcatcagaatcaccagaattccagacctagaaggaatactgaggaccagtctcaccaattgtataagcgggaaaatcaaggcttagagtagtgaagtgtctcgttccaggttacataacaaatttacacagaaacgcgagaaaccaggactctcgatcactcattttgttctagtagccatgagaatagtgaaagcacataaaactgaagtgtttttttctgctgaattcactatgacccatgtggtctcacgtctggaccagacacgattcttcggctcaattaagaaatctctttggaatagaaatggttctttctgtttcatttcagttaatccagagtcataccaatgaaggtaaatttctctgaggaattgtgacaattgccatttgtggactttatttactgttcttttggtttttttcgttgtggctagaaagctgacattctactctcaaacattccatgggcaggcaaatttaaaagtttcctataaaagcactttgcaaaatattgcatgttcatgttgccagtgtagtctccgaaatcttaacttctctttggattagctgggttttgtaatgatttattttagtcctctccctaaacaattaatttgggtcttcagtgttcactttaggcatctaactttacatttcttgtttgaattaaagtgccgtagaaatctcaatctgattaagatggtaatcaaccaaagcactctaaatatgtgttatttcccagggcagacctataaatggcccctaggcccgccctaaaatagaacagtgaaggaacagcacaggggtttggggagtgagggcagcaacgatgaactagaggcccagtttttagtcccaactctgtcaattcactttgtgatttcaggcaagtcatttaatctattcagggcttcagtttctccatctataaaataaattctaatcgatgctggccaatatgggaatcccactatccatctgcagctcctctcactcaaaatgcattgaatgtgactgcagagctaaaattttcattttacttaattataatttctttaaattgaaaagtcaataatatcaccctatttagaggctggaacttttaagtatgtttggaaaacacagaaatgtgactatcttctcaatggtaaattttattaaaaaatctaaatatggaataactatttctaatgaaaatttagtgtatgaactgtaatatgttgcagatgtaaaacacactgtggattttgaataatatgaaacatataaaacattccattaataatttttatattgattttaaggtgaaatgacaatattttggatacatggggctaaataaatttcattatacttaatttcagctgctcgtttttatttattttttttttagtgttgctaccagacaattaagattatgaacgtggcttccattgtatttctatcagagaataatggcctagataatctgaacagcatcttaatataatcacttattaggaagacgggcccctgtgctgtagtacagtatacaaaagaactacttaaaatagcatttaatgtcatattttattcattcaactaacattttatgcttattccttttaaataaatactttcttattacatgggagatcgaggcagataaatagttgactacaagtgtctatttggctgacgtctatttttatagagagaatgccgcatcataggagtggagcctcagaatccatgcttacaaacggtgaactttccctgtagccatagttggttggatgatggtagacacctgacttggataggccaaccagaacgttcctccccaaaattggtattgatcattagaaactgataattaatctctgaatagggctgaaattgaaatatgtaaacctggcagctcttgggcagttacattctaccaagtgactggaacaaaggagaaaatatctgcacaaatagaatgaggcggagaaacagagattcagagatggagaaggaaaaactgatagtttccaatcctggttccagtcttttcatggggcctgttgcacccatgcccttaggtgacatgctattctttagtgtccttataataatgggacttttactattagtgaaaaccacaggaatctaaactaataagatgggctccttcaagatttggaaatctagcatttttgccaagagttaaatgtttattcataactattttttgaggagcgactatatgcattggattgtctaaagaatggtgaggagatacacaggagtaaaagatttcaaccttgctctgtagatagtcaaaatatagtaaaaagagaacacaacaacaaaataataatgatggtatctgatgttattatatgcacaccacaactcatattttttgtattttaattatttctcacgataatactttgagacaaatatataacacttaaaatattaagctctatgtaagcaatatatgatcatgtacccaagatgaatagcttctggacaaattccatagaagtcacaagataataaactaaaagatagggtccacatagcaggtgcaatgatagtattgctgaccaccaagctccagcatcaagcaaaacactcagcacagagtagcacctgatcaaatgatacatgggagagaaaatgtgggctgaaagagcagaaaatgtccttgtgtgaaagagaaatcttaaactgaccttggaggagatgaccactaagatgggttaagccccaagatattgcatgattctatgggtagaatttggataagtggatgggagaagaaagggcatcctttgagaacaggcgcattattttaggaggcagtgatgcatgtggctgaggtggcaagtttgtgttggggaataatgggtattcagatgagttggttagggtagggaaggattacagagagtcatgaacattaggttcaggaatctggctctcagcctttagtaaatgggaacaataagcaggttcttgaatgcaaaaataactcaattaaagcagtagaaccaaaggcttaaagaagctgtgattccccaaaattgcataatacaattcttacacctaaaatatttcaaaaaattcacacgtatctaaaagaagataataacgttgcagtgcagatactgtgtgacgagttataggcactcacctcatcattataaccttgtgaactaagttcaaatctgtgcctcaaggaaattacaaatgattatatggtagggaaattttcttcctccttcctttcttcactttctttcagcaaatattcattaaatgcatatgagcatccatgaggcactgagaatctaatgcagagcaaaaagaatatagttcctacctttgtgaagtttacaggttggtggaagattatctattaaatcatcccacaaatacatccaaaactgctactctgaggagtgcgatgagaagagtttccagtagaacaatttggtttcatcaaaaatcaaaaccaaaatctaaaagaatcaggtgttagctagacaaaagaaccaatcaggattccaggaatagagaaagccaggcaagaagctatgtggcagcaaggaactggtaacgataacgataaaggactgaaaaaggatgtggaaaggtgccagatcagtatagtctttttttttttttttttttttttgagacggagtctcgctctgtcacccagcctggagtgcagtggtgcaatcttggctcactgaaaactccacctcccaggttcacgccattctcctgtctcagcctcctgagtagctgggactacaggcgcccgccaccacgcccagctaattttctgtatttttagtatagacggggtttcactgtgttaaccaggatggtctcgatctcctgacctcatgatccacctgtctcagcctcccaaaatgctgagattacaggcgtgagccactgtgcccagctagatcactacagtcttggaggccttgttgaagcagctccttttcctgtttcctaagagcagcaaaaagccattcaatgaatataaagaaacaggaatgaaatgattggatgtatttctttttaaatcactctgtctattcaggaagaatcaaaacatcaaataataaatcctcaggtatcaaagaaaatggaaagagcccagaggtaagtaacagggccaggcaaaaaaagatgagaatagccaagaagtgaaattgtgcatacctgaggaagggtactgaagagggaagaagtttggaaggcttattgttagagtggcatcacatgctgccaatcacttccatatttagctgtgcctttaaaaagtctgaacgaaaaactgacaatgatagcaaagattggttcaggtaagtatcatcaatagatgctaaatctgtgggagaaactttgagaaggagaaggattgcttatatggccttaaagtgtctctccccaaattgtgaatgagtaaatatacataaacagttgaacatcttaaccagatgatcaaaacaaacagcaccatgaggagaggatggactctgtgtgcctctggatgtggttacctgagcacaaatcatcactttcgtagcattgtcacttgaattgcataagctccacagaagcattaagaaacatcaatcaaatgttgcaaagagaaacacttttcttaaaggggaggactgtctcattcaaaaatgtcagtgccataaagacaaagaaagcctgaggaaatcttaaaggagactagagagacaggatgtagtagcttattattgctgctataacaaagtactacaaacttggtggcttaaagcagcacaaatttgttattttacagttctggaggtcagaagtttaaaataggtctgaataggctaataccaaggtattcattagggctgtgtttcttttggatgctgtaaaggaaaaatcattttctttgccttttccagctttcagaggccatgtgcgttccttggcttgtgaatccctcttccatctttgaagccagcagtgtaatattttcaaatctccctctctggctctgacactcctgcctcccttttataagaactcatgtaaatcagagtgggaccacctggataatccaaaataacttttccatctataaatccttaatttaattacatctgcaaagtcctttttgccatgtcaggtaatatattcccaaaacaaggcatctttgggagtcattatttacatggtatcaaaatgaaaattccaatcctagataggatcttatactgaaggaaaagaaatgcaaaaaacaaaaaacaaaaacaaaaacaaaaaagctaaattgaaatgcagacctagattaaagtactataattattgtaaaatgtgttgaagttgcaaatgtactgtgtttaggtaagaaaatatccttcacataggaaatacacactgaagtatttaagagtaaatggccatgtatgcatcagtatacaacttattcaagaagttcagaaacataataaaacacacatgcatacatagaaagaaagcaactgataaagcaaatgaggcagaatgttaaaaatacttgaaataggtgaatctggattaaacggcacatgggtgttctttaaatattcttgcaacgtttttgtaaatttaaaattatttgcaaataaaaaactaaaagaaaactgatgaatatatactttaagtaaaaattgaaaaacgaataagatccagtgttcagtagcaaaataggtggcacagttaataaaaatgtctgtttcaaaataactaaaagagtggaattggaatgttcctaacacaaagaaattgtaaagttgagctgatgaatattccagttactctgatttgatcattacacactgtatggttgcatcaaaatatcacgtgtaccccataaatatacacaactcttatgtatccataatagctaaaaataaaaaaatttttttaaaaatgaagatttttaaactcaaatattacaagcaacccacagtttatgtaaatgctatggaagttcaagtgaatgaaggtgtgtggcaacaattcagcaatgccatttttattctttctacaataacattaccagtaaatgtaaaagaccagaaatatccaggtattctttaaggttaggaagttaaaggaaatttcaacagtccggcaatataatagtttcaaagagtttaaaatagcattggtgattatcgttagatttaaatactaagtggttgatcacaccctgctatttgtgagacagaatctgctaggtaattttctaagaaggaccttggaaaagtgaactcccttttctaggagaatttagctgttttttaaaatgaaggcaaaataaaaataaaaataaaagtgtattctattctagagctttcttctgcccagtgcccatgggcagaattttattgctttggcaccagagaatctttttggcacccattcccactccaccctctattgtttaaagacaaaagataaggcagctgggactctgaccactcgcaaataatcagaggcctccccactgggaaactcctctggtcttcgcagaaacgaacatgtcaaaatgaaggtaaaacaaagggtgagacccctggttctgtccaatgctctaaacgtggccttgtttttcttgcccatggtggtggccaagaagaacagtgtttctccagttgtgccagtatagcatgccagaatcaatagtagatttttctcaattacagaaacaagcacaaaatatgtggcagtgaatcagctttattttcacaagcttggctcttgctatcacaagccgacattgaaatctatgatttagcatattctatgattataccagcacaaaaaattctatttagttgttttcagtttagcatttgtttttcaaagagcagcaggttatctttgggtgcttggcaatcacaatcctaaatgctgctgcagtcaggaaggatctggggtgggtctttattacctagaggcttcccttcaaacactttccctaagtgttgtaattatatagatcctcactttccgtaacccagggttaagagtctgatgacctacgggtttctttttaagactctgtcacgttctaattgtatagccttgggcaaaatacttttgcgctgtaaagctcaatatatcatttgtaaaataggaatcataatagctattttaccttcctcagagtttttctaatcagccaagaaaattaatatgtgaaatcattttgcaaatggaaaagtgttataaaaaggccacataatcccccctgcctgccttcccaattactaaactttttgaactaaagatcattgcctaattggtgtgtgtttgtttcttcaagtgtctgccaaagtgctggctcctggttagtttttcctaactaaatacttgcttagtaaccaaataataaaattaattaactttcaggctgctaataattttccatttctatttccagagaactccccctaactcaataggatagacattgacataggcttgaggataaatggttcaacatgaagatacatgttctaaggaattctaaaaaaaactttaggtagttcatgctaaaatgcttactaataaaaagaaatgtagctttgacattctcttgaaatgacagccttgtagtctttgaaatgcattttaagcacaagcacataatgatgtgtttaaattggtaacaactttgatggactgatccacaaaaattggtcaaaacctacacaaagtagatgtttaataagttttggtagattatggaaagatgagagttgtagagaagagagtaactcaaatggttttaaatttactcaagaaacacagtacagtagttgaaatgagtcaacataaaacaacttgtcaaagcatgttgaaagatataagcgaacttcaaagtatagaagcttaacataaaattattaaatattcaaaaagttccatgtcttatgtatgggtgcatacactgcagtaaacatataagagaatgctcctcctgctctacataacactagtgaatgctgtccacattacaagccctgaaagcacacattggaatgaaaaagtccagctcagaataagtgttaccactaagagacaaactggggattaatgaagacagagaaggagcatacatagggcattagttacatttgtaatgtttcattattaaaaatatatttgaagcaaatattgcacaatggtaaggtttgataagctctgtgataggtatacagatattacattattctctatgcttgaaatatttcttaatgtatgaattctgatactgtgtaatgagaaaaataattaaaatttcttggtttcagcaacagagtagtacttataatagtaaacacatacacttgttgtaaggttctaagaatctattgcactgctagtaaatcaaattgtgctttcaaattaaacaagtgaggtaggtcagctatgaaaaagaatttacataaacttacactgaagtccttttttagggggatgcttaaggaaaatgagaaaatctgtggctaggtctaaagaagataatcgtatttactttggaagtacagatggccctctgtatccacggattcaaccaaccaaagatggaaaatattcaaacaataagaaaacataaagcaaattttaaaagcagagcataacaatgatttatgtaatataggcattatattcagtattagaattaatttagaattaatttagaaataatttaatttagttccaaattcctggaactaaactcctggaacacacaggagttccagtgtgccttccatggtgaaaaataaaaatttaaaaataaagtatacagaagaatgtgcataggttatatgcaaatactatgccattcatagaaatgacttgagcatcctaggatttgggtatcctgatggtggagtgagtggggaggatggagggtcggaaggtgtcctggaaccaatttcctaaggatagtgaagaacaactatacaggtctaggatatatgtgctgaaatgatcactgataaagtttaacagttgcttaagagggggaaaaaaaagcctgcaagtcaaattccaaagataaattcttcaaatcctgacaataagcaagctcctaaatagcagctagtgtactatctcaatatgaatgatcccatttcttctatgagctactaaaatgaaactcagaaatgtagtttacataccaaaacatccatcccggggacatatttgagggttatcatgtagtcttttggaagatttgccacctacagagacaaaaaaaaaaattccataagaaaattcttatacatcaattaatcatatttgtagtgctttggagaaaagcacacaaaactgttgtgctttttaaagttaccaatgaatttcaatatttacatgtatattgatttttaatccttgatttccctctgtaatcaaaaggcatccttcaaaataaaaaagtgataatacagatcttttagactccaaattcagttatgcctggctaggtataacctactgagttttggaaacatgatctgaatttcagcttccacctgtgatcttggaattcccctcaaggactattttcctacttgttcctccataggattaatcataaaatacatgctttttatgtcagtggttctcaaaatgtggacctcaaagtgatgtgccagcaatagggaatctgtcagaaatgcatattctcaggccataccagagctactgaatcttacttaacaagtcctccaggtgattccgatgtgcacccaaatttgagaactattttatgttgaacctaaaaaatgatcagtgaaacttcaaaaaaacaatgctacttatgagatgcaaatgctttataagaaataatttagaaagattcattttgtgatgtaacttaattctcttaccttcggctgaacatttgagaagtctcaaatatttgcctaggttcttttgaaggctttaaataacgtctgacttacttacatcagtcattctggcataagtgaataagcaataggtttaggacaaaggaatctgggacaaatctaaactctgtatgttggttcctctcatttatacaatgaagatcaagatacctatgtcaaatggtcatttagaattaagacagatgaatgtgccaaacacattataaacactcaatccatgttctttactgagagctataccggcaactgactttggaggcatataaccctagtaagttacagagttctaggttctcttccttcctacacactgtaccaactttgctgtccgcaaccttctcttatgtcaccattaaaattcccagatgaataatttagccaacaactgacttagaccattgggtattaagataacatatattaaaaagtagttttgcaccattacatcttcaagggtctatcttgctttgtagacttattttttccttcaccttgtctctaaaaactttatcttccttatagaaagctaagatcatgtgcatgtttgctagactaggtcatctcgcacaagtttaccataacattttctgtatgattctgcttggtcttgtcaatagcttctagaatctgagaacaatttattgataaatgaatttaggcatgggcataagtagtcacatgggagctaagatagtaactgatctcatggtgcttactaccatcctacttccagtaatgccacctgacactcatttcagctctgaactgaggcacttagtatggttcctcttccctaagttcacataatcataaaatagtaacagtgtctaacacgtatcaaatatttactatgtgctaggcactgtgctcactatgggcttgggctgcattattacaatttatcctcagatcccgctgacatattacctctatttaacagatgaagaaactgaggctagaaggggtcaagtgccttgactaaggtcacacagccatcacatgttaagtctagactagaactcaggtccctggagagaagagcctcccttgtctcttagctccactacatattttcacactctacaccctctgggcacttgttctgggtattttccacttgtgaatcttcaccatcaaccttcttcataccaccctaaataaaatattagaatcattgctgctttttttttctttttttggtacagagtctcactctgtcacccaggctggagtgcagtagcacaatcctggctcactccaacctccacctcctgggcttaaggaatcctcgcatgtgtcagcctctgggattacaggcacgcaccactacacctggctaatttttgtatttttagcagagacggggttttgctatgttggccagtctggtctcaaactcctggcctcaagtgatctgcctgccttggcctcccaaaatgctgggattacagtcatgagccaccgtgtccattccattgctgcttattgaaaacacacctgagctgccagacatgacggcatttttgttcatttatttttggcgttaactcccttattctttacacttaactttcttcctctcaaactttccaccaagcttccataatttcttttctcttcttaatcttcatcctcatctttgaaaggaaaaagcgtctagtcattttatgtaaaccctagtgacaaagacagagcagacctgttgcagatgtgaaagcgataagtaagcagcaatattctatctcattttgaataaaccaggtaaattaaaggcattccagatagaaaaacgcagcaagaagtggcaggtattctgaacacaagctgcttaacaatccagccctttcttaagcataatttatattattttaaaaatacaaaaatacaatcaactagattagtatttagaaagtgtgggatctgagtatatgtctaaaaagcaaagaaaatgtaaagagtatggtgaccaattccatttcatgaataatttatatacaaatattggttcaaagaaggcttataggaagttccctgataaaaacactgaaatctacattctaccactggtggtagggcagtgtataataataaagtaatttattcgttaagctgatttactgatattcaatttctggtgagactgaaaaataatactgtttttgaaacgtgctttataatttaaaacaagttttcatatacagtctctaccacaaccccatgagagattatattaagcttattttacaaatgaggtcatggaaactcagagaggttaaccggtatccccaaggtacacgcattaggagtaactggtgcaggtaggatgcaaaccctggctttgtgtgctggggctcagcacatctacctatagcgcagtatcccattattacgtccttggttttcattggtttccttctaattacatttggaagagaacttagaaagtcaagttgtagatatttgtggtcgcttaataaattattgtgttaatattactttctaagcatttatacagattgaacatctctaatctgaaatctaaaataaagctacatgcatacaagccatgtcatctttgacagagtcaacaaacatacacaatagggaaaggactccctattcaataaatggtgctgggataactggctagctatatgcagaagaatggaactagacccctactattcaacacatacaaaaattaactcaaaaggaattaaagattaaaatgtaaggccccacactgtaaaaatgctggaagaaaacttagtaaacaccattctggacattggccttggggaataatttatgactaagtcctcaaaagcaattccaacagaaacaaaaaatgacaattgggagctaattaaactaaagagctactacacagcaaaagaaactactaacagagtaaatagacaacctacagaatgggggaaaatatttgtaaactatgcatccaacaaagatctaatatccagaatctataaggaacttaaacaattcaacaagcaaaaaataaccccataaacaacaagtaagcaaaagacacagacatttctcaaaagaagatatgcaaggggccaagaaacatatgaaaaattgcttaacctcactaatcaacagagaaatgcaaatcaaaaccacaataagacaccatctcataggggttagaatggctgtcatgttggtgggagtgtaaattagttcaaccattgtggaagatagtgtagcgattcctcaaggatctagaaccagaaataccatttgacccagcgatcccattactgggtatatacacaaaggattataaatcattctactataaagacacattcacacgtatgtttattgcggcactattcacaatagcaaagacttggaaccaacccaaatgtccatcagtgatagactggataaagaaaatgtggcacatatacagcatggaataatatgcagccataaaaaggatgagttcatgtcctttgcagagacatggatgaagctggaaacaatcattctcagtaaactaacacaacaacagaaaaccaaacaccacatgttctcactcataagtgggagttgaacaatgagaacacatggacacagggagggaaacatcacacaccagggcctgttgggtattggggggctaggcgaaggatagcactaggagaaatacctaatgtaggtgaggggttgatggctgcagcaaaccaccatggcacgtgtatacctatgtaacaaactgcacgttctgcacttgtaccccagaacttaaagtataatttaaaaaaatgtcaaaaaacaacagatgctggtgtggctgcagagaaaagggaatgcatatacactgttcagccactgtggaaagaaatttggggatttctcaaagaattcagaactaccattcaacccagcaatcccattgctgggtgtatatccaaaataagtccttctaccaaataaacccatgcatttgtacgttcatcacagtactattcgcaatagaaagacatggaatcgacctatgtgcctatcaacaatggactgaataaagacaatgtgatacatatacaccatggaatactatgcagccacaaaaaaaaacaataaaatcatgtctttcgcaggaatatggatgcagctggaggccatcattgtcagtgaattaacacaggaacagaaaaccaaatattgcatgttctcacttacaagtggggactaaacactgcatactcatggaaataaagatggcaacaatagataccagggacaactagataggaagcaggaagacagggttaaaaaaactacctattgggtaccatgttcactacctgggtgatgggatcaatcataccccaaacctcagcatcatacaatatacccaagtaataaaccttcaaatgtagctgctgaatcaaaaataatagttgaaagtatattaaaaagaaaaaaccacaaatattctaaaatctgaaaaaaaaaaatgaaatctgaaacacttttggtcccaagcattttgggtaggaaatattcaaccccgtagtatattgactcaccttccagaaagcacagataaccatgaaataaattctgcttctctgatatatatcactgtggaaagtttcacagagtagagggagcctatggcctgcaacttggaaaatactccttagaggcagtgaatttaatgtatggattaatagcacaggttctggagacagaccactcaggttggatcctggccctgaaacctactaactcagaagtcttgggcaagtcacttcatctacttcagcctaaatttttacatgtgtcacatgggaatcatatagaatctagctgatggatttataaggataaaataactcatataaaatactaagtgcttagttaggcatggtatgtgaatgagtatgaatttctattaatactaaatgcgagggagtgggacagtctagatagaggaagggtcttatgcaaaggcaaagaaatgggaaagctcataatgtgttagggagaccagttaagagataagaaatattccaggaaaactgcctttgagagagaccctccaaatgttgagctagggaggtcaaatggtaggtagtaaggtacagtaggaacagttctaccatcagaactccacagcaagttgcttctgcttagacacatagcatcatctctgtggaagttctactccttgtctgtaagataaagagggcaaactagataatttctataaattcagtctggtttgacttacttacgtaagtggtgatgcaacactgaatgtgtttcagcagagaaggaacctggtagtaaaataccaagattagtatgggaagacagtttggagcaaagagaaaacagagacagacaaaagattagaagaccactaggaatttgaatatacattaaatgtttacatgcaaactggaaactagaaaagcaggaaccaggtctagagtccagggagtattccctattggtagggttaagtggataagtaaccaaggctacgtattttaaaaaacaaatctgttctactaaagaaattcatggcaaaaaaaaattaattgacggaaaattttaccaaaggccaactcattctaatgagctctggtttggagtgcaaggatgtcaatactatgccagattgtaaaataaaaaactgcaaaaacaagttactggatgatgagctaactgtgctaggtgggaaccatttactgtcttctttggatgtcttaatgattgaccatgtccagtgacactggaaaaacatccatgggagaacagcatttggaaatgctggagacttggccaacaagaagtctttgcaagccaaactggcactggctgcataccacaccctgcaggtatttggactcagaagaaaaataactcaaagtcagaacacttaacttcctctctagatcactgatctaaaaacctttggatctcatggttcaagggtcactgaggtccctaaatctcatgagatcagtggccaccttggacatctttgcaagacccttacttgttatgctgtctctcccaagtccaaggcaggaatcaaaattcattagttatctatgactcccttgacacttttacaaaatgctgtgcctatgtcaacttttctggggaaagagtctatgattttcagacctagcaaagtttaataatcatggctgtagaggaaaaaagctctacacttctatcatcgttcactcaggtacagtagcttactatgttagttgttcaaccttcagaaataacaccccccaaaaaagctttttgcttctttgtttctcctaaaaaattatctaccactaatattgactaaaaatctaaccaaccaggtgtattacctatagttttcaaatgtaactggacttttttaaaatggtaactcaattagtgattaaaaataaattggcagggcacagtggttcatacctgtaatcctactgctttaagaagccaaggtgagaggattgcttaaagccaggagtttgagaccagacttggcaacaaagtgagagtccatctcaagaaaaaaatttaaaaaattagtcaggtatggtggcaactactctggagtcccagctactagagaggctgaggcaggaggatcacttgagcccaggagtttgaggctccagtgagccatgattgcaccactgtaccccagactgggtgatagacaccctgtctcaaaaaaaaattaagatgacaacttcaggaggcttttcaaggtcatcgttcctcagtaaagaatatctaaataaagatagataacaattttttctttcaaatagaagagattataaactacaatatttagggagtgtataatacctcatgatgatgacataccttatgatgatgacacaccttatgatgatgattccaattaagtaactaactgagcttctacaatatgatagcttcctaatcacagtaagataaggtgactactattcaggaaataaaattcagtaggttacaatgataattcattaattgtagttgaaacttacatcttaaactactgggaaggcattataaattatgaactgcattactgtgcctcaatgataggtagttaaggggtcaaacctctactcaactatttcccaagtgatgataatcagattactaaataccactagatctcagctttctaaccaatatactgggctaaaaatagttatcttgtaaggttatgaaaagtaaaggagacaatccatgcaaagtgtttctgcatggtgtctgtgtactcataactattgttctaaaaaaccaaggagcaggctgcacatggtggcttacacctgtaatcccagaattttgagaggcagaggtgggaggatctcttggggccaggagtttgagaccagcctgggcaacataatgggacccacatctctacaaaagataaaaataaaaattcaatgagcagaagacatattatccaagtagtttattctataaaggaagaacaatgttttcctaacaataagactcatatgcttgataatatagcaatctatctagagttttaataaatattatttctaatagtcctttttttaaaatacaaaatgtcctaaatttagctttaaatagagaaagaattttctgctgaccacaggagcagaaattaaaatgctaaatattgcaacctaataaaataaaatttgaaaactatctttcaaactattatttttcgaaggtcaaacaaaattatgtgaaatcttcactattaatgatatacctaggtcatctgaagaaaagcttagaattcatccagaaatggggacattcagagactccaattcttcactttaatgcagtggtaattctacttgagaacaataatatttgaagaagaaaaataatcagaattaatcaaaactgtctattcaaagtgtgaaaatgtgttatctgaggatatttttataatctctcattacgataatctccatgaatcatgtataaatatagccaacttgaaataagtgcctatcacaagaccaggaagacaatagattcctttgttctaatgctatcttactaatttgtagactgaccttgaaaagacagagtaatttcacctttacgagatggagatgggaccttaagaaacattttgaggaagacaagtcattacccaatagaaagttaaagacaaaacattttttctttttagcaacaaaatcatattgagttaaattgcctcaaatgaagaaacaaagtcgtcacaaacaaagagaagagtagggagaatacacagagaaaactagtttgaactttttcaatatctggatttccttcctatatgaacaattacaactactaaaatctgcaacctaactatcccatagatacaagttataaaagcttgattcatcctcttcccagatacttgaccctttctttaggtaagtctgagtttgccatttaaaacaaatgttgcaacatttttttagaaacaaagcaaaatgttctgtaaatagatgaactattatgcttagtaaacaggccagaagcatttcgaataaaaaccacggggaccgtgggggcagtacaaagtgttcaagaagaaattaaaaaaaaaatttgacattaaagtcataaatcatgggcttctgtgacatgagaatcacttcaagcaaaaaaacttcaagtgtgtgggcacagtgcaggttgccacctaatgcaaagatgaaactggtaggggctgcaaaggaatgatttccattgaaggaataactgtgagcacaggcaaaaatggactgtcaggccactttctttccctcacataaaatgtagcaaggttatgtctgcaaagcaaattcctctcatcctatataacctccttcagtcgagttattattgaattattccaagaggtgcaacctgaaaaaaacatcattatggaataaaataatttcaaagctgaaaaaggcctccaagtttctctaatttagtagttcttatcttctttggggtcttagatttctctgagaaatgataaaagctacacactctcctcagaaatgaacataaggcatatgaaggcagcacaattctgagcttcatgtgtaagcatttgaagtttgtcagccctagattaataactattgatcatgtccatgttcctcatttgaaaaattaggaaattgaatgccagaaagattcagtgatttgtccaaggccacacagccaggtaatagtggagctggtattaaaaaaacctagtattcccgacttccttcaagatgctctgccccaccatgtatagagaaaggctgtgattatctacatccataaatctcaacagtcactcatgttgctgtttgaataaatgaaattagtaagttaggataggaacactccacttcttttcaaacattaaaatacacacacacacatgcacacacacacacacactctataaacattatggcctaagcagtcctgatacttctacataaataacttttatgtagatgctagttggaaacattagggttctcacaccccatctccacaagttgagattcggtatagtgatgcccttagagctgtaccttaaataagtccctgagagactgtgatctgctggttctaaagtagtgacctactttaaacatattttggagatttgtattaatctggcatccttataagtctatacaacacagatgataactagtcataataggaattgagattaaataagagtcaagacattttggtttctaaacaatgacagaagagaccatctagagcaattgctcttaagcctcctttcagaattttgttaaaaatatagatgtttggatccctttttcagacttaccaaagtagtttcttggtgtagtcccaggcacctgtaatttttattattattattatactttaagttctagggtacatgtgcacaacgtgcaggtttgttacataggtatacatgtatcatgttgctttgctgcacccatcagctcgtcatttacattaggtatttctccaaacgctatccctcttccaggcccccaccccccaacaggccccagtgtgtaatgttcccctccctgtgtccttgtgttctcattgttcaactcccacttatgagtgagaacatgcggtgtttggttttctgttcttgtgatattttgctgagaataattgtttccagcttcatccatgtcccttcaaaggacatgaactcatctttttttatggctgcatagtattccatggtgtatatttgtgaaattttctttatccagtcttctattattgatggacatttgggttggttccaagtctttgctattgtgaatagaggtacccataattttcatcagcatgacaggtgattgtgatgctcactaaagtaaagcacatcatttcctcttcttcactcacccagcaaacatttaatgaacatcatctactttgctttccccgcccttctcatatcaccattaaaattcccagatgaaaaatttagccaacaactgacttagaccattgggtattaagataacatacattaaaaagtagttttgcaccattacatcttcaagggtctatcttgctttgtagacttatttttttccttcatcttgtctctaaaaactttatcttccttatagaaagctaagatcatgtgcatgtttgctagactaggtcatctcgcacaagtttactataacattttctgtatgatcctgcttggtcttgtcaatagcttctagaatctgagaacaatttattgataaatgaatttaggcatgggcgtaagtagtcagatgggagctaagatagtgactgatctcatggtgcttactaccatcctacttccagtaatgccacctgacactcatttcagctctgaactgaggcacttagtatggttcctcttccctaagttcacataatcataaaatagtaacagtgtctaacactgtttactatgtgctgtgtgtcaaatatttactatgtgctaggcactgtgctcactatgggcttaggctgcattattacaatttatcctcagatcccgctgacatattatctctatttaacagatgaagaaactgaggctagaaggggtcaagtgccttgactaaggtcacacagccatcacatgttaagtctagactagaatccaggtcattcacaaaagttagattttaaacacatactgtccttttagtattgtttcttgggtcacaaactaacaagcaactcaaggaaaaaaaacatgatctatttttaaacagtatgtttttaaaaaaaaaaaagtactcccccctcacccccatccctatacacaatagctaactgggtatatagcagacaactcttgcatggctttgctcacagttccctcaagtaagacatactgatacatctgctgctgctgcatggaagaatgcttttaaacctgaactctctgggtcctaaggaatttgtataaattgtgtctgtgtgtttctaattctatattgaggctaagctagcaagacttcaacagtggccttaaacttctgttttgaagttctattataaacccaaaataagacatatacaccagaaaatatatatcaagaggagggaagataaatagagccccttctactccttatcccagtacctcaaaaaataaacttttcatccttttctccatatcacaaccctcatttcttacctattctcgcatcacctccgttctctagtcagtatttaaataactaggaatttaaaaattgcttctcaagctttgttcatcccgaaatcatacatggttcaaaaaagcatgtaagatctcccctagatcgtgacggttgggaaggatgcattccagatgtgttatgcccactctgtggcttgatcttgagagaaagcatctggagaagcatagcatggagctggcagtgacttggggaagcaatgcaaatgctttcgctgagggaagagttcaatgtgacaaaccagggagatgagtcccttcaacatgtgggcaatgaatcacctctctatgttccctgaaggagcaaacacccactgacatgtgacagggtcttcctgctgattgaattgggagaatagccatttcagatttcctttcgttagactttttaaagaagagtaggaagacatgtgaaggggaatagaacatgctgggaaacccactggagagattatggggaacaagctggggcaagcccatcagcacacagcgaactctccaaggtccttcactgcctatgaaggatggggagaagaccagcaaagaagcagtcacagcagtggtgtgcaactagccagttttaccaacaaattatccatgaccctaaatatctcactacctgctttctataaaccctttattgtaacccagtgattactttccccactttaggaaaacattactttggggcaagaaaaatctaaatcttttatcaacaagcacaggaaaaagagccacagctcttttttacacagcacggtaaagcattccttacttaccaatttagtgacgtcttttacattattagtcacacgattcctgcagatcccttcagttttgacgagaggattaaataggagcagctgaagataaatgcaagtgagaatccaagtctaaatgaaaacagaaaaattgcttggtgatcatcagttaagatctgtaatcattcaaacttttaacatctaatgccttgatgcacaaaaagaccagtctaatatatgttattggcttaaatgcaattaaatattacgcattcaagctatgctcaccaaagtttttaaaagcttttagttaaaatccattttgaattattctctcaatgacaatattgttaacttttgttaaaaactttcttcagccaatttcccaatggcaattaggaataaacttgtagcagcatgttaaagacttagcccttagggtatcttctaaaaactagagaatgcataaaatgtataccttatggcaccaaaagaaacatcttatttctactttaaatgtagactgcttggcaagaagcagcataatccctgagcagtgctttaatccaataatctacaatagcacaccaagttaaagtgagagagatgtatatttttagacctaagagaattccactgaatttgtgagacatcaaaagaatattttgaaacacagctttttagccacttaaggaaaatatttccttagccaacaggaaggcattcttgaaccctagcagaaagtaatctgtcttctctctctctctctcgaacacacataacctacacatcggcttgaaaataacattttctattatgtattatagttgcttttatgcatgacttatttttccttattacactgtagagtttcaagaacttgtgcaactgatttatctttgtagtatcttcacaacacataacacagtgtcttgcatataaaaagtcctgaataaatatttgctgggtcaatcagtggtcaaggtaaaaatatatcctgatgctcaaattcaataaccatttattgaatatatattatgcaacaggaacaacgccagtcactagggtaacaaagatgttgaagatgcccttgaaactcagaggcaggtaaataaataacactcacatcttgtgataaacactttcggaacacagaagaggaagcaattaatcaattaaccttaagggggagaaccagttgcaggaagacagtgccaagaaaagccagaaagaaaatgtgactgtggctggatttaggaggacaaggaggacttgcaagggctgacaaagaaaagatgaacgttccaggaaaaataaacagcatgacaaaaccatgcagatgtgaagacatcttaaaatatgtgcacattcttttatgagataccattcttctgtaaaatcttaaaattacacaagagtccagatgcacatggctagaaatcttctctatttacatagctagccatattaaaaaggaactggattattattttcaattaatatctgcatgctaactagatattatactagaacaaataatgattattatttgctaaaatttctaaaactacaatgctaattacatggatatagtggtttgtattcaagattgaaatccttttattcccttaccaccatggtctattttagcagtaatcctgcataattttatttaaggctacttctagcattgtggggtcacactcttcatagtatcatctttcttggaccacagtgaagactaagttgtataaattatttctgtttgaggattcttctttttggacagacaacccctacatacaaactgtcccttaataacagtcttccttcacatgtgtaaatataatttattaaagtcagctttcttttatattgtcattgctaagacgtaacctccctggaaatatatttctctaaacccctctttctgatgtgatttgggaactttctctaaggatctctgtaatggaccaatctcagaaatgaccataatcatatcctttgctcaaagaaatgtaatggcagaaattctgttactggtcttcgcaatcctttacgcctggcattgaataaatactaaagaaacgtttgttttctcattcatctaacaagtatttattgagtatctggtgtataccaggcattgtcctaggtgctaggcctatataatgaacaaaattcctgccctcataaggcttaatcaacaaacataagtaactaggttatacagtatgtcaaaaggtgtcaaaagctatgggaaaaataagattagagcaaggtaaaggggattgggatcataatgtctactctgccttactggtgatcttgggttcagagtgacaatcacagtcatgagtcaccatgtgtactgctttgcccagcaccaaggctttgcccagcaccaagtgtactgctgagttttaagaaaggttaggttggccgggcgtggtggctcatgcctgtaatcccagcactttaggaggccgaggtgggcggatcacgaggtcaggagatcgagaccagcctggccaacatggtgaatccccatctctactaaaaatacaaaaattagctgggtgtggcagtgcatgcctgtaatcccaggtactcgggaggctgaggcaggagaatcgtttgaacccgtgaggcggaggttgcagtgagccaagattgcgccactgcactctagcctggcgacaaaagctagactacatcaccaaaaaaaaaaaaagttagataacaaaagagtacatacagcacaagcagagcagactcccaggccatctctaatatcagaaagtcactgaacactcaagatacgtgtggcaatgataggtgatgttgggtaggtagaatcattccttctgcttataccttgctagctgagcagctttttagggatatggcatgaacttctattcattttctagagcagctacccccaccagtaccagtctcaacaataaaatattaatacatatcagtgcatgacatatgcttgtaataaagcacacatcagtgcctgctacctagtaacttcagctgaattcccttggaggaagtatagatgtacacctaaaagtttcttgagtccttgttgaaagaagacttatagggagggtcaaatcaccaggcatctctgagtctcgagaagagccatagaactaactgtactcttttctttccagagattgcagtatgggtggaaacagcttgaaatttttaacagggtaatattgataagtgtctcattaagaagacaaaatttcaccaaagattggacaaagctaaggcagtgatccacgcagacatctgtgggaagagtactgcatacagagagaaaagctggtgccaaggtcctaaggtctatttaaggcatctgttatttaagacatagcaagagtaaattagggagcagtagaagatgatgatgtcagagagacaatggagaggacagctcatgtagggcgttgaagcctattgcccagacattgactcttacttgaataaaataggattcattgcaagattttgagcagaggagggatatatacttcagaataaaaataaattaattaaataagatcagtctgattgctataataaaaatagactttagggtgacaacaggtagaaaatgaaaccgacaagttgggaggttgctgctgtaatccaatcaagaaagggttatagtaatacattgactgaaagtggttagattctggacatcttctgaaggctgaaccatgagaatttcctgacagagtacgatttgagagaaagagtcaaagatgactataagaactttggtatggaaagatggtgttgccatcaactgatatggggaagactgggggtagagaaggtttgggaggcagatcaggagttaaattttgagtatgttaagtttaagatgtctttgagatattctagtgataatgccaggtcaagatatttaaatctggacttaggagggaaacttggggtgcagatataaatatgataaccttccatatataagcaaatgagtggatgagatcaccaagggagtgagtaaaagtataaaaaagaacaaagaactgcgcatgctatggtgttctaaccttaagggatctgacagaagagtgagaacccacaaaagagtccaagagagcaaagcaaaaagatcatggaaggaagccaagactttaaaaaagtactttaaggaaaatagggtcaaactatgtcaaatgccagttataggccgagtaagataaggactgataactgaccactggtttggcaacattaaggtcactggtaatattaacaagagcagttttattgaagtggtatgggaaaaagccagtctacagtgggttttagaaagcaggagatgagattaaccagaaacagtgagtatgaacagctgttttgaagagttttccttcaaaggagagcaactggataaacaaacacataaataaataaaaccaagatggggaagtagctggcaagaaattgggggtgaagagagttttatttgtaagaaggttgaaataccagaatgagtgtatgcctatgggaatgatccagtaggaggaagcaattggcaatataggtcagaagagaggggactgcttgggcaacagccttgagcaggaaagaaggggtgagattcagttctcaagtaggaagtgtggctttaaataggagtataggtagttcaatgctatcaggcagagcgctggaatgtgaatgcagatgctggttgtgttttgggaacaattccatgaatagagctaaaagttactgaacatttactatacaccaagcatcttggatatctaataaggaaaaaaataactttcatatatcctaattttaaagatgaaggagttgaggtacagggaggtttggtgacttctgagtggtgaaatcagtaagcccaggtctgtccaattctaactcctgtccttttagcccctctacactgtcccagaactcctgcaaatctgttagatggtttgtgagaactgtgatgcgatagcagatctctaaaactttaatacttttgcaaatatcaagcatatggagacaagtctgttccatattccatgccacagctgaatagtctatattattcaagtcatcataatttttaatatatgtcctttgatagttccttaaaatatatcaacacagactgctataataattgaagaatgatttgatcagggcaacataaattttttttgcatcagttaaattcaaatatcttacaaagacacagttttgttcattttgtaaaaatccactgggtcaatgctaaaattaaatctatgttagcttatgaacattcaaatatctctgaaaaacctatatttcttaaagccctttattttaaagccattataaataaattcatattgtaatttaattttgcatatactttgctaccattaaaaatatccacctttcataaaattaaagaattcattctggcatagctaaacattaggacagggagataatcaagttagaaatattgagatttttgccaagcagtaatgacacctccttcatcagtatactcaggagagagctgaaatgcagagcttacttctttatataaaaaagaaacttttcagtattaacttttctacacagaagtctttctaatattgtacacacactttgatttcttaaacagtgaattgaaatattaaactttgcttttctgtgacggttcaggttcatcaaataaaaggaagactttcaaagtatctcagttatgtagttgtagcttcccttctccaagtggttccaaattactgtacttgtttgtataacttttaaaaatttattttaggtttcatttgtttgttccttagttttcctgtttcccccagattgtcaggtcattacttgcaacatattgttactgctaacatgcctatttctagtctcctgcactcttgatgatgaacacaacatgtgtcccatatgggagcttacagcaggaagtataatggccccaaagatgtccatgtcctaattcttggaacttgtgaatacatcaccacacatggcaaaatggactttccagacatgattacgttaagaactagagatgaagagactatcctagattccctgggtccaatctaatccccatggtccttaaaaatggagactattttccagctctgttcagagagaggtgcgatgatggaagaagggtcggggaaatgtgacctgaaaaggactcaacatgtccttgctggcattgaaaatagagagaagggaccaagagtcaagaaatgtaggcagcttctagaagctgcaaaagagaaagaaatagattctcccctagagcctttggaaagcaacatagtccaactgatactttgatgtaagtgagccttattttgaacatttgatcttcaaaattatgataattttttttttttttttttgacagagtctctctctgttgctcaggctgggatgcagtggtgcaatctcggctcactgcaacctccgcctcccagattcaagtgattctcctgcctcagcctcccaagtagctgggattataggtgcctgccaccatggctggcctttttcttttctttttttttttgtatttttggtagagacagagtttcaccatgttggccaggctggtcttgaactcctgagctcaggtaatccacccacttcagcctcccaaaatgctgagattacaggtatgagccactgcacccggccagtcactaaatttttggtaatttattacagcagcaatagaaaaataaaacacagctcaattgaaatacttttggaatgaatgaatgaatgaaaggtgtagtgtagtgatggtcaagctattccaaatgaggaaagtgaattgcctctgccagaattattggcccgcaccctttattttaagcagagcagctcagctttttttgttgttttatttgttcatgcctctgagtaagattctgtttaaacaaaggtttccaagggcaagaagaaattaaaaaaaaaaaacgcttttggaaaccatgggcagaacatggatccagaaaacctctcagtcccttcccatgtgacttcaaacaagtcagctaatctccctgagtatccatttatcagcctataaaatgatagtaaaaataatttttgccttacccatctcatgaactagtagtaagaatcaaatgagaaactattcaaactatgggtgttatgcaattatttgttgtgtggtttatgggctttgcatcggctaggaaaccagaagacaagtacttcaaaaatgtttgagtaaaactttctgagaaaagactttatagagtagatctcccatatacaaagagtatgacctttagcacatgaatattttgacactgactttgagttcacacacctttttcatttatttcttagttctgaactgtgtttagagtagcttcagttaacagacaactgacttccaattaaatgacatgttccaatatatcaacaaaatatttatctttgttttctcttcctcttcttccaatttctggaaactctgagggaatagggtgcctaaatatgtgggtgtgcacacacgctcacacacaccctaatggagatacactgaagcaaaatgtccctgtgtttgtgacttctgctctaaaatgtatcttttcagtttgggtaatcatctattttttttttctgttaacattctctgcagctgtatatgacatttttctttggctactttgttttatcattgtacaacttttctctctaggtcaagctcattgtgtgataacccctcatttctggatagtctttcattgtatagacacatatcgtcctgggtagttctcgatttttgttttcagaaacatgcatcaaaagtgtcccccgtttattcccccacaacacacaaaattccaataatcctttcattgctaaatgttgccttcaaatcatttacatgattaggaaaaaaaataatgagaaatctgtgtgcactgttacaaccaaggcatgcagtagaaacagttctggtagagggaagtaatactgactaaaatttatgttaacatcagtgacagatgtggctggtccttttctgggagcagacagtagcagacagtactagaaaagtactttaaagaagtctggggtgggagggatttacaagaagatgaggttgaagacctcaaaggcaaaggtcttgcttaattttcatttttgttgagaacaaacatcagcagactccagtggactattcactcaataaccaatccctcctgaacacagagctttccttacagtaaaaggccacatgccaggaaaaggagctacaaacacccaaaacaaaccatggacttaatctgaacgtgtgttgcaacacataagtcacactgcagattcctttccttcagtagaaattaaaatgcatgcagcctaagaatatcagggggacatatgctgttcaagaaaccagaagataccaatcctctaaacttggaaaaacaaaaaaataaaatacagaaaaaaagcctttttttctctatgaatatgagaagtgattttaaaatatgcattgtcagggtccatattacagacgtcacaaagtcaaaaagagagttaagtgtttgtgtagctcattttctttatgcacagacctacgaaatggtattagagctgccctgaacaaaacagcagctgctgccaaaaacaacattcatcttctctttaatcctgcataccagctattgaagcaggcagttcccttgtagcccaaatgtattttggaagagagccaactggctcaactacccaaagacaggaaagcaagttaccaagatacaggtatggtaattggtcctgagttcaggtcttcttaactcatatgaaccatatcttccaaaaataatctatgtaaaccaacaacaggatcctcatttggtgaataaccattcagttctatatgacttcttttttcagatctttttaattgcttaaaaatttaccattaaacattataaggaaaatacctaatcatcttacacagactaaaattcttctctaagcactgttaagtaatcttaaagggacaactgaaacatttagtagatttgttagtttttgaaacttaactactatcaataaaacagatgttaccagagtaactaattgaaactcagaccaacttggagtccaaattggtgggtgccaaaatcttgtaaagatactcttctaacttcccttttgtgaagaagtaagctaaaaatgttttaaaatatgggtgatcattaaaatatgtaatgaatatgctcttataacaaaaaaaaactagaaagaagttgcttaatatgaaaaggcagacaatgtaatataataagggaatttaatgtaacgggaatttaaagatttcaaggtattcaatgcatgagaaaaatttggggaaattcaccctttaataatcagtcctcgttctacatgtaaatactacttaaagtggaaataactcaaaatatattgacttctaaggggctgtgcataggacaagcagtttgcagatattatttcctgtaatcctcccatcaaccaggtagatattattaccctactctgcaggtgagcaaaacacaattcgggagagattaggtaacttccttatggccactttgctaggaaattgctggattggatataaaccaaaacctacactatctatgctggaaagaaaaatactaggccagttagataataaaactgacttcatttatatttaatgaactactaaattttattttaaagggtcatgttacagaaggcatataggtctctttaactcaatcagtttcaaattgaaattacatgtcaagttattaccaggttgaataaatgagtcgagcaggtaaatcaagttacacttagctatagcttaaacaaaaatttacatagctagagggaggggagaaacccaaaaaataaagcgataagttgtttcttcttataaaaacaaaattgggtgctttcagacttctagtaacattatcccaggggccacttcttcatttaacagacatgtatggagtatctaataaatacataagataaagacagaaagactatgatcactggcctcaggaagctcaagctactagagaacacagcacagtggtgggagtcagagagaaaaggcccagcccctccctcaactgccccctgccccaagtacagctaaacctgacttggggaggggggcatttgggggacaggggcatttgagggaggggctgatagtttctggggggagaagcttctccaaaggtgatcgggggcagccaactcaaagttagtgagggagaagacccctgagagaggaagtagcaggtgcccacagaagtgtggaaacaaggcatgttcttagaattctgtgatttttttactccattggaaaataagtttcaaagaataagcaaaaaaaaaaaaaaaggcaaggctagagagatatgcagaggccctccttgctaattgatttagatttcattttaaaagcactggggagacctggaatgattttaagcaagggagtgtcaagatctgatttattgttaaaaggtttatcaggcatcagaatgaaggatggactgggggagagagggcaacaaacctgggggcatgaggcccattaggaggtcactgaagtaatccaaagctgagatgataagggccttaactagggcagtggcagtgagaatggagagaaatgaacacgttcaacaggatatggaagtagaacggaagatcttggtgactaatgaaaagagggtagggtcaaaaggggaagaggcacaaatgacttccaggttccagtttgggtgactgtgtaaaaagtggtgctatctgctgatccagatatgtaggaagagaagaggcagcaggagtctgggagtttatcaccaaaaaccttagtgaatactaccataccatagatagataccattctatcatgaactatctgtgtaggagatgagagaatgtgaagccaaatacatgagagggaaatcagttgattgtggggtacagcagccaatggaaaaaaaataccaaagggagagggcaatgaataaaacaagcactaaaagatgtcaatatgatgtttactaaagagtacttaatggagctgaccttaatgagggcagttgccattgagttgatggaactaaaagtcaatcacagtggatggactacaggagtgaatgagtatgagggaatttcaagggtatattactacagtttgccaaaaaagaaagaagagagtgagtgatcatggaaagggctagaaaagttcacttcggtcttggtagaagggaacacacagccctgaaagagtgggactaaaataataaactcagcatttctcttttttaaatggcctaggaatagggaacaactcacctggggttaacagagccaggtgagctcagaagttttgaccctgtgtaaaaatccctgataaaagactggtacctcaggcaagaatatagggcctgagtgttcaggtttttactgttactaattttaataaagatgtacataatagagtaagcatttgtgacagcagtatagactatctaattagtaacaatggtttaaaaagtagatcattagctattcataaagctctttagcagttatacaaagcagaggggaaaaaaatcccctacacagtataatccacttaattttaaggagatgcgagctaatgactaattctaatttctgtgaggataatgatgtgtaacagactgagctagtctagaaaactgatgggtactagtttaattctcaactatcacgtctggaaaactaaaaacgccatttctcagatgccctttaagttagctaggtttatatatctaccgccaactctctgcaataagtgtgtattttcaaagaaataagacgagcagacctcccccaacaccggccaaagtatggaaacataattttaaaaattcatgaaagttctgaaatctgcatcttcagcactccatggacacgggcaccgtttactcttatgccaactagctgctcttaaaattgaactaccctgatgtacaagaatctgagggttgtacatcaccctgatgtacaagaatctgagggctgtagctctctaaaaacagctacagaaacataaatcataatttatactctttcaaatacgtgacttgcttctgaaagtgagatctcatgtaaatcaaaaattatgtaattatttaaaatctctaaaatattttgaactccaaaccatttggtgatgtgaaatgagcataggcttcagttgccatctgatcccaagtgcccaatctgagactgaatgcctgaatttcctagaacctttttgtgtttttttcccactatggatgtaattaatgtgctcatatgtattttcacatctgctactgaaaatctgacaagtttagtctcacaagaccttttaaataaataaataaataaataaaaatctgaggaagcagctcagaaaattttcaacaaagttccccccacccctcacgacccgccacccaccaacctggatcttttactacatgagaataaactaaatctttatactctactttaactgcttccaaatatcatcaaaatgagtggagctagagacatgagctcaaagaacgttcacaatcttgatcgttttctctgtcacatcagatgacaagcttgattggcaaaggtcacaaactggctttgcgaattatgcaatgtgtgtgagacataccaactgcctttttagtgggatggaataaactgttaaaatgttccttctttcactgaaggtgttccaactgaaaccaagggagtcagctgtgttatgtttagatgaaagtgtaatcatctggggtgtttaattaaaatacagattcctgcatgtcagagggaatccaaatttctgagggtgcatctcaggaaagcacatcttttagtaagccctctatgtgattattaggtactctataaagtctgagatataatattttagatagttcatgagtgttatattgttaaagaaaacaaacaaaacaaaaatgtcttaaaagatatacaacgttgtatttgattgaagggctacatactaggtgctcttgatttagagtaacttgaggggggtgagggataaaagatgacaaattgggtacagtgtatactacttgggtgatgggtgcaccaaaatctcacaaatcaccactaaagaacttactcatgtaaccaaacaccccctgttccccaataacctatggaaattaaaaacaaaaaagataagaaaagttaagtgtattgagtgcacagaatactgttgattgtctctttcaattgccattccaatattctcctagcatatccctctaaactatcatggctggaaagctaaaaactccatttatcagacgccctttaagttatccagggttgtagatgggacttcggttctgccaattaggcgtgactgcaagatctgatatgggaaggaaatactcgagaagacaggctggctgtgggcatgcattttattggcttagttggtactgcgggcagcaagaccctccagtcagcagcagtaacagctttctgcactggccgcaacatatttacagactgtagtggacttaagttctgagtgctgggagtgttctggaagctcagcttgcagtctgctcctacggcccttccaaaaattccacaggccatcaaatgcacttcaatatactctttgaagtatatcccaggtttcaatcaggcagagtagactatattgtccaaaattaaatcctaagcaaaacaaggggaaaaagcccagtaattaagcatttatttctcctaagggtggtcaaaattttccttagaaatttcccattagtgtttcacaattcaagttgaaaaataaggattattttaaattttaaaaaagaccaattttttataggcaatccatgagagtttaatacaattctaccagctgaaacacagcaaagcatttacagttggcatgcctgggacaagttcctctggtaacaataaacttcaattgcagattcattgacatgcctgagacacatttctctggtaacaatactctacaactgcaggttcaatgacatgcccaggacttgttcttctgataacaatatatgtcaattgcaggctcactgtttatgaagatgatgacatttaaaacagagaacgttatcaaagtaagatatggattcaaatcctggtgctgtcacgtgttgtaatccagagcaaattatgtaacctctctgagactcagttttcttgtgatgataacatgtttttgcagttttgaaaagattacataagacaatgttatgtaaagcactcacaagccaattggcagatctatgagaacattacatgactattaatgctctaattattattttgttaattacagttaatagttaactatagctagttcagttagctacagttaaaccacagttgatgctacagttataattttatctttattgatcccttaaatattctaaaagctttgctaacagtaaatgactatacaatcattcacaatacaacccattttttaaaaaatgtgttttctttttaattgcacataataattgtaaacaatctcatttatcctctgcctccccatagattaaagatcagccctggaaagtgaaataaagaggttgtgaaactgccccctgagcttggatttggatccgctcttccaagcaggcaggctcttttctacctagtataaaagtgaggcaaaaattgtttgggcaacaggtgaatgttaacctaaatagcaaagtttcaaaagtcaacttcagcttcactaatatatccaaaacagctttagaaaacagtgtgttggctgggcgctgtggctcacgcctgtaatcccagcactttgggaggctgaggcgggcggatcacaaggtcaggagttcgagaccagcctggccaacacagtgaaaccccgtctctactaaaaataaaaaaattagccgggcatggtggcatgcgcctgtagtcccagctacctggggggctgaggcaggagaatcgcttgaacctgggaggcggaggttgcggtgagccgagatcgcaccactgcactcaagcctgggtaacaaagcgagactctgtctcaaaaaaaaaaaaaaaaaaaaaaaaaagaaagaaagaaagaaaacagtgtgtttactcatgcacagagaagtggtatagaggagggggttggaaaacatcaaccttagaatcagactgcccatatcttaatttctactttgacacaatccttatggccgttggaaagttattttatcattctgggcctcagtttcctcatctgtaaatgggtgtaataacagaactgactttataggtttgctgaggattaaatatagttatgtaagtgggcatttagtatagtacctgtcaaataatacacctttataaatgtttgctatggctattgtcattgctgtctagaacaagcattcctagtaacatcatgcccaaacttgaagaatggtggtttaagccaaaaatctgggcactatccttgattcttcccagtcccctatttccacatctgatcatattttctaccagcaaaataaatctcaaaactcatttctctccatttcatcttgtacaactttagcttgtgctaagctcttagcacactcttactggaagattacagggatcctctaaatagccttctttgctttcagacttattactcacaatagtatcttcttctgggaatatataaaacatgatcactacctgcttaaaatctcccaatgccttcccattacatttacagtaagactccaactcctaatcaaggcctacagagaccttcggaagacagacttgtccaactccatgtttacgccttagtaacctttatcttcccaccatgctctagccacactggcctcctttatgttcctgaaatacctggaaggtaattcctgcctcaagccctttgtacttgctgctgccagttttctcctttttgggctttgccaatggcaagttgttctcatcattcaggactcagttcaaatatcaccttctcagagaagccttcccaggtaacctgtcttaaggagcacctcttatcacatcacatcacatcacagttttgctttcccttaagcacttttcattctcagaaattattttgattacccaattagtttactcttatcatctgttcctcccaacaagaatatacatggtataagaatgaggattatattattcttatccgtcattcttacctctagcaccttgatttggtcctttctcatagtacataatcctccatatttgtggattgtatgtattgctaactgctactgaattgctcataaaagttctccttcaataaaattctcttttatatggtacagaccaaggtactggcactatctaaattgtgttactagagaataaacccaggtacatataatggggcagagatgaaggctggacaatgtacaattcaatcctcagcagctggtttccatatttacacaatagaattgcaacatcgccaaccagttttgcttattatctgtttcttacacttgactgtgagcaccataaggtgccatatggactttcagtccctccctgttttgtcagactgactaaggcaatggcaggtgtgaagaagcccctcgtaaatatatttagaatgaatgagtgaaggataaacaggagggttttgttcatcagttgggtataaaccattgtcatccttctcactcttaggctcaataacttctaaattcaaatagtgacgattagctaaatgcttctcagtttgaacttttaaccattttctttgtacctttaatacttccctaggtccatgtaagtggaaaactaggctataaaaccatgagtagactacaagctccaagaagggcagggacaacgtaaatagacaattttaatgaatgaacaatcattgaaaaatgcttctcctggtagatgtggcccaaaattgaagggctgacctggctataaaatccccagagctccctttctgaagaaactacgtaagtataaagtggagtttctttcctttattgacaaaaaggggcatattaaaaaagcgaaaacactgaaagtatcacacagagctgaaatgtagacactgtcctgcagtaagttcactggaagtctctgagaagtcaacaattccatatactgctttatttagaatttattgtaatacgcaaccataaattttttatttccccaatgagttgcaatccattaacatttctaaagtagccattcataaaaattattcatggtgattcagcattcaaaatgcatgcaaagaataagatttcactcagggaagacatacccagaagtgatgacatgggttaagcttttaaatgctaatcttatctcttcccaaagcattggttgactcttatctatctgtcatcttttctaaagcaggcaaaacaatgttcataaaactgaatccctttccagactcattcctactttgaccaaaacaaaaccagctaccttttcttcagggacacactggcatagtgttgatgttcccctatcatgcaacttgtttgcaagaaacagaaagtcgcatgccagactactcatgagctgattcaatgacacttcatccctcccccaaaataggctgcatcatcacattttcatgctaataatcatgactaagtggcaagctcttttattccaattgtttatcgtgagatccatggaattatccttagcattctctctaataccattttgatgtaggaggagactctaaattcattaagaaaggaagatgtggccgggcgcagtggctcacacctgtaatcccagcaatttgggagaccaaggtgggcggatcacctaaggtcaggagttcgagaccagcctggccaacatggggaaaccccacctctactaaaaatacaaaaaattagctgggcatggtggtgggcacctgtaatcccagctactagggaggctgaggcaggagaattgcttgaacccgggaggcagaggttacagtaagccaagattgcaccattgcactccagcaggggcaacaagagcaaaactccatctcaaaaaaaaagaaaagaaaaaaggatgtaggacacagtaaggaaggagatgattttttacaatgtatcaggataggagtactggcatcacacttgttattgttatctctattttagaagattctgacttaacagttttctcggtaaatgtaagttattgtgcattctgaaattcatcctcatggtagacttgggaagattattttgctttcaagtttaaaacaaaagaagaatataggaaatgtaccttaaggcctcaagtcttgactcttaataatgctgggaaaatacagaaagaaactttcttcttggagcagaaaagggggagagtgggtaaccatttcaaggtaatcctttgagcttcttttcaaagcagctgctttgctgaggaatcagaaggggatggaagaacaaatgtaaacagggaaactggatagcaaagagattttctcaccatatgggagagaatagggatctacttcctcaggaaatgaagagagggactcgtgagcaatatattcactaaatgaaatttaagatgtacttcggctgctgtatgttttaagtgccaaatctgcacaaaccattttgtacatctacttcattgctcaccatttgtgtgttatctcctcttctttatggtcctttttggagcttttctttgcaaatcaaggcagaaggtagactttgtgatataattatataaaactggaaacattttattggttcaagaaatgttaacttttcagatctacacccaaaaccaagaagcttacctgattaaaaaaaaaaggaacacagatcatgctctaagtttgtatcattttaaacacttcagaattttttaaacttggcatcaaagagtatccccaaaatgatatatgtttttaaaagtacatgcaatatctgtaacattattttagagcactgtattgtaaagcagtagtattactgccttgagtcactaagatgatggcttctaaccacacatgaaatttgaaaacatcacttcttgttaatccttctccaactttcttcctccacgcttaatctctgatcttatgtattgagacattatttttgctgaactccttaaccatatctgttttaaatacataaatatcattctaatagaatcatctaaaccctctcatattgtcatatttctgtctttcaactccttttagacaaagactatacatctcagtatccaaaactacacaacatcctttacttgagtattgcactagctacctattaactagcacaaattgttaacagaattttaaaggaagcatcttgagtgtgggtgagctgggaaggaagaatccatttaccatatttgtaatagtctcatgaattattatgtatcaaaaaaaatctcggctgggcacggtggctcaggcctgtaatcccagcactctgggaggttgaggcaggcagatcacgagatcaagagatcgagaccatcctggccaacatggtgaaaccacatctctactaaaaatacaaaaattagccgggagtggtggcacgtgcctgtaatcccagctactcaggaggctgaggcaggagaatcacttaaacctgggaggcggaagttgcagtgagctgagattgcaccactgcactccagcctggtgacagagcgagactccatttaaacaaacaaagaaacaaacaaacaaaatctctaggtgagaaaataaaatgtcaacagtactaatactaagcaagaaattaggaacaaacagatcaggtttgatgactgagagttgtaagatgctgagaaatttgctcaacctctgtgagctcagattcctcctcttgtatcaaatggaataatcacactaccaccaccctcacaggtggggagaatcaggagacataaagtatgtaacacatttagctcaggacctggcacagagaataagcatcggaaatcaacatttttcctcttcatcatcatcaacaatattctgccctaaaatcctttctggttcttaagtcttcatatatctggcattagcgagttttaactggcccttgtcattcagcctattgtgtcatttccttaagaatggcaagcaatggcctcaccttctcctttatttatttatttatttttaatttactgtctccattctcttctaccacccaaagtggctcatttatcatttctctctctgaggaaaattctgtttgaacaatgtatgtatgtttatacaggacagtgttacatgcagtttcatgtgtctgctgaggtcagcaggcacaaaattgtcaaatgtctggatccattcttagaatgctgacaggtggatgttgtccctcaaagagacatttggcattaaattcatagtttagttcagaaaacctttatcaatattttggcactgtgccactagctagggataccagtgttagacaacttagctaggtaagtaaaaaaataacttcaatataatgtgataagtgatatgattgtttttttaaatgctacaggagctcagggtaagatcactaaacaacatagtagggagaggggctgaggaaaaagagcaaacaaaagtcagggaggacttcctggagtagagaccatcaaagctacccaaatgcgaggccctcagggccttggaaaccaagtgcagcaatattggtatgtcattgtacatagttaggtgacgctggaatgaaacttaccactcgggagtggtggagataagcaacagccaaaccacagaggaccttgtatagtgtgctgagggtttggactttatcctgagggtaatgtaaagtcggtagaggattttagccagggtaatgacacagtcagacttctgttaataactctagattgtgtgcattagaaagaacctttaaaattataggatctacccctacattttgatggacaataaaatggacatcctgaaagctgcatagcaatacagtaccacatacatgaatttaggacatggatctcctgcgctgtcagtaagttcttgttctgactttcctgtattactcctcaaatgctaggacacaaatcttcagggaaaagtgcaaaaggaattcctttttaaatctaattctgttcctaagcaattcacaaaaattacacatgtcagtgtttctactacattctcctttaggccttaaaagcagggactttaatatatatatatttgtttttctttttcaatatctaaaagagatttctgcattttaatattggttcaaagtgttgtgttagatcccactctgaactgaacccaaaattacttcccacattttccggcttggtaaattaatcactgtggtatccacaatcaaagattcaatcaagaaacttccagaaaacctttggaaacaaactttgtattacaaaagagttataaaacaggagctgttttctctctttcacaagtgttttgaacaaatcagcactccatcaaaaagaacataacagtttaatgttctgtcaaagaatggaatgcttgtttacctgaagtaatggactgataaaagtaacttgcatctgtcttgattgatacaaaacttactcaaagatgaatctggacaaccaagcccttaaactaaacagagtcactgacaagaaaataaaacctgaattcataatggaaacatttccaaactgttgattctataaagttattaaattcaacacatgcaaaaaaaataaaaacaacaaacgaacaacctttgaatgcaaaactgcattttatttgaaaggagctaacatttaccgaggttttctggtacctgtcctaatgcccttcttatgcattagctcatttaatcctcacagtcaccttaggacttagacactattataaacctcattttacaagtgagaaaatcagaatgttatccgaagaatcaagtgactcaaagtcatacagtttgaagagatgattccagatttatgagtctccaaagctattcatgatcatactatacaaaaactaatttgaggctcattttagaagacattaataaactaaagttttcatgtacttggaaaatttatattttttattgctcaagtctgagaacaatacaacaacactaggcctctgaatggacagtatagtatgtagagcactgctcagttaattaactctcttgactttcacaacttgtgaggtcgccaacatgtgtcaacatccttacagacacagagcagacagtctaatacatactgatgtgtctgctggcataatccattccctaaagcttacagatacaatttattgagcatcacttctgggtcagacaatttccacatattatctcatttatttatttatttatttatttatttatttatttatttattttatttataatatttttgtagagacaaggtctcactatgttgcccaggctgttctcaaactcctgggctcaagcaatcctcctgcctctgtcttccaaagtgtttggattgcagacataaaccaccatgcccagactataatctcatttaattcttgtgttcttccaactatgtactattacccctacaaccccattacaccaatgaggatattggggcctagaggaaggaaataaatatcatgttgtaatcataatagtggagctaagatttaactctcattctgtctaactccaaaccccatgcttcttccagtctacacaaggccaatgagccaaacactttgagaaatataatttacttcttaaaattagagcaggaaaccgtgttaattctgaaaaacattgttttctaatagtacaattatttgagtgattgtgaatcgtgattacaaattaggtatataacattatttccaggtttttaaaaaaaagaagggaaagaacaaggaaagaagggagagaaaaaagagtgaggaaacaagagaaggaagctgcaaagtattattcttccattttacagaagtttaagagaaggttaaggaaagataaataaattgcctaaggtcccatgtcaagctagagtcaagagccagaggtaaaatctatatgcttttgacacaaaagccatgttctttccattttcttttgacaagtggctatatttctatggatgctgaaaatgacttcactcatatagggaaaagtaggcaatcactcactgattcaaaatgggaatgactcatgttctgtccccctaattccaggtaaagcaaagagcttgggaatgcgagctctgaatccgaatctgtttcataagccagccaccacatattggtgccgcgatcttgggcacatgatagaaagaagtaactttgctctaggtaaactcttttgtgattctaattatacacatttttctttttcagtttttgttttaaaaaaagaataaaaacaactacattactcaggacaaaagtgaatttgaggctggagttacttggataaattgcttcaactttccctttcactctggtagtggagattttgcagttaaagtcactttctttaagaaaggagccatcactattgataagcattacattaccatttgtttaatggtaatagcaagagtaaatgtttatttagtattttcttggtgtccagcactggactaagtgcttttttgtggattatttcattttatccttataactacctatgataaatgtaccattgctcattctgtttggcagatggggaaattgaggctaagaggttttcgttcttaggcaaccaaagcagaccatctgactgcagagtttggttaagcacatctctgttctgttgtctcctttacctgtgttgagatgatgccaggactttttagccaacattttcatttgtactaaactgctattgagtatgttacaaggtgatgctgctgataaggttgtgctgacaatcacccatttaaaatcttgcgatattaatgcagaaaatattttttttaatattaatgcagttggattgataagaaatgaacaaaacaaaggccacaatataaatggctggtagctttaaaagccagacataaacgacattattatcaaataatttcctaatatgatcacagacatttaaaaccatcttccaaaacatcatgtaaagaggatcagagcaaattgataaaagtactttctgaagtatctttctatttccaagaagttattttgaaacataactttaaaatattttaaaatctgccctctgccaacaaagtaccactttatttgaaagacagaaagctttttggcaatgaagtaattcctgattccataaagtaagacgacatctttagagtttacaatgagattccctcacaacagtcagatgagtcaggcaaggggtttccatttgactgctggggagatgggtgggaaagcctgatgaggaaacccaggctccctgacctgtgggagtgttgctcacatacagccatttacacttctggtaagtactgaggagtgtggggtcagaagcaactcatcactcaaccagaggactcagctttgcctgctctcagtctttctggtgtaaagttaaattgcatcttcttctccacaaataaattagaaaaaacaacaacaacaacaaaaaaaaaacaaagaagttcaaccctttcagtttgtatgtgtatgcatgcgtgtctatattggtgcattatattgtagtgattagaaggaatctggcctttagatttaaataggcttggcttcaaatacaaactcttccacttgcactttttaaattctcattttgggcaagttttcttaatctctctgaacttcagggtttttatttttctttgttaaaaaaaatgatgccaaataataatatgtattttacaacattttgctacaatcgaatgagatacacttgtgcagtttgtggcatggtgtttcacccatggggagtaattcacagttattaacttattaatttgtcttatatttccttattcagtaagctgctcttacttcttaaacagcttgtctttggcctactttgttatttcttttcaacagaaaggggagaaaagtaaagaagataaaattgggaaaattttctaaaaatttgctaagggtgtttatgagtgtcaaataagatagataacgtataaataagagagttaagctattagtctctaaggattggttttaatttttttatttatgaaagccctatagccaaagccaggaattactaacactgaagttatttcttacagcatacagatttgtataatgttctgtgtgatttactattcttttagagaaggaaacaatgctctattaagtaagtgccagttgctgtgatgttagacagtctatctcttttaattatcacatcaatactactactaggtggttacttctgtgcccattttaaatattgagaaagtgaagttcaaagagaaaaacttactggggttggtaagtggcagaaccaatactacatttgatctatatccattcaaacctttgctattctctcacattgtctccagtttcactaagtaaatgatgttatgcattcactgaaaattaatgctgtaaaatagtaaacaaagtagccttgccagtcatgcaccaaacacatttgtgtgtataacagacctagcacaattgttaaaattttgccattagaaaaaaggcttataaaaaatgtatcagtatctaacaacctgaattaggtctccattcatttcacaacattccaagtgtatttactgagcagttggcaggagccactctttgaggcaactgcaatcatgaaatttttgttgtccaaattctattactggcagcttttttgaacatctgagttgcatttgtttttgattcaatgttcatgtaaacagaatgcatatctttgaggtattaaataagccacactaatgcgctgtggttaatgccagctgagtctcttttgcaataaacacctgggattggcaggagaaagaccttgtcttagttttcctatctgtgaaatggggtttaaaaaaataataactacctctcagcggaaaagtgctgtgaattaattaatcttggaactgttttctactaagtgccattttggcatgatctattatcaggatggtttgattttataatataatgatagaagctatttaaaatggctacacatttaaatgccaaacacttgacacatagtacagtaaatttcatctcttcaagttgaatcattatgtgtgacatttgtacagaagtgcaaacaataaatggtcaaatcagtcttggatttaaaagtctcattattgaaaaatataaataaataaatgcaaacggcttagaacaggtcctgacattgtgagcattatataaggatttgctagtattattagaagctacttataattttaaattaaaattagctacagtcatatgtgtatctatatatgaaataaatcaagcaagcctaataaatgcctaaatacatttttttcttaaagaccctagtttcatattttaaaaaaaggtacattatttttaaagtattattaaagcatagagtactgtggcttcagtacattacaaacaggaagtaaagttttaaaaacacttttctgggcaggggctaagaataaatataaatatgtacattatatatatattatatacattattatatatatatatatatatatataatttgttacaaagatattggaagaattatgtaagccctattttgtagttcagtgcttttctacatacaattaatgtcatccaaatagtaaaaacattatgctaataatttcctctgaatttttcatgaatgttgcctaatccctttattatcccctcattttgtttagttcccactttggaccacctggaagtagaaagcaccagccattctcctatactgtgataatgtatctttcaaacagcagaatgacaaatgtgctaaggtcagtcctctgactaacagagcacatcaaagatttatgagtagggcccacggaatacagcagttttctaaagttgcgagaaatccaaactaaagcaatcacagagcttttggttgttcatcaaaaaaggaaatccctaatgtgtttactatttcagaagcgttaaattgtacatttacacagaaccataaataatgatgtatgactgctgaggtctgtgttgcaatccttgggttttctagatcacattagaaacaattttatatgaaaacatctctaccctcccttcttaccactcctccatctagagttctgcagtgaacatgaattttaacagccagtacatcgatatggataacacatccaggagggtgacaaggcctttataacaaagcacactttctctgtcacactcttcttggaagccaaagaatctgtgtgttttcccaaggcagttgtttgggaaggcactgagaaaggaactccaagtaaacagtagaaaactcagcactgtagggccctaagaggttccttcacaatagaccaccattattcagttgtattccttagaggcaacctggttcactgccactcaaatactcacatttaggtgaaacaagccaataatgagatgcaattcagccctggagcagagtgaagacattgaaagggaaaggtcctcagctttagggattttatgtcaaggtgaaaaagagggaaaagttctaagcactcacagggcttatgttcagcagatgaacttctgctcctgaaaaggcaacacagtatgggcatacaagacaaacacaacgcccccctccaacctgtgctctttcttcccaggtttgcacagggatgcaattatgcagtggggatgccctttctgcaaaggtgaacaaggcttgctttttcaagtgagcaccgatgagtttgcggtggtcctttcatgtccttttacatggtcaccctaaagagcaaaggcattctttgtgagcaacagacaaagtttgagctgctgtctgtgtacctggaacacagaaaaggctaccttattgccccgctccctcccaatttacccatgttctaatcagcagcattcaagagccccagggcaacagctacaggcacaaagtcaagtgctgaatttctgcatccaaatatcccaataatagccattgctacttttttttttttttaaattttctagactattgcctcaattctaaactttgttttagtggatagctcagtgggcaatgccagtgattagagaagaacattatcttcatggttgtggccctgttttctgagaaatgtgtgttctcctagcttgaggagggtccagctgatcttggaatattctcatgtcaacaagaaaagactgccatagcttctgactgctaaaagaaaaaaaaaaaaagaaaaaaagaaaagggctacggctagctgctgggtttgctccagctctcagctaaggaaaggaggtaagcaagcactgttccaaggatggtactggacccagacaaaagccagccaaggagagatttggcatagtatcatctgcaggaactgcctttccctgaggctccctcctctttccacctccgtgtctccagctgcagcctctcatcttcactatcttctcaggattaactatcttgggcatgattcagagatactaagactgggagactagtccaaggtcacacatcttgaggcagagcaaagggtaggatcagttcctctgattctcccctcagtgctctttctactacatcatcagatcccttcttggttttctttctccatttcaactccatgcacacacgtactggaagttaaagggacagaaaaaaaacaggcaaatacagggaagcattaccttttgtaagcttatctcctctggttagctgactttatcttagaattctttttcatagaacttaaaaatttagaacagagaaagtaaagatcctctttaactatggattttgctaaaacaggaaagtgtaaataccattctttttacaaagaaatatcaagcagtaggtgaaatgcataaaagtagaacagtctaaatttaaatctccttcatttctccccattggcttattcataatcataaaacaatggttataatgtgcattcacactgaagcaatggctgcataaatctgagaactgaaggaagcttaaataccatctggttcaaatatctattttactagtactttagaaatagagaattttagaaccagaaggcacttagaaatcacctagtctcacttactcattttacagttgagcaaactaagatctggagttcaaataatttcccaaattactactacttattatccaggttaataaaagaaatcagcctcctaatatccaagccaaagtggcagcctacaaaaatagtaaaatgtagccaaaggacaaagacaggtacataaagaacagtcttcctttagatgacacacattatgattttaaagaaagaaccatgagccccaactatgagaaaatcactcccccacctcttttttctatagagaaagaaataggtagagatgagatcatgacaattctcttaaactcccagcccctgtaaacagtttttagtatacccataattaagtgaaaaggcaaacacatcttgctgcatctataaatcagaaaggctgcagtcaattgtttctatgaaacagagcctatacaaaacaaccctgaaagcagcatatattataaaaatatcttggtgttccctcaacttgttttgtaaattgttctgtctacacacgtgactaagaccaagaacagtgtgtaagaccaagaacagtttcttgcagctgctcatgatttatgtgctagaaagaaagataaaagatcactcttcagagatttatatccaaatgccttgccctaatttacaaaagggaataaaatttacaaaagggaataaaaataatttacaaaagggaacattaagataatccagaaaagaaaaataaaagtctcaaactagcataatgaaaaaaaaatgtcactgcacgttgcctggtaaagacaacaaagacaccccacagaaatgaatgcatggcctcactcagaaaagcaagtgcgagaacattagggatgggaaactaaccaagtctctttagtccaaaataaaataaaataaaatgaaataattccttagaatcatacaaggagaacttagcaagagtgtagaaatatgaaactgagtcagcgataaagataatatttccattttccatttctattttctattctaattatctcattcatttgtactttaaaagaaaaaccttcaaaaacgtagcacctcttaagcccacatatcacctttgtcttcacatattcctggattgatgtgtcttaattatagtctataaacagatattagcctatcatgggagtcaccaaatcgacagacgtagatttaggaaaacttggtctctgtgcttggttcattaggcataatttacctgcaataagtcagtttttctctggcttgtaaaagtaggccagcaggcactctcttctcaggaacaataaattcaaactgtacatatagtaagctactatgctggtataaagacacatataaaatttcatttagtccttaaaaccaccatgcgagaaaaatctttataacttttataatcatcatacagattacaaaaaacagaaatcccaaaaagtttaacaaatatttgcctaaggtcatttgtctcatgagtagtaaaacaggaattagaatctaagtcttcagaagctagaacctagaatccttctaccaaccatattttaggtgtttctcatatatgctcagatatggtttattctcagatataaagcgaaggccacatgtagtggaatttgccaatccatgtaaaaaacctccaatacccacacttgctatttgagtgagaaatttttatgtgatttatggtgatggaaacatttcagtcacctattattaaaaaaaaaatgtgacccagaatttgctatcttcaaatcagcagttagacgtaaataaaatttagcaattttaattggtttggcccagactttcagatttccatatggttattttccttgttttatgttaaatgtaatcaacttagcacttgggttttaaagtcttggcagaatgtatcaattaaaagctacataaattggaattattcaaagcatacattccaaattgagtgatcttaaggacaagactaaaaaaatgctcttttcataagtatgttaattttcttctacaaagtaaacttgcatcatcacccacatgacaaacttcatacagacataaaagagatattttctttggagtagtgaaaattagcattctatttgcttattctctgagagttagtatgcctaaaatggccttttttacattgtttgcaagatcaatctttcttatctcagtatttctgaaattgacaggagttatgacacttctcacaaaccatccccaaactaaaatgtaagcacaacattgataaatgtaacaccaggcacattaagctaatggcacttttaaccaaatcttaatcagtgttgcaaaatatggtgccttgattgttatccaatatggtgtatcagaatattatgtttaaaaaatagttacacattgaaagagatgttttttctaagcccaagccacaaacacctctagaaaactgtaaaaccacacaatctgaataaaataaaatcaaacagaaatctgaaaaattcaaaagacattcatttctgtagaactgtgcttaaatttattgcctgtgtcattatattggaaatactgaagtgtaccaacatgctaaatgaatgaatcattcatcaaaccccaagtggttgttgatggaattttcacacttacttagcttgacggaaaggccagaatacctggagtccccatgattcttggagagctgtgtaattcaaatcaaaccccattttaaaatattactataaattttttttatatgtggggtagtaggagagtacagaacaagttgctttataatagaaccatggtattgatgccatgtttataaatgactatttaaactactaaatattaatagatattcttccctggtgaggataacattagaatcagaacaatcgatcctatttcttaatgtccaatttacataggctaccttccatccatgcagcattgcacagaaaatgtctttgtaatttttggattagaaaatttaacaatatgaaagatctaatcccctcctccatttctgcagattattttattgattttgggctatttccagtgtcccctttttcagtgactgtggaatcgctagaagtattcttaaaaaaaaccttgaaggtcattagatcctaggcaatgaatgccttcattcaacaagggtactgccctcctttgcctacaagccgtttaacatcagcaagttcccccaaagggcctgcactttaacttgtgtgatgtgtgaccgaacaggtcacatatctaaaatacttagctttctcaaatttctctggtcggcagcactgagtcactaatgccacagtcacaatgtttcagactagattgacctctttctagttttcaatggaattattccatgtaatccgatttacacagccatttaatcaaagcgagaaaggagattacagagctcacatttgttttgcaaagcaagggtgcaaggataatcaatcctactgcctctcaaagtgacttgatagtacatcccctggctttggagtgttggacattaaccttatctgtctcctgtgttcttgtttaaataggaaggtttaggctcttttcctgaactagaaggtagcagcttcttcccccagatctcaccaccatccatgggagcagatgctactataagaaggaataggtctctacccttcttataatttcgcagaaagcttgtctaaatcaagagattacaataaaacttttcttttgttgcaagaatctttaacatttgcatttcgacagcacgctgtggtgattccaggtgcggtgctcaatgccttgcctgaaagctaacctgcttgtaagagaggggagaggcacatcgcgtcttttctcttagagagtgctctagagactatgcaagcctcttttagccaggcaatgtccctttcccctgccttttaccacaccggtacaaggggctagagtcttgcaactttttgcaggcctagatatctgtttaaaatatgatgctaagcaggtcatttgataaagcattttgagcacattgatgccttcattctacaccaacgatgtgtacaaacaccccggtttcctttttccccaccacttccaccccttccacacatttcaggaactgcaatctccaacagaacctctggggggtgaaagggcaacccttagccaaccgcggcagataacacataacaatttctaagggggaaagtgagaggaggtaacaatcaacaatggtgaagagaactgtggataggggcaccgtggcggccctttctaaacgaagaaccaggtattttcttcaagggaaaaaaaaatctaattgtccccccaggcagcgctttacccacagtgctttatgtataatgcagaatttagcagcactgggaattatctcaatcactatcattcagaggtgcctattttataaaaagcctttatcccttttgaaatggaaaaaggtgcgtgcattgtggaggtactagagctctttagagcccacacagagctgcaaactaggcagacaccgccgagagccaagtttcccgggcaggcgggcaggttcccgccccgccgagagctgccgcttaggagttccgcgttggcttcgctcccgcggctgcacccgcgttcgcgccgctcctggtgcccggcgcccacctcggggctacacaaataaatctgagtgagagagctagtgagggtggcgcgtggggtgctgtttcataatctcctggaatccacgggaaaaccgtctcctatgcaaagacatgccttcccgtgataacttaacattccatggcccaaaagccaatctttccaccagacgggaattacggtttccgactgacagctcaaaacttaactgctgaggctccaaacttgacactggctccctctcagcactcccactccttttctccctggctcacccggctcggctcgggatcacacaccacgccggcctcccccgcatcctcttgtctcacccggcaggcacagccctgcacgccccagctgcaagtcccagggagcgccggcttccccggggcaccgggcgcgatttttcctggagagcctgggagctcccgggcgcgccctactcacttgtgtcttcttcataaggaaaggcagcgctgcgatccagcacaaacagtggtgtggcgactccgtttagctgttctggagctccagcatattgcacgaacagcggcggcagatagtccacgcattgggtagcccgagcgcagcgccctctccactgtccctgcttcccgcagcgcttctagtctcggcgcgaggcggcgagcgaagccc

SEQ ID NO: 1839 - DNA, 87681 bp, Homo sapiens; identical to SEQ ID NO: 1838

SEQ ID NO: 1840 - DNA, 3785 bp, Homo sapiens
ggtggggcggggttgagtcggaaccacaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgtgagtgcagaccacggacccgagcggcgagcgctgcagtggggcggcgcgcggctccctgagggaggggtggggaaggatcaccaggaagggaggaagcggcagagggggcagcggctggggataccggccgggaggtcccctgtcgaaaagggaagccggtgtgctgggtgcttagggcatgttccgggacacgctcaggccagagccttgctggatgtgcccttggtgggacttgggatggaaacccagacgttttactccccgctctgagcacatcgctatccctccccgcccctcaccaggctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggtatggagaggggagccagacttcccctgtcccccaaaggggatcccaagggggcgacctggaccccatcctggatggttggaggggcagggacaggatctccggaagattactaagagttggtctgcagcagcatttgtaataggcaggaccctattcatcaagtggtggtgaggaaggatccctggacctgagaggtctgacttgggttctggtctcagccatccacttatcagttgtggaaccttgggtaagtcgcttaacctctctcagcttccttacctcatgtttaaggagaagacaataatttccctctccccgctcccctcatgggttgttgtgaaggtcagatgaaataatgggtataaacagtagaatgacgtgcaaacacaaagtgttgtcatcccagtttcaccgactcacagaaccatggcagtctccagaccctagtccaaccccttaagctttcaaagaaaggaaaatgaagtccagaaaggggaagtcaccattagattgtgaacttcttagtatctgttcggtcgacaagtatttaggtccttgcagtattctcaggactagggaaaaaatagcaaacagaaagacaaaacccccagccctaataaatcttacacagtgatacaatcacggctcactgcagcctcgacctccctgggctcaggtgatcctcctgccccagcctcctgagtagccgggactacagacatgcaccaccacacctcgctaatttttgcatttttccagagactgggttttgccatgttgcccaggctggtctcaaactcctggctcaagcgatctacccacgttggcctcccaaagtgctgggattacaggcgtgagtcactgtgcctggccacattttttaaaataagtaaaatatatagtatatattaggtattgaaaatgcaatggagagaaagcagggaagtgaaagagtatgagtttgttgggtgtatgtgtcagggacagtctcactgaaaaggtgacatttgatcaatgatctgaagaaaggtgggggacaagccatgtggttatctgagggaagaatattttggacagaacagcaagtaccaaggccctgaggcagaattatgcctgctcaaggatcaacagggttggttggtatggctggagttacgtgagatggaggagggtagtaggagatgaggtcagagaggcagggagtgcagtgcttggttcctggcatacaataaatacctagtaaaagtttgctgaacttacttttgtttttttcaaattggccagaaggtgaactctccaggaaggatcttcattgtaactcaactgcctactctcccctaccccctgcacaaccaatgccatttttagttcaacatatgactcctactggatgcctagagctggtgctatagggcaatagctttcaaacgttttgaccacaacccagccataagaaatacattttaaggggctgggcatggtggctcatgcctgtaatcccagcactttgggaggccgaggcgggcggatcacaaagtcaggtgttcaagaccagcctggccaacatggtgaaaccccatctctactaaaaatacaaaaattagctgggcatggtggtgcgtgcctgtaatcccagccactcaggaggctgaggcaggagaatcacttgaacccaggaggcagtggttgcagtgagccgagatcacgccactgcactccagcctgggcaacagagcaagactccatctcaaaaaaaaaaaaaaaaaaagaaatacattttaaggctgagcacagtgcctcactcctgtaatcccaacactttgggaggctgaggctggaggattatctgaggccaggagttcaagaccagccttggtgacctaataagaccccatctctacaaaaaaaattttaataaataaataaataggaaaaaattttttaagaaagacattttaagtcagagctcaacacacacatagacccactaaaacaaaagtcatgaaacaatacttttcctactacatgtaatatacttcattttttcttttttggtttttaatgctgatcaaccttcttaatttatctcctaactgtggggtcaaatctgcaatttgaaaaacattaccatgggaaaagaggagaaataccagttgggttaccactcccatgcccctctcagtgtctgtggggtgagctcacagtaataacatcactcatttggacaactgttggcagatatgaaatttcatggtattagcaccctcaccaactgggatgaggtagggattacagaaagaaaaactgaatttctgagagactaagtttcccagagtaacatggttagtaggtggctgtgctgaggctggaacctgggctcagaaccccatgttcagggctgtggccaaaagcttttccgctgaacttcctgctgtgcccagggcatgggaggaagatatagtctctctggggccagagaagcctttggggaaggagggtgctaagggtgccaagcagaacatcacatcccatcatatcacccccaccaggagggccgtgtagccatcacccgagtggccaaccttctgctgtgtatgtatgccaaggagaccgtgggctttggaatgctcaaggccaaggtgtgtatgtgcccatccctccatagccctgggcccagccttcgtgcttctacactgtgttcactcccaccaggaccctgtttctagagttctcatgtctactcagtccatttctggtgtgggccagctcccaagagcaggtgggggttgggggctggttgcttcctatggcactgggagcagacctggatttggggtccctaatgccaggctgtgtgcgggactgatctctgttctccctctgcaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcatgtg

SEQ ID NO: 1841 - DNA, 3785 bp, Homo sapiens; identical to SEQ ID NO: 1840

SEQ ID NO: 1842 - DNA, 34927 bp, Homo sapiens
aagtcagggtgggacgtgggcgcggggagacaggtggtggctacgacggcgaagggagctgagactgtccaggcagccaggttaggccaggaggaccatgtgaatggggccagagggctcccgggctgggcaggtaaggagcgctggtattgggggcgcaggcgccggggtgagaggcctgatagcagacggctgcagctgtgcgggcccaggctccctagggatgcagcagccctttgtggctggggagagaagatcctcgctcaaggtcaggtgggaggcaggcagtgtagctgggtcgcctctttcctgcgaagctggtgtcgcttgcctctgtcgtgctgtccaccagtggccccacctgactgggagcgtgtttcctggacaccaggcacatggacagtcaggtgttaaaaaggcttccagaaaccaccaagcccagtccctcaggccatgaggatgaggctcctgaggcccagagagaacaaggcactcactgcccacggtttctcagcaaggcagtggcagggctgagagtgatggctgaggctgtggccaccccgcctggagcagggtgatggacaggctggactcagaggacccaggaatccttctggtttctggggcagaccccagtgacaagaatctcctgagaaagagagagagagagagagagagagagagagagagagagagagacagagatcacccaaggcatccagatggacatgcgaggagtgattttagcctcagcgatcgagggaagaatctcctgatgggcgtgaactgatatgtgtgggggtgtccatcatctgggatggagctccagggtggatggacatatctgatctgagtatgggaagttggaagtgaaagagaatgatgggagaaaggaagaggaagtactatttttatcccagacaggggtgcagttggtcctgggtgaggaagcgctgaacttccatctggaaagtcaccattcctgcccctgccaagcgtcacagcaggatgtcctcccctcgcccctggctccctcccgcttcagccctgcctgtgtagggccagttggttttgctgattcctgcttcaaaccccagggaggtggagagagactggggaggcatagttgctacctgctcacctcctcactttttaactctgagccttaatttttttgggaagtcctcactcagccagatttccaggtttcccctgcttcgttggagtttttcttgacacacactttccgcctagtcagctggtcccagcctttctcctgtctacagctccaagtcctgtagcctcttgtgggggctagggaacatggtggctctcctcgcacttcagggagggtcattcaccctggacaggcatgagcagttccttccacccagccctatgctgacagacgaatcagacagggtcccttgctcttgggccccaggaacagaggctcttctcaaagagagaagggccaagtggacaagggccaagaacaggctgagcattggttcagaggaggggagaaggtgtctcttaagatctggaaagcttcctgcaagagtcaagacagttctgagaaggagaaagacccattttcaagagtgcgtaggacatgaagccaaggtcactatccctggattctgttccttgggtaccacgagggcagagacctcagagcaagaccaaaggccagagagcccacaggtgtggtgtggagcagagaatgtgcatttcagagacaggccgacccagtcacaattccgctggaccatttccttgagcaagtggcttcatctctctctctgagcttcagtttacttatctgtaaagaggcaataatcaagctgggcacggtggctcacacctgtaatcccagcactttgggaggctgaggcgggcagatcatttgaggccaggagcttgagaccaggctggccgacatggtgaaaccctgtcttcgttaaaaatgcaaaattagccgagcgtggtggcaggtgcctgtaatcctagctactcagggggctgaggcagaattgcttgaacccgggatgcacaggttgtaatgagcagagatcgagtcattgcactccagcctaggcaacagagcgaaaccccatctcaaacaaaaatgcctcccgggttcaagtgattctcctgcctcagcctcccaagtgctaggattaacaggcgcgccaccatgcccagctaatttttgcatttttagtagagatggagtttcactatattggccaggatggtttcgatctcctgacctcgtgatccgcccacctcggccccccaaagtgctgggattacaggcatgagccaccgcacctggccagcacatagtaggtgtttaagggaggtggggcactccctccccctgcaaatgatgcaccaaagggagggctgtccacacccaaattatgcccactcagcaccttggtgggccagtgaaccacccattccctcacacttgtggtgtggctttgcaaatcagcctgtttcctgtatacagtgtgaggagtgtgagaactcaggcaggctggactctgagcggggccatgggatctactttagaagagggtctctcacgcagccacacacagacacacacacacacacacacacacaagccaaaacaccatacatatcatgggaaaatctacgtgtacagatgtgttcagaggcagggcaggggctacacataaaacacagactacatcctataactccatgcacacacccacgagctgatggcttcaaggccaagctcaattcagtgaaagtaattctcagtggggtggggtggggtaggtggtgaggagcaggtgggaccaaggtaccatccagtaatggggcctctcacaatcaacctcagtgttgattttaaagtatctggagctaggggtttgaggctgcagtgagctgtgatcgctccactgcactctggcctgggtgacacagctagattctgtctctaaaaaataaacacggcagagtgcagtggctcacgcctgtaatcccagcactttgggaggccaaagcaggtggatcacctgaggtcaggagttcgaaaccagcctggccatcatggtgaatccccatctccactaaaaatacaaaaaattagccaggcatggtggtgcatgtctgtaaacctccacctcccaggttccagtgattctcctgccttagcctccccagtaactgggattacaggcgtgtgccaccatgtctggctaagttttgtggggtttttttggtttgtttgttttttgtttttttgagacagagttttactcttgttgcccaggatggagtgcagtggtgcgagcttggctcactgcaacctccgtctccctggttcaagtgattctgctgcctcagcctcccgagtagctgggattacaggcatggaccaccacgcccggctaattttgtgtttttagtagagatggggtttctccatgttggtcaggctgatcttgaactcccgatctcaggtgatccgcctgcctcagcctcccaaagtgctgggattacaggcatgagccacctcgcccggctgtttttgtttctaattacaaaattagcacattgctgttttaaaaacactcaaacaggccaggcacagtggctcgcacctgtaatcctagcactttggggggccgtgatgggaggatcacatgggcccaggagtttgagacctgcctgggcaacataggcagaccccatctctatttaattatttaaaaaaaaaataaaatttaaaactcaaacagtaagaggcatataaagaaatacaagaaatgcagcctcctccaatcccacttctgggatatgcccatcgtgaaaaatttggtgtgtgtccttccagattttcccatgtatggctgctgaaaaacatggaggttaagtctagtctctgcaggctggcagaccgggactcacttcacaactccactgctcatttgtttgttatgaggcctcagacaaatcattttacctggtttgggcctcagtctttgcatctgtaaaatggggataataatagcacttcataggattattatgagaattacatgaaataatgcaaataaaggcttagcacagagcttatttaaaagaatcccctgtatacatatgtcaatgcaaataggcatatactctgcattctgttctgcaacttgcttgccatggtgtatgcgggatgtctttccgtgtcaatacatgtcaatacaaaatacctcatccttttaactgtttcactaaacgttagcttggtaaatggttaacggtggtgattttgaaatgttacttcctggcaagtgttgctgtcatgtgcggccatgttgtcggcagtcacagatattattgatcagtgagctaactacaagccttatagcctcctgtgaaaatgaagtgacccaccagaggggcacccacctctgtcacagagggcagggccaaatgcatgggacgctctctgtctgcttacttctgcatcctcagctctaggtcagaatctggcacataggaggtacccattaaatttattttttttttttttttttttgagacagtgtctcagtctgttgccccggctggggcacatggtgtgatcatagctcactgtaacttcacacacctgggcttgagtggttctcccacctcagcttcctgagtagcctaggactacagatgtgtaccaccatgcccagctaattataaaaaaattcttggccaggcacagtggctcatgcctataatcccaatactttgggaggctgaggcaggaagatctcttgagactaggcattcaagactagcctgggcaacatagcaacaccccgtctctattaaaacataataataacaatacaatttatttatttatttatttagttatttatagatggagtcttgctctgtcacccaggctggagtgcagtggcactatctcagctcactgcaacctctgtctccgggttcaagcaattctcctgcctcagcttcccaagtagctgggactataggcacatgccaccaagcccggctaacttttgtatttttagtagaaatggggtttctactaaactcccaacactttgggagggtgaggtgggtgcatcatctgaggtcaggagtttgaaaccagcctggccaacatggtgaaaccctgtctctactaaaaatacaacaaattagccaggcgtggtggcaggcgcctgtaatcccagttacttgggaggctgagacaggagaattgcttgaactcgggaagtggaggttgcagtgaaccgagatcgtgccattgcactccagcctgggcaacaagagcaaaactctgtcttaaaaaaaaaaagtgtgtggagataagatctcactattttgcccaagctgcactcacactatgtatggtctcaagcaatcgtcctacctcacccattacatttttgtcaataggccagctcctttaatccacaagcagcagcctaagcccaaagttctctcttgcagtgtggcatttcctaaaatatgacctgtacaccactcaggtgtgtaagtgattttaggggataatggatgaccatttacgaatgttaatttatgtgtttattttagtgtgcgctgttgtttcacttctatttatgtctcatgattctggttttccatttatggtagtaaagtttccattttaggtacatatatcaaacgtgaaaaggtagcccgtggaagtgccaaaaatcatgaaggaaaatgaaaatgatcaatcattttagcctgaaagatgtttaaggccagtgtctatgtagcaagcactatgttaagcattttattatatgagatcatctatatatcacgtataatgctcaccacagccagccttagatgcaagtcttatttttgtcatcattttgctgatgaaggaactgagggaagtgcagaggtttagtaagctgcccaacaaccttctgccagtaagtcttgttttttttttttttgttttttttgtttttttgagacaaggtcttgctctgtcgcctaggctggagcgtagtggcccaatcttggctaactgtagccttgacctccccaatctcaggtgatcctctcacctcagcctcccaagtagctgggaccacaagcatgggacacaaagtccggctaatttttgtattttttttgtaccgacggggttttgccatgttgcccaggctggtctcaaactcctgggctcacgtatctgtctgcccaccttagcctcccaaagtgctgggattataggtgtgaaccaccacgcctggtgcccttctgccagcaagtgattgggagaacctggattgaatttgggttgccatggcatggacatggtgaactgagcttccagagctgccagactcccagaaacgtttataaagcagtgtggattgccaagctgtaagtaaggctccatcctaataaaactgtccatgatacaaaaagcacaccaaagtacccaagggagcggactcagtaaaagggattatcaggtatattcacgttactggttgggggacttctactaaaataccaattagaataattgctctatatcccttatttatagcgatacttgactagcagaatcagttctatgttcaagacactcccaatttgtgaaaataaatccattttgtttgcatccaaaataatgcttttttttttgttctctctgtgtcgagaggctacagagttcattcaaaaaaggtattaagccaggtgtggtggcttgcacctataatcacagcattttgggaggccaaagcaaggggactgcttgagcccaggagctcaagaccagcctggggaacataggcagaccccgtctctacaaaaaataaaaaaattaactgggcttggtggtgtgtacctgtggtcccagctactcaggaggctgaggtgggaggatcacttgagcccaggtggttgaggctgcagtgagccatgatcatgccaccgcactccagcctgggcaacagagtgagatcccatctctaaaggaaaaaaaaaaaaaagagagagagcggaattaaagccaggtgcagtggctcctgcctgtaatcccagctattcgggaggctgaggtgggaggattacttgaggccagaagtttcaggttgcagtgagctacaatcatgtgctgtactactccagcctgggtgacagagtgagatgtgagactccatctctttaaaaaaaaaaaaaaaaaccaggctgggcgcagtggctcacacctgtaatcccagcactttgggaggcggaggcaggtggatcacaacatcagaagttcgagaccagcctgaccaacatagtgaaactaaaattagtttctactaaaaaacacgtctctactaaaaatacaaaaaattagctaggcatggtggcgggtgcctgtaatcccagctactcgggaggctgaggcaggagaatcgcttgaacctgggaggtggaggttgcagtgagctgagatcacgtcactgcactccagcctgggcaacagtgcgagactccgtctcaaaaaaaaaaaaaaaaaaaacccagcctgtgtgacgtggtgagaccctgtccctactaaaaatacaaaaattatccaggcgtggtgttgcccacccatagtgccagctactcaggaggctgaggtaggaggatcacctgagctatgggaggtcgaggctgcagtgagccatgattgtgtcactgcactccagtctgggccacagagtgagataccatctcaaaaaaaaaaaaagtattatgtatttaaacaaatatgaaaaaggaggtagcccaggacacatccctgatttacccactagaaattaattactgacggggcacggtagcccatgcctgtaatcccagcactttaaggggctgaggcagtggattgcttaagctcaggagtttgagactagcctgagcaacatggcaaaaccctgtctctacaaaaattaaaaaaatacaaaaattacccgggccctctcattcacagcttctcaggtaaaaaaaaaaaaagaaaaagaaaaagaaaaaaaaaatagctggaggctgggtgcggtggctcatgccacacctgtaatcccacactttgggaggccaatgcaggcagatcacttgaggccaagagttctagactaccctggccaacatggtgaaaccccatctctactaaaaatacaaacattagccaggtgtggtggcacacgcctgtagtcccagctcctcgggaggctgaggtaggataattgcttgaacctgggaggcagaggttgcagtgagccgagattgcaccactgcactccagcctgggcgatagagtgagacttcatctaaaaaaataaaaataataataataataataatgataataataatagccaggcgtggtggcacatgcctgttgtcccagttactcaggaggctgaggtgggaggattgcttgagcccgggaggtcgaggcttcagtgagctgtgattttgccactgcactccagtggcacaagagagcaagagagcaagagggcaagaccctgtctcaaaataaaataaaataaagaaagaaattatttgccatgcctgctagccctgattcttgatattgcttgatattgtcatgagggttctatgtgggcatgaatagctaaggctctttattgaacatgggcagctttgtcattaatcaagtctgggtcggggcaaaggcgaagaaaatgttttaaatgattcatttttttttaattttatttttatttttattttattttattttatttttgagacagagtcttgctctgtcgccacgctggagtgcagtcccgggtttaagcaattctcctgcctcagccttccgagtagctgggactacaggtgtgcaccaccacgttcagctaattttttgtatttttagtagagatgaggtttcgccatgttggccagaatggtctcgatctcttgacctcatgatccacccacctcagcctcccaaagtgttggggttacaggtgtgaaccactgcgcctggccttttatttttatttttacagagacaaagtctcactatgttgcccaggctggtcttgaacttctgagctcaagtgattttcccatctcggccctaggattacaggcgtgagcctccagccctggctattctaaatgatttctgacagattttgccatgaggtggtccagagtacaacaatggtctgcagtagaatagtctgcttgttcttttttcttttttactttttgtgctctacatgttcagagaaactgaactaaagaaatgatccctaaaggaagtatagtcttgtctgctgttttttgtgttgctttgtttgttttgttttgtttgagagaggttcttgctctttcccccaggctagagtacagtggtatgatattggctcactgcaacctcaacctcctgggctcagcgatcctcctaccttaacctcctgagtagctaggactacaggcgtgcaccaccacacctggttaatttttgtattttttgtagagatgagttctcaccatgttgcccaggttggtcttgaactcctggcctcgagtgatccttccactttggccttccaaaatgttgagattactggcgtgagccattgcatccgaccacctgcctgttcttgatgtaaagcattggcccaagaaactcagccacgaagctggcacacattttggacaaaatgttcaataaatcaataggtctatagttggaggagaaaaaatgttaacttaaaaattttttttaatttaatttaattaattttttctttttttgagacagggtcccctgtcgcccagactggtgtgcagtggtataatcacggctcactgcagccttgacttcctgggctcagtgatcctcccacttcagcctcctgggtagctaggactacaggcaaatgccatcacgccatcatgcttggctaatttttttttttttttttttttttttgagacagagtctcactccatggaccaggctggagtgcagtggcgtgatgtccactcactgcaacctccgcttccccagttcaagagattctcctgctggccgggcatggtggtggctcaagcctgtaatcccagcactttgggaggccgaggtgggcggatcacgaagtcaggagttcaagaccagcctagccaacatagtgaaaccccgtctctactaaaaatacaaaaattagctgggcctggtggaacgtgactgtaatcccagctacttgggaggctgaggcaggataatcacttgaacctgggagttggaggttgcagtgagccgagatcgtgccactgctccctagcctgggcgacacagtgagactctgtcctctgtctcaaaaaaaaaaaaaaaaaaagggccaggtgtggtggcttacacctgtaatctcagcactttggaggccgaggtgggcagatcatgaggtcaggagtttaagaccagcctgaccaacatggtgaaaccccgtctctactaaaaatacaaaaattagccgggcatactaggcgcatgcctccaatcccagctactccggaggctgaggcaggagaatcgcttgaacctgggaggcagaggttgcagtgaaccgagatcacaccattgcactccagcctgggcaacagaactagactctgtcagaaaaaaaaaaaaaaaaaaaaaaagagattctcctgcctcagcctcccaagtagctcaagtagctgggactacagtcacgtgccaccacacccagataatctttgtatttttagtagagatggggtttcaccatgttggccaggctggtctcaaaatccagacctcaagtgattcacctgcctcggcctcccaaagtgctggggttacaggtgtgagccacggcccccggtagccggacgccggccactaattatatagctgagcatggtcgggtgccgtggctcacacctgtaatcccagcactttgggaagccgaggcaggtgaatcacttgaggactggattttgagaccagcctggccaacatggtgaaaccccatctctgctaaaaatacaaaaatcagctgggtgtggtggtgcgtgcctataatcccagctacttgggaggctgtggcaggagaatctctttttcttttcttttttttttttttgatggagtctagttctgtcacccaggcttgagtgcaatggcgcgatctcggctcactgcaacctctgtctcctgggttcaagcgattctcctgcctcagcctcctgagtagctgggattacaagcatgcgcctagtacacctggctaatttttgtatttttagtagagacggggtttcaccatgttggtcaggctgctctcgaactcctgggctcaaggagtcctactgcctcagcctcccaaagtgctgggattacaggcgtgagtcaccatgcccagactccttctggtcttagtttgataaagattgctgagtagccaacatgatctaaccaggttaataaatgaggtcagtaaaaagaaaatcaaaattaaagcttaatataaatttctcattgtctgaaagaaagaagtggaggaagggagaaaaaaaaaaaaaaaaaaacagatgaaaggaatccccagggctcccagaaccagcaatgagggcagattctggggtgaatgaaacaggacattcttttctcccaatttaggaatccaaggtcacgagtaagaatttcatagattcgaggctgcctctgactagggcatgtaatgttctcagtcaaacttaaggctgcccgtggtccacagaacattttgtgatgattataaaaaggccacaggccaggtctggtgactcatgcctgtcatcccagcactttgggaagcggaggtgggcaggccacttgaggttgggagttcgagaccaacctggccaacatggtgaaaccctgtctctactaaaaataataaaaattagcgggcatggtggtgcatgcctgtaatctcagctacttgggaggctcaaacaggagaaattgcttgaacccaggatgtggaggttgcagtcagctgcgattgtgccactgcactccagcctgggggacagaggaagactccgtctcaaaataaataaaataaataaataaataaataaataaataaataaataaataaataaaaattagactgggcatggtggcccatgcctgccatcccaacactttcggagtctgaggtgggaggactgcttgagcccatgagtttgagaccagcctgggcaacatggtgaaaccttgtcactgcaaaaaagtaaaaataaaaggctgggcatggtggcttatgcctgtaatcccagcactttgggaggccaaggtggcaggttagtaatcccagcactttgggaggccaaggtggcaggttacttgagcccaggagttcaagaccagactggccaacatggtgaaaccccatcattacaaaaaacacaaaaattagtcaggcttggtggcatgggcctgcagtccccactactcaggaggctgaggtaagaggatcccttgagcacaggaggcaggagtttgcagtgagctgagacagtgccactgcactgcactccagcctgtgcgacagagcaagaccctgtttaaaaaaaaaaaaagaagaagaccggaaggatggggtatacccacattttgtataaacagatgtatgcctatatgacttcacaattacatagggacggtcgctgctattcatagtctcattctgttatatatccctctgcacacacagactcctgcaaacccacagatatgcacccataagcacagggctcactgcatatgttttcatatgcacagacttgcattcaacaggcaggtaaatatatacccagaaacgtgcattccaggtagaggggggattgtcttgaagagaaaagcctttgttaacagcacagtggtcaaatttttgatgggaaatggaccctaccctgtcagacctgccttcctgcctcacattctcctagacctctcagccctccccctccacccttagactttccagggagtgaaaagtagaggagaggatcttgataaaggatgtaggagccaagccaggcatatgccagcaatcccagctatttgggaggctgaggtgggagaagcgcttgagcccaggagttagagaccagcctgggcaacgtagtgagacctcgtctaaaaaaaaaaggatgtaaggttttgatatgagttttgcatctgccaggaaccctcagtgtattattgggacaatcactgaacctctccttttccccagttttaaaatgaggctgatgaactgtatttgtgtttcctaaactcttgtgaagacaaagtgtcttttaccattccctgttctacactccctcttccccacatggatctcatgattttaaagtttttacctactaagctacctcatttagatgcaaattttcttattttcaagttaaaaaaatttttcttttaatagagaaagggtctcaccacgttgcccaggctggtctcaaactccggggctcaatcgatcctctctcctcagcctcccaaagtgctgggattacaggtgtgagtcactgcacctggcctcaagtttacattttaatcaaagatttggctgggcacagtggctctcgcttgtaatctcagcactttgggaggccgaggcaggtggatcacctgaggtcaggagttcaagaccagcttgggcaacatggtgaaacctcatctctactaaaaatagagagattagctgggcgtggcggcacgtgcctgtaatcccagctgctcgggaggctgaggcacggaggttgcagtgagccaagattgcgccactgcactccagcctgggtgacagagtgagactttgtctcaaaaaaaaaaaaaaatgtaatcagcgatttaattaagtatgcaatgaagaaataaataatacaatttgtcaaaacaagaaacaaagtatagtggaatttcctttcagatttttgaaatattaaaataacctaaaggcctccccggcactagcctgggacttcctgggagcatgtaaacttcaggctgggagcctctgactacaaacatttctggcattgccagatcctatggacttacgattgctgccaggccctatcctccaaagctcacatgcttatagagggcaggaactgccacctgtagctggggggccatagaggaaacagtagaggccagataccctgcaaagctagagttcctctgatcttaatttaacataggctgactttttctcactttttgcccagtcttaagtcggggattttctggcccagattcagtccagaatctaggacctgccttgcatgctttcctggatcctagcccaaggccttgtgattccttttccctccccacctgaccccagcctggaccaggtaccagcttccagccccatgatctccaacctagattccttctgcttcttctactggccttttctcactgttgcaccatagtttatctcttctccttctcctcctccttcttcttcctcttctttttttcctttatatagagactgagtcttgctacgttgcccaggctggtctgaaactcttggcaattctcctgccttggtttcccaaagggattacagacatgagctacagcacccggccttgttttgagacagggtgttgctctcttgctctgttatccaggctggagtgcagtggcgtgttcacggctcactgccgcctcaacctcccaggctcaagtgatcctccccactcagcctcctgagtagctaggactacaggggcgcaccaccatgccctgctaattttcagattttttttgtagagataaggtctcactgtgttacccaggcactggtctctaattcctgggctcaagagatcctcctggccgggcacggtggctcacgcctgtgatcccagaactttgggaggctgaggcgggcaaatcacaaggtcaggagatcaagaccatcctggctaacatggtgaaaccccgtctctactaaaaatacaaaaaaaaaaaaatagccgggcacagtggcgggcgccggtagttccagctactcgggaggctgaggcaggagaagggcgtgaacccaggaggcagagcttgcagtgaatgagtcgtgatcacgccactgcactccagcctgggcaacagagcgagactctgtctcaaaaaaaaaaaaaaaaaagagagatcctcctgcctcagcctccaaaagggctgagattataggcctgagctactacgccctttcttcctcctcctcctcctccgccaccaccacctcctctcctccttcacctcctcctcctcttcctcctccccctcctcatccctctcctccccctccccttccccctcctccccatccccttccccctcctccccctccccttccccctcctccccctcctcttccccctcctcccctccccctccccttccccctcctccccctcctcttccccctcctccccctccccctccccttccccctccctttctttctcctccttcttcttctttcccatctctcccttcctcctatacattccctcttcttaacctcaaacttctacaatctttctcttgcctttttctaaaggctccaagaatgtcaagcctggcagggaccttactggtctaagtccacattccatctgatgttggtattctctttacaacacaaccaacttgtggtttcctaaggctcatacgactatcacaaacaacaggatgctcactacctcacaaaacagctcagcttatctgagaccagttccaggttgctgttagtcctttactgggggctcttgttgctaattactctcaggctataatagtcaaaaagtcatttgcagtcacagatgggtgcactctggtctagcaggatttcccaaatgtccacctccccccaggactcctaacagtaggggaaagagtgaatacgtacccttttcctggaaagtttcttgatttgatttaaaattccatgcacattttgcattttcctccataataggtcatgtttgtttaacttacatgaataaggtcaggaaacactcatgctctggaaaaatgcacaccatgacatgacttccggtacccatgggaggctgagtatctcagtttaagaaacaggagtcgagctgggcacggtggctcacgtctgtagtcccagcactttgggaggtcgaggagggcagatcacctgaagtcaggagttcaagaccagccagaccaacatggtgaaaccctgtctctactaaaaatacaaaattaggccgggcatggtggctcatgcctgtaatcccagcactttgagaggccgaggcgggcagatcacctgaggtcgagagattgagaccagcctgaccaacatggagaaatccagtctcttaaaaaatacagaattagccgggtgtggtggcacacgcctgtaatcccagttacttgggaggctgaggcaggagaatcacttgaacctgggaggtggatattgcagtgagccgagatcacaccattgcactccagcctgggcaacaagagcgaaactctgtctcaaaaaataataataataaggccgggcacagtggctcacgcctgtaatcccagcactttgggaggccgaggcaggaggatcacaaggtgaggagattgagaccatcctggcaaacacgatgaaaccccatctctactaaaaatataaaaaatcagccaggtgtggcggcacgcgcctgtagtcccagctactagggaggctgaggcaggagaatcgcttgaacccaggaggcggaggttgcagtgagctgagatcgcgccactgcactccagcctgggagacagagtgagactctgtctcaaaaaaaataaaaaagaaaaaagtaatgagagaaatgcaaatgcagaaagagaaatgcaaatgcctggcagtatgttgggcttcttttcaaaacttaaaaaaatttattattattattcatttatttatttactttagacaaggggtcttgttctgtcacccaggctggagtgcagtggtgcaatcgtagctcactgtggccttgaactcctgggctcaagtgatcctcctgcctcagcctcccaagcacctgggattataggcatgcaccaccatgcccagctagtttttataataataataataataagaggcttgcttgaggtgatggatagctcatttatcccttttgtgattattacacattgtatgcctctatcaaaatatatcatgtaccccataaacatatatacttaccagatacccataaaagtaaataaataaataagtaaataaataaatatacaaaattagccgggcgtggtggcacatgcctgtaatcccagctacttgggagactgaggtaggagaatcgcttgaacctgggaggcagaggttgcggtgggccgagatcgtgccattgcactccagcttgggcaacaagagcaaaactccgtctcaaaaaaaaaaaaaaaagaaaagaaaagaaacaggagtctagggctgggcacagtggctcattgcctgtaatcccagcactttgggaggctgaggtcaggagttcgagaccagcctggccaacgtggcaaaactctgtctctactaaaaatacaaaacacaaaatacaaaaattagccaggcgtggtggtgcacgcctgtagtcccacctgcttagggaggctgagggaggagagacagagcttgcagtgagcccagatcacaccactgcactccagcctgggcaacagagcaagtctaaaaaaaaaaaaaaaaggaaagagagaaaagaaacaggagtctaggctgggcatggtggttcacgcctgtaatcccagcactttgggaggctgaggtgggtggatcacttgaggtcaggagttcaagaccaccctggccaacatggtgaaacccccatctctactaaaattacaaaaattagctgggcgtggtgacacatgcctgtagtcctagctagtcagggggctgaggcaggagaatcacttgaacctgggaggtggaggttccagtgagccaagttcacaccactgaactccagcctaggtgacagagtgagattctgtctgtttttttttcttttgagatggtatcttgctctgtcacctaggctagagtgcaatggcgtggtctcagctcactgcaacctccacctccatggttcaagcaattctcctgcctcagcctcccaagaagctgggattacaggcgcgcaccaccacgcccagctaatttttgtatttttagtagagacagggtttcaccatgttggccaggcttgtctcgaactcctgaccatgtgatttgccctcctcagcctcccaaagtgctgggattacaggcatgagccaccgcgcccagccgagactctattaaaaaaagaaaaaagaaagaaacaggagtctaaagcaaaggagattaattacccagtcccattcttccaccttccaaagcaggagttggtaggacagaattgtgcactggtgaaagtgtttctaagcactaaactaagctaacattcatgtgagcttatgagaaatggatgaagagccccatttgacagaagaggaaaagtgaggcttaggaggaatgatttcagcaaagtcacacagtaagtgtcaaaattgctatttgaacttaggtctctaactatggggacagtcttctgagttttgctaatgagaaacttccactgctccctgcttccacttagacccagcatgaattctctctctctgtctctcttttgttttttctttttagacagagtctctgtcacccaagttggagtgaacagtgcggtggcagtggcaggatctaggctcactgcaacctccacctcttgagttcaagcaattctccagccaccatgcccagctaactttttttttttttttttttttgtatttttagtagagacagggtttcaccattgttggccaggctggttgtcttgaacttctgaccccaggtgatccacccaccttggcctcccaaagtgctgggattacaagcatgagccaccgtgcccagcctgctcttttgagatggagtctcgctctgtcatccaggctggagtgcagtggcttgatctcggctcactgcaacctctgcctcccgggttcaagtgattctcctgcctcagcctcctgagtagctgggattacaggcgtgtgccaccatgcctggctaatttttgtatttttagtagacacggggtttcaccatgttggtcaggctggtcttgaacacctgacctcgtgatccacccgcctcagcctcccaaagtgctgggattacaggaatgagccatcgtgcccggacttttttttttttttttttttttttttgagacggacggaatctcactctgttgccaggctggagtgcaatggcgcaattccggctcactgcaacctctacctcctgggtttaagcgattctcctgcctcagcctcctgagtagctgagattacaggcacctgccaccaagcccgattaatttttggatttttagtagaggcagggttgcaccatgttggccaggatggtctcgatcccttaatcttgtgacccacccgccttggcctcccaaagtgctgggattacaggtgtgagccaccgcgcctggcctttttttttttttttttgagacaggctctcgctctgttatccaggctggagtgcagtggcacaatcgtagctcattgcagccttgagctcctgggctcaagtgatctttttgcctcagcctcccaagtagctggaactacaggcatgccccatcacacctggctaattttttgattttttttctagagatgaggtctcactatgttgcccaggctagtctggaacttctgagtttgaatggtcttactgcctcagtctcccaaagtgccgcgattacagatgtgagccaccacgcccggccagcaactccagctttgctctactccaaataggttgtgtgactttaagcatacctctgtgggcctcagtttgctcatctaaaatcagaggtttagccaggtatggcagctcatgcctgtaatcccagcactttgggaggccaagaaggaaggatcacttgaagccaagaatttgagaccagtccgggcaacatagcaatacccccatctctagaacaaataaaaaatcacctgggctcagtggtgccagctacccaggaggctgaagttagaggatcacttgagcccaggagtttgaggttccagtgagttaggattgggtcattgcactgcagtctgggcaagagagtgacactttatctcaaaaataaatcaacaaataataaaattggagattaggcttgctggtttctaagacctttgcagatgggagactctatgcattaacactgcatgttccagttgacatttattaactaattttgggtgctggtggctttcagacaaataaactacagcttctgctcttgatgaacccccactctcatcaaaggtatgggagaggcagtgggaccctggggctgacatgtaaatcagtaatcatggaactctgtgtctaagttgattattgaggtctgaatagaatgttgcaggagactggggtgagagggaagcaaagagcattgggaagtcttcagactaggtgatatttaggccaggtgcctgtaatccgagcactttgggaggctgaggcaggagaattgcttgaggccaggagttcgagaccagcctggccaacatggtgaaaccctgtctctactaaaaatacaaaagttagccaagcgtgatggtgcatgcctgtaatcccaactactcaggaggccgaggcaggagaattgcttgaacctgggaggtagaggttgcaggaaaaaaaaaaaaggtaatatttcagctgagccttgaaggttgagttagaattcagcagttggacaaaagagagcatgccgactgggttcggtggtgcatgcctataatcctagcatttggggaggccaaggcaggaggattgcttgagcccaggagttcgagatcagactgggcaacatagtgagacctcatctctacaaaaaaataatcagctgggcatgatggtgtgcacctttagtctcagctactggggaggttgaggtgggaagattgcttgagcccaggaggtctaaggggattgcgccactgcacttcagcctgggagaggaagggagaccctgtctcaagagagagagagaaagagagagagagagagaaagagagagagagagagaaagagagagagagagagagagagagagcgagagagcgcacgcatttcaaagcagggagaaccacaagtacaaaggcattaagtaagaaaatagcatggggtgtttgggaaaggcaagaatagttcagaacacaggctgtgtgtgtgggggtgtgtgggggtgcctgtgtgtgggtgtttgtgtgtgtgtgagtgtgggtgtgtgggggtatctatggaggggatgcctgtgtgtgtgtgtaaggtgagtgtgtggatgtgtgcatgggtgtgggtgagtgtgtggaggtgcctgtgtgtgtgtatgaatgtgtgttggggaggggagaatgtgtgtgtgtggggtgagtgcgtgtgtgtgggggtgaatgcgtgtgtgtgtgtatgtgggtgtgactgtgtgggtgtgtggacgagtgtgtgtgttcctgggtgtgggagcctgtgtgtgtagggggagtatgtatagggtgtgtgcatgaatgtgtgtgtgggtacgtgtgtgagagtgggtgcctgtgtgtggggggtgagtgtgtgtgtgggggggcacttgtggagggtgagtgtatgtgtttactgagtgtgagtgtgggtgcctgtgtgtgggagggtgagtctgtgtgtgagtgtgtgggggagtacctgtgaggggtgagtgtgtgtgtttatgtgaaagtgtgtgtgtgtggatgcctctgtggaggtgggatagggggtgcctctgtgtgtgtgtgtgagagtgtgtgtgtgtagggtgtgtatatgtatagggtgtgtgtgagtgtgtgtgtgtgagagagtgtgtgtgtggcagaatagactgcggaggtggatttcatcttgatatgaaaggtctggaatgcatggtacattaaactttgaggacagcgctttccaagcactctgaggagcagccctagagaaggaggagctgcagggactccgggggcttcaaagtgagggccccactctgcttcaggcaaaacaggcacacatttatcactttatctatggagttctgcttgatttcatcagacaaaaaatttccactgctaaaacaggcaaataaacaaaaaaaaagttatggccaacagagtcactggagggttttctgctggggagaagcaagcccgtgtttgaaggaaccctgtgagatgactgtgggctgtgtgaggggaacagcgggggcttgatggtggacttcgggagcagaagcctctttctcagcctcctcagctagacaggggaattataataggaggtgtggcgtgcacacctctccagtaggggagggtctgataagtcaggtctctcccaggcttgggaaagtgtgtgtcatctctaggaggtggtcctcccaacacagggtactggcagagggagagggagggggcagaggcaggaagtgggtaactagactaacaaaggtgcctgtggcggtttgcccatcccaggtgggagggtggggctagggctcaggggccgtgtgtgaatttacttgtagcctgagggctcagagggagcaccggtttggagctgggaccccctattttagcttttctgtggctggtgaatggggatcccaggatctcacaatctcaggtacttttggaactttccagggcaaggccccattatatctgatgttgggggagcagatcttgggggagccccttcagccccctcttccattccctcagggaccatgggctgtggctgcagctcacacccggaagatgactggatggaaaacatcgatgtgtgtgagaactgccattatcccatagtcccactggatggcaagggcacggtaagaggcgagacaggggccttggtgagggagttgggtagagaatgcaacccaggagaaagaaatgaccagcactacaggcccttgaaagaatagagtggccctctcccctgaaatacagaaaggaaaagaggcccagagaggggaagggaatctcctaagatcacacagaaagtagttggtaaactcagggataacatctaaccaggctggagaggctgagagcagagcaggggggaagggggccagggtctgacccaatcttctgctttctgaccccaccctcatcccccactccacagctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagtgagtccctctccaccttgctctggcggagtccgtgagggagcggcgatctccgcgacccgcagccctcctgcggcccttgaccagctcggggtggccgcccttgggacaaaattcgaggctcagtattgctgagccagggttgggggaggctggcttaaggggtggaggggtctttgagggagggtctcaggtcgacggctgagcgagccacactgacccacctccgtggcgcaggagcggcgagtggtggaaggcgcagtccctgaccacgggccaggaaggcttcatccccttcaattttgtggccaaagcgaacagcctggagcccgaaccgtaagtggggacccgtcgtgggggtgggtaggagcagatctagggatcctggagcagggagtaggcctggggtggcggtgaaggcttgagggccacggaggaagatccgacgacagccgacggccttcgttcgcttccgccctgcacagctggttcttcaagaacctgagccgcaaggacgcggagcggcagctcctggcgcccgggaacactcacggctccttcctcatccgggagagcgagagcaccgcgggtgagcgggcggcggtctcgaccgggcgcgggggtgccccggggtgtgcccgagggggggcgcagggtgagcccgaggtggagacacggggtgagtcggagggggacgcgggatgagcccgaggtgggggcgcgggatgacccggagttgggggtgctgggtgagcccaaggtgggggcgcggtggcgggccagactcactgcgttctttcgtcgctttgtccatccattcattcattcaggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccagtgagcccgacgggacccctcccccgtgccctatcagcctatctcccctcagtccccctcaggtgtcccccatccatctttcaatgccctactccattccccgcagtgggtgaggtgtggaacctgaccctacggccccaagtgtttgggtgacagccccacacccccttgctagtccacttcacctagatgggggcttggagaagtgggggaggtggtgtcaatacgaggcctgccctattgacagccttcacccctccctcgtcctcgcagatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatgggtgagtgtggcctccaggactgcctgggaagaggggaacgggaggggccgctgaggtgatgagagtcccaggacagctgcctggcgactttcccactccttcccttccccgacccagggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatggtgggtgctacccgagtcggctaccaggggatactgctctccctgctgtccctgccagagggtggaaatacaccttttcttctggcccaaagctcaagcaaggagggtttcttgagctttcctgccccctggagactcacctccagccgggcgcggtggctcaggcctgtaatcccagcactttgggagccgaggcgggcagatcacgaggtcaggagttcgagaccagcctgaccaatatggtgaaactctgtctctactaaaaatacaaaaagtagccaggtgtggtggcacatgcctgtaatcccagctactcagaagactgaggcaggagaatccctttaatccgggaggtggaggctacagttgcagtgagctgagatcatgccactgaactccagcctgggtgacagagcaagactctatcaaaaaaaaaaaaaaaaaaaagactcacctccaggcatgagaaaaaggtgtatcctctgatctgatcctgtctgggggcaagcctaaggtggcaagaatgttctggaagagcattcaccccaaccttccctgacctgccattctgtttgccttcttcaaagccctaccttgatctcaggatgcttgatctcagaaagcaagtgggtccctagccctgtttctctcccttctgcccctgagccctaggagggcagatctgcccccaaagccctctttttcagttctgagtgagacccccacccctgcacccctcttggtctgttactggacagagtgagagccccaggaagaggaatatgagtttctagcttcagctttgttcacaccgatttgccgtgtgacaggccaagtgcctgcactgtctctggtgctcagtttccccaagtataacagcagaaatctaaatgggctcaccagaaataatacagagtattcatcaaggcctctagagtctgactgcctgggtcagaagcctggcttcatgattttatggctttgtgataattatatcacctctttctgccatggtttcctactataataacgcgttagtaacttcctcacagggtcttgtgaggatgaaataattaatgcatacagagcagttagaactatgcctacttccaggtgctgtggctcaagcctataactccagcactttgggaggccaaggtgggtggatcacttgagcccagaagttcaagaccagtctgtgcaacatagcgagacttcattcctacaaaaaaatgtttaaaaattagctgggcatagtggtgtatgcctgtagtcccagctacttgggaggctgaggtgggaggatcacttgagcccaggaggttgaggctgcactgagctgtgattgcaccactgcactccaacctgggtaacagagcgagaccttgtctcaaaacaaaaaacccacaaaactatggctaccatatagtaactgatcaataagtttgttgctgttatctggctctgattctttgggagtgtaagatctatccttttttcaggaagagaaacaagctgttcattggctaatgggaaatggcaaatagattatgtcatgtgtatcttttttttttttgagtctcactctgtcctccaggctggagtgcagtggcatgatctcggctcacttcagcctccccctcctgggttcaaatgattctcatgcctcagtctcccaagtagctgggactacaagcatgtgccaccatgcctggctaatttttgtatttttagtagagacaggttttcgccttgttggctaggctggtctcgatctcctgtcctcaggtgatcctcccgccttggcctcccaaagtgctgggattacagatgtgagccaccatgcccagcctatcatgtgtatcgactttgattggtagttgcttgtagtgctggagaaggattctgaggttcattggaagtgagtgccaggaatgattagtaacatctgccatggatacaatggaagaatggcagtatatctatgtctatgtatttgctgtgtgtaggtgaggtctttgtctttggtaactagttcagcactcaaagtggggacactcaggttgctgtcatccttttacagggttttaatctcttgggaagggccattggtcactcactgcatcctagcaactcccatccatgtccagctgccctccactattagagaggtggtccctcagacccccagaccccctctttcttattccatccaatatattcagcacatagttattgtttcttactctcggctgggcaccaggaacatggatggatgaaacaaggttcctgttgtcagggaaacctgattttagttacagctactggggaaaccagagtttgtgccatgggaaagttccagcatgcccatgggagtgtagatgatgatccagtttattatgcctggtaggatctagagaggcttcctagtggggcagtctagcagggccacgaaagaaaagtagaattttttttagcaggcagagatgaaacaaagaggctttggggtgagagcctagtggtctgagtgcaggatctcaaaattgctaaactgtttgaagtcaaaggcagagtgggggaaagagaagaagctaccagtgtggaccatgccaagcttaggatactagttgaggattctaggttctaccttattggtgatgaaaaacctacagatccctcccagcatgctctaccctagcccctctgcaaaaaaacctttacatatcctgggcatccttaccctgaacacacactcctccattctcactcttcaatcttccttttcacatgtcagacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaagtaaggagactggggaggggggctgggcaagggaacagaccagtgacgtgaagacatctggctcaggaccgctgatctgtgtttggcctgcagattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggtacgtgtgagatttaagggtggtctgggccctgcagggtctggccaagcagacccaggtgacctcactctgcctcctccttaggggccaagtttcccattaagtggacagcgccagaagccattaactacgggacattcaccatcaagtcagatgtgtggtcttttgggatcctgctgacggaaattgtcacccacggccgcatcccttacccaggttagagccaagggcaggaactgaaagggtgatgggaagggcaagtccatgtcttcccattcaattctttccagtctcagaatctgaaactttgtagctgcatctcctctatcttctcaggggtatgagtccaacgtccccaggcagatgccacatctcccagggctggcttccatctccgtatctctctttaataaccccagctcttttctttttctctttttttctttttcttttttttttttttttttttttttttttttgagacggagtcttgctctgtctcccaggctggggtgcagtggcgccatcttggatcactgcaacctctgcctcctgggttcaagtgattctcctgcctcagcctcccaaatagctaggattacaggtacgtgccaccatgcgcagctaattttttgtatttttagtagagacagggtttcaccatgttagccaggatggcctcaatctcctgacctcgtgattggcctgcctcggcctcccagtgttgggattacaggcgtgagccaccacacccggccccagctcttttctttagttctggcccaggcagcctggtatggtagaagaagatctagctcaggaacaagaggcctaccttttatcagcagatctgccactgttgctaactttctgtttggctttgttcagatcattactgtaactagtgaagctagtcacttcacttctctaagcctcagtttcctgatactaaaaataagagactaggccaggtacagtggcttatgcctataatctcagaactttgggagaccaaggtgggaggactgcttgagcccaggagttcgagaccagcctgggaaactggtcgaaaccccatctctacaaaaacaaaagttagccaggtttggtggcatgtgcctctagtcccagctactcagaaggctgaggtgggaggatcacctgagccagggaggcagaggttgcagtgagccaagaccatgccataacactccagcctagggcaatagaccaagaccctgtctcaaaacaagaaaaagagagactccatctctacaaaaaaaaaaaaacaaacaaacaaaaaaaacatttaaaaattagctgggcatggtggcacacacccgtagtttcagctatttgggaggctgaggtgggaggatcatttgagcccaggaggttgagggtgcagtgagccatgattgttctattgcactccagcctgagcaacagagagagaatttgtctcaaaaaaaaaaaaaaagaaaaagaaaaagaaaaaagaaaaaatgagagaccatttgtgaaagagcctgactcatagtaggttgtcagtatacactgactcctcccaccatctcctggacaaagccctttacccctgaattcagccaagacagggatggaatttttgaaaggaacttgctaagaaactctggggaaaggaaatggagcataaagacaggagtaggggggtcatgcggcacagtggctagatttgtagaagcttcccatatccccagagcaaggtgaacagacctttgctccaaggaaggtaaagacaccttggaaggccggatgcagtggctcacacctgtaataccagcactttgggaggccgaggcgggtggatcacaaggtcaggtgttcgagaccagcctgaccaacatggtgaaaccccgtctctactaaaaaaaatatatataaaaattatctgggcatggtggcacgcgcctgtaaccctagatactcaggaggctgaggcaggagaattgcttgaacccaggaggcagaggttgcagtgagctgagatcatgccaccgcactccagcctgggtgacaaagtgagactctgtttcaaaacaaaaacaaaaacaaccaccttggaaacaggtgaaaagctgaggggcttccctgccctgggcttgccccaaaccagcgtccaggggtagtgctggagctggaaatacagaaatattctccagttatcctgccaggggtcctcactgctccttcccggttcccacagaggcaaacccatagggaatgtatctattagaagaaaataggcagtgaaagcatgatgataaatggcaactgacatatagcattagggtcagggagacaatggggagaaatggggaccttggtaaacttgcagctgctccagcagatggctgcaattaaggcgtgggggacccaaaaaaacagatcttttgtttttttaagagaagcccaaacttggagttttaggaaaatctgttcatttccatttattggcgattgattcaaattgtttaaaagcactctaggggctgggcacggtgactcacacctgtaatcccagcactttgggaagctgaggtgggtggatcacaaggtgaggagtttgagaccagcctggccaacatggtgaaaccctgcctctactaaaaatacaaaaatattagccaggcgtggtgttgggcactggtagtcccagccactcaagaggctggggcaagagaatcacttgaaccctggaggcggaagttgcagtgagccatgatcacgctgttgcactccagcctgggtgacagagtgagagtccatctcaaaaataaatataaataaattaaataaataaattaattaaatgaataaataaataaaaccactctagggccaatccaaagtggatctgtgggctatactcaggctggatttagcctgtgggcttgcacccttaactctggccatgggtgtttagttccgtggcctatgtcctcctatgccccagttttaaaatgtgagagtcccagccaggcgtggtgggtcacgcctgcaacccagcactttgggaggctgagatgagcggatcacgtggtcaggaggtggagaccagcctgaccaacatagtgaaaccccatctctactaaaaatacaaaaattaaccgggtgtggtggcatgcacctgtagtcccagctactcgggaagctgagacaggggaatcatttgaacctgggaggcggaggttgcagtgagccgagactgtaccattgcactccagcctgggcaacagagcgagactctgtctcaaaaaaaaaaaaaaaaaaaaaaaattgtgagagtcccataggcagaggctcccttgtacaagtcctggggaaaaagggtctctgttgaccaggctttagtcccaagctttccaggagcaaaactttgattttgtaaataccctataaggttttggtctttgggaactgcttgtcacaatctttgttcagaagactgaaggagaaaccagacactacatgagcaatttagaaatagggaaggagggagctatgttactgctgtgatcatgtagttctccagagcagctcttcttggggtctacatgccaaaagcctgccagaggggccaggaccagcataaagggagggaaccagcccaaagactatttcatctgggtcatggaggggcctggggaaccttctcaagtccaagcaaggtctgctttgctaggcccagggtccatttggcttcgtgatgcaggatgtcatgtgcctggtcttaaaactggagagacctcaccactgtcttggttgtgggtgcccatcctgccctgggccctgaccatctcatcattcctaccaaataataataatcccaggtgccctttattatttatttatttatgtatttatttcagacagagtctctgtcacccaggctggagtgcagtggcatgatctcagctcactgcaacctctacctcctgggtttaagcgattctcctgcctcagtctctcgggtagctggaattacaggtgtgtgccaccacgcccagctaatttttgtatttttttagtacagacaggtttttactatgttgaccaggctggtttcaaactcctgaccccaggtgatccacccggcttggcctcccaaagtgttgggattacaggcgtgagccaccgcagatggcctcaggtgccctttatgaagcatctccgatccagactttctgtgcctggatagatttgatgctttctgtgatatatatatatatatatatctgtgagatatatatatctgtgagatatatatatatctgtgagagatatatatatgtgagatatatatataataatatatatattatttttatttttaatttttttgagacaagagtctggcttgagttgctcaggctggagtgcagtggcacagtctcagctcactacaacctctgcacctccacctcccaggttcaagcaattactgtgactcagcctcccaaatagctgggactacaggcgcataccaccaagcctggctaatttttgtatttttagtaaagatggggttttgccatgttggtcaggctggtcttgaactcctggcctcaagtgatctgcctgctttggcctcccaccatgctgggattacaggcatgagccaccatgcctggcctgtgcactatatttgatgctttctgtgcacaatctcatttaatcctcataacaattctatgaggtaggaacagttatttactctattttccaaataaggaaactgggctcgcccaaggttccacaactaacatgtgtgtattattgagcatttaatttacaccagggaagcaggttgtggtggtgtgcacctgttgtccagctatttaggaggctgaggtgaaaggatcacttgaacggaggagttcaaatttgcaatgtgctatgattgtgcctgtgaacagctgctgcactccagcctgggcaacatagtgagatcccttatctaaaacattttttttaagtaaataatcaggtgggcacggtggctcacgcctgtaatccagcactttgggaggctgaggcgggcggatcacctgaggtcaggagttcaagaccagcctgaccaacatggagaaacccgtctctactaaaaatacaaaattagcttggcgtggtggtgcatgcctgtaatcccagctactcgagaagctgaggcaggagaattgtttgaacctgggaggtggaggttgcggtgagccgagatcgcaccattgcactccagcctgggcaacaagagtgaaattgcatctcaaaaaaaaagaaaaggaaataatctataccaggcactccaagtggtgtgactgatattcaacaagtacctctagtgtgaccttaccattgatgaagaccaagattcttttggattggtgctcacactgtgccagttaaatattccgaacattacccttgcctgtgggcttccagtgcctgaccttgatgtcctttcacccatcaacccgtagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 1843 - DNA, 12055 bp, Homo sapiens
gtgtgaatttacttgtagcctgagggctcagagggagcaccggtttggagctgggaccccctattttagcttttctgtggctggtgaatggggatcccaggatctcacaatctcaggtacttttggaactttccagggcaaggccccattatatctgatgttgggggagcagatcttgggggagccccttcagccccctcttccattccctcagggaccatgggctgtggctgcagctcacacccggaagatgactggatggaaaacatcgatgtgtgtgagaactgccattatcccatagtcccactggatggcaagggcacggtaagaggcgagacaggggccttggtgagggagttgggtagagaatgcaacccaggagaaagaaatgaccagcactacaggcccttgaaagaatagagtggccctctcccctgaaatacagaaaggaaaagaggcccagagaggggaagggaatctcctaagatcacacagaaagtagttggtaaactcagggataacatctaaccaggctggagaggctgagagcagagcaggggggaagggggccagggtctgacccaatcttctgctttctgaccccaccctcatcccccactccacagctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagtgagtccctctccaccttgctctggcggagtccgtgagggagcggcgatctccgcgacccgcagccctcctgcggcccttgaccagctcggggtggccgcccttgggacaaaattcgaggctcagtattgctgagccagggttgggggaggctggcttaaggggtggaggggtctttgagggagggtctcaggtcgacggctgagcgagccacactgacccacctccgtggcgcaggagcggcgagtggtggaaggcgcagtccctgaccacgggccaggaaggcttcatccccttcaattttgtggccaaagcgaacagcctggagcccgaaccgtaagtggggacccgtcgtgggggtgggtaggagcagatctagggatcctggagcagggagtaggcctggggtggcggtgaaggcttgagggccacggaggaagatccgacgacagccgacggccttcgttcgcttccgccctgcacagctggttcttcaagaacctgagccgcaaggacgcggagcggcagctcctggcgcccgggaacactcacggctccttcctcatccgggagagcgagagcaccgcgggtgagcgggcggcggtctcgaccgggcgcgggggtgccccggggtgtgcccgagggggggcgcagggtgagcccgaggtggagacacggggtgagtcggagggggacgcgggatgagcccgaggtgggggcgcgggatgacccggagttgggggtgctgggtgagcccaaggtgggggcgcggtggcgggccagactcactgcgttctttcgtcgctttgtccatccattcattcattcaggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccagtgagcccgacgggacccctcccccgtgccctatcagcctatctcccctcagtccccctcaggtgtcccccatccatctttcaatgccctactccattccccgcagtgggtgaggtgtggaacctgaccctacggccccaagtgtttgggtgacagccccacacccccttgctagtccacttcacctagatgggggcttggagaagtgggggaggtggtgtcaatacgaggcctgccctattgacagccttcacccctccctcgtcctcgcagatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatgggtgagtgtggcctccaggactgcctgggaagaggggaacgggaggggccgctgaggtgatgagagtcccaggacagctgcctggcgactttcccactccttcccttccccgacccagggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatggtgggtgctacccgagtcggctaccaggggatactgctctccctgctgtccctgccagagggtggaaatacaccttttcttctggcccaaagctcaagcaaggagggtttcttgagctttcctgccccctggagactcacctccagccgggcgcggtggctcaggcctgtaatcccagcactttgggagccgaggcgggcagatcacgaggtcaggagttcgagaccagcctgaccaatatggtgaaactctgtctctactaaaaatacaaaaagtagccaggtgtggtggcacatgcctgtaatcccagctactcagaagactgaggcaggagaatccctttaatccgggaggtggaggctacagttgcagtgagctgagatcatgccactgaactccagcctgggtgacagagcaagactctatcaaaaaaaaaaaaaaaaaaaagactcacctccaggcatgagaaaaaggtgtatcctctgatctgatcctgtctgggggcaagcctaaggtggcaagaatgttctggaagagcattcaccccaaccttccctgacctgccattctgtttgccttcttcaaagccctaccttgatctcaggatgcttgatctcagaaagcaagtgggtccctagccctgtttctctcccttctgcccctgagccctaggagggcagatctgcccccaaagccctctttttcagttctgagtgagacccccacccctgcacccctcttggtctgttactggacagagtgagagccccaggaagaggaatatgagtttctagcttcagctttgttcacaccgatttgccgtgtgacaggccaagtgcctgcactgtctctggtgctcagtttccccaagtataacagcagaaatctaaatgggctcaccagaaataatacagagtattcatcaaggcctctagagtctgactgcctgggtcagaagcctggcttcatgattttatggctttgtgataattatatcacctctttctgccatggtttcctactataataacgcgttagtaacttcctcacagggtcttgtgaggatgaaataattaatgcatacagagcagttagaactatgcctacttccaggtgctgtggctcaagcctataactccagcactttgggaggccaaggtgggtggatcacttgagcccagaagttcaagaccagtctgtgcaacatagcgagacttcattcctacaaaaaaatgtttaaaaattagctgggcatagtggtgtatgcctgtagtcccagctacttgggaggctgaggtgggaggatcacttgagcccaggaggttgaggctgcactgagctgtgattgcaccactgcactccaacctgggtaacagagcgagaccttgtctcaaaacaaaaaacccacaaaactatggctaccatatagtaactgatcaataagtttgttgctgttatctggctctgattctttgggagtgtaagatctatccttttttcaggaagagaaacaagctgttcattggctaatgggaaatggcaaatagattatgtcatgtgtatcttttttttttttgagtctcactctgtcctccaggctggagtgcagtggcatgatctcggctcacttcagcctccccctcctgggttcaaatgattctcatgcctcagtctcccaagtagctgggactacaagcatgtgccaccatgcctggctaatttttgtatttttagtagagacaggttttcgccttgttggctaggctggtctcgatctcctgtcctcaggtgatcctcccgccttggcctcccaaagtgctgggattacagatgtgagccaccatgcccagcctatcatgtgtatcgactttgattggtagttgcttgtagtgctggagaaggattctgaggttcattggaagtgagtgccaggaatgattagtaacatctgccatggatacaatggaagaatggcagtatatctatgtctatgtatttgctgtgtgtaggtgaggtctttgtctttggtaactagttcagcactcaaagtggggacactcaggttgctgtcatccttttacagggttttaatctcttgggaagggccattggtcactcactgcatcctagcaactcccatccatgtccagctgccctccactattagagaggtggtccctcagacccccagaccccctctttcttattccatccaatatattcagcacatagttattgtttcttactctcggctgggcaccaggaacatggatggatgaaacaaggttcctgttgtcagggaaacctgattttagttacagctactggggaaaccagagtttgtgccatgggaaagttccagcatgcccatgggagtgtagatgatgatccagtttattatgcctggtaggatctagagaggcttcctagtggggcagtctagcagggccacgaaagaaaagtagaattttttttagcaggcagagatgaaacaaagaggctttggggtgagagcctagtggtctgagtgcaggatctcaaaattgctaaactgtttgaagtcaaaggcagagtgggggaaagagaagaagctaccagtgtggaccatgccaagcttaggatactagttgaggattctaggttctaccttattggtgatgaaaaacctacagatccctcccagcatgctctaccctagcccctctgcaaaaaaacctttacatatcctgggcatccttaccctgaacacacactcctccattctcactcttcaatcttccttttcacatgtcagacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaagtaaggagactggggaggggggctgggcaagggaacagaccagtgacgtgaagacatctggctcaggaccgctgatctgtgtttggcctgcagattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggtacgtgtgagatttaagggtggtctgggccctgcagggtctggccaagcagacccaggtgacctcactctgcctcctccttaggggccaagtttcccattaagtggacagcgccagaagccattaactacgggacattcaccatcaagtcagatgtgtggtcttttgggatcctgctgacggaaattgtcacccacggccgcatcccttacccaggttagagccaagggcaggaactgaaagggtgatgggaagggcaagtccatgtcttcccattcaattctttccagtctcagaatctgaaactttgtagctgcatctcctctatcttctcaggggtatgagtccaacgtccccaggcagatgccacatctcccagggctggcttccatctccgtatctctctttaataaccccagctcttttctttttctctttttttctttttcttttttttttttttttttttttttttttttgagacggagtcttgctctgtctcccaggctggggtgcagtggcgccatcttggatcactgcaacctctgcctcctgggttcaagtgattctcctgcctcagcctcccaaatagctaggattacaggtacgtgccaccatgcgcagctaattttttgtatttttagtagagacagggtttcaccatgttagccaggatggcctcaatctcctgacctcgtgattggcctgcctcggcctcccagtgttgggattacaggcgtgagccaccacacccggccccagctcttttctttagttctggcccaggcagcctggtatggtagaagaagatctagctcaggaacaagaggcctaccttttatcagcagatctgccactgttgctaactttctgtttggctttgttcagatcattactgtaactagtgaagctagtcacttcacttctctaagcctcagtttcctgatactaaaaataagagactaggccaggtacagtggcttatgcctataatctcagaactttgggagaccaaggtgggaggactgcttgagcccaggagttcgagaccagcctgggaaactggtcgaaaccccatctctacaaaaacaaaagttagccaggtttggtggcatgtgcctctagtcccagctactcagaaggctgaggtgggaggatcacctgagccagggaggcagaggttgcagtgagccaagaccatgccataacactccagcctagggcaatagaccaagaccctgtctcaaaacaagaaaaagagagactccatctctacaaaaaaaaaaaaacaaacaaacaaaaaaaacatttaaaaattagctgggcatggtggcacacacccgtagtttcagctatttgggaggctgaggtgggaggatcatttgagcccaggaggttgagggtgcagtgagccatgattgttctattgcactccagcctgagcaacagagagagaatttgtctcaaaaaaaaaaaaaaagaaaaagaaaaagaaaaaagaaaaaatgagagaccatttgtgaaagagcctgactcatagtaggttgtcagtatacactgactcctcccaccatctcctggacaaagccctttacccctgaattcagccaagacagggatggaatttttgaaaggaacttgctaagaaactctggggaaaggaaatggagcataaagacaggagtaggggggtcatgcggcacagtggctagatttgtagaagcttcccatatccccagagcaaggtgaacagacctttgctccaaggaaggtaaagacaccttggaaggccggatgcagtggctcacacctgtaataccagcactttgggaggccgaggcgggtggatcacaaggtcaggtgttcgagaccagcctgaccaacatggtgaaaccccgtctctactaaaaaaaatatatataaaaattatctgggcatggtggcacgcgcctgtaaccctagatactcaggaggctgaggcaggagaattgcttgaacccaggaggcagaggttgcagtgagctgagatcatgccaccgcactccagcctgggtgacaaagtgagactctgtttcaaaacaaaaacaaaaacaaccaccttggaaacaggtgaaaagctgaggggcttccctgccctgggcttgccccaaaccagcgtccaggggtagtgctggagctggaaatacagaaatattctccagttatcctgccaggggtcctcactgctccttcccggttcccacagaggcaaacccatagggaatgtatctattagaagaaaataggcagtgaaagcatgatgataaatggcaactgacatatagcattagggtcagggagacaatggggagaaatggggaccttggtaaacttgcagctgctccagcagatggctgcaattaaggcgtgggggacccaaaaaaacagatcttttgtttttttaagagaagcccaaacttggagttttaggaaaatctgttcatttccatttattggcgattgattcaaattgtttaaaagcactctaggggctgggcacggtgactcacacctgtaatcccagcactttgggaagctgaggtgggtggatcacaaggtgaggagtttgagaccagcctggccaacatggtgaaaccctgcctctactaaaaatacaaaaatattagccaggcgtggtgttgggcactggtagtcccagccactcaagaggctggggcaagagaatcacttgaaccctggaggcggaagttgcagtgagccatgatcacgctgttgcactccagcctgggtgacagagtgagagtccatctcaaaaataaatataaataaattaaataaataaattaattaaatgaataaataaataaaaccactctagggccaatccaaagtggatctgtgggctatactcaggctggatttagcctgtgggcttgcacccttaactctggccatgggtgtttagttccgtggcctatgtcctcctatgccccagttttaaaatgtgagagtcccagccaggcgtggtgggtcacgcctgcaacccagcactttgggaggctgagatgagcggatcacgtggtcaggaggtggagaccagcctgaccaacatagtgaaaccccatctctactaaaaatacaaaaattaaccgggtgtggtggcatgcacctgtagtcccagctactcgggaagctgagacaggggaatcatttgaacctgggaggcggaggttgcagtgagccgagactgtaccattgcactccagcctgggcaacagagcgagactctgtctcaaaaaaaaaaaaaaaaaaaaaaaattgtgagagtcccataggcagaggctcccttgtacaagtcctggggaaaaagggtctctgttgaccaggctttagtcccaagctttccaggagcaaaactttgattttgtaaataccctataaggttttggtctttgggaactgcttgtcacaatctttgttcagaagactgaaggagaaaccagacactacatgagcaatttagaaatagggaaggagggagctatgttactgctgtgatcatgtagttctccagagcagctcttcttggggtctacatgccaaaagcctgccagaggggccaggaccagcataaagggagggaaccagcccaaagactatttcatctgggtcatggaggggcctggggaaccttctcaagtccaagcaaggtctgctttgctaggcccagggtccatttggcttcgtgatgcaggatgtcatgtgcctggtcttaaaactggagagacctcaccactgtcttggttgtgggtgcccatcctgccctgggccctgaccatctcatcattcctaccaaataataataatcccaggtgccctttattatttatttatttatgtatttatttcagacagagtctctgtcacccaggctggagtgcagtggcatgatctcagctcactgcaacctctacctcctgggtttaagcgattctcctgcctcagtctctcgggtagctggaattacaggtgtgtgccaccacgcccagctaatttttgtatttttttagtacagacaggtttttactatgttgaccaggctggtttcaaactcctgaccccaggtgatccacccggcttggcctcccaaagtgttgggattacaggcgtgagccaccgcagatggcctcaggtgccctttatgaagcatctccgatccagactttctgtgcctggatagatttgatgctttctgtgatatatatatatatatatatctgtgagatatatatatctgtgagatatatatatatctgtgagagatatatatatgtgagatatatatataataatatatatattatttttatttttaatttttttgagacaagagtctggcttgagttgctcaggctggagtgcagtggcacagtctcagctcactacaacctctgcacctccacctcccaggttcaagcaattactgtgactcagcctcccaaatagctgggactacaggcgcataccaccaagcctggctaatttttgtatttttagtaaagatggggttttgccatgttggtcaggctggtcttgaactcctggcctcaagtgatctgcctgctttggcctcccaccatgctgggattacaggcatgagccaccatgcctggcctgtgcactatatttgatgctttctgtgcacaatctcatttaatcctcataacaattctatgaggtaggaacagttatttactctattttccaaataaggaaactgggctcgcccaaggttccacaactaacatgtgtgtattattgagcatttaatttacaccagggaagcaggttgtggtggtgtgcacctgttgtccagctatttaggaggctgaggtgaaaggatcacttgaacggaggagttcaaatttgcaatgtgctatgattgtgcctgtgaacagctgctgcactccagcctgggcaacatagtgagatcccttatctaaaacattttttttaagtaaataatcaggtgggcacggtggctcacgcctgtaatccagcactttgggaggctgaggcgggcggatcacctgaggtcaggagttcaagaccagcctgaccaacatggagaaacccgtctctactaaaaatacaaaattagcttggcgtggtggtgcatgcctgtaatcccagctactcgagaagctgaggcaggagaattgtttgaacctgggaggtggaggttgcggtgagccgagatcgcaccattgcactccagcctgggcaacaagagtgaaattgcatctcaaaaaaaaagaaaaggaaataatctataccaggcactccaagtggtgtgactgatattcaacaagtacctctagtgtgaccttaccattgatgaagaccaagattcttttggattggtgctcacactgtgccagttaaatattccgaacattacccttgcctgtgggcttccagtgcctgaccttgatgtcctttcacccatcaacccgtagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 1844 - DNA, 49735 bp, Homo sapiens
taaagcaaaagactattttaatcccagaagttatctcaacatgcatttgtcttttcataaaaaaattacgtaaaaatgcccccaggaaaaaatactaaataagagtgaaattatatttttgaagcctcttaaattattgctgctgagaaaacgaggtttagtgattttcaaattacatgtataaaactaatgaatgcctctgactgacagaggtttggctgtaaaaaacaaatcagttttatgtgacaccaataactattactgtttcagtgttttaaaacttgccccaaattgtttctgtagctgtgtaaactactgtattttgaaatgggcattaaataatcttttaaaaaatgaattattacagtgcactactagacttcaagtgtgaacatgactcatgcactttacaaacattgaagaagaataaataaattatgggatagttgacagtcttcatttcaaacactgtttttaaaggaaaggataaaacccttgtgttcatggggaggggttcagttcagtcctaagtgtttgtccattgaccaaggctgattgatctcgtgttggcaacagaggcaggaggacggttcatttgctcggctataacttgctatgggtaccctgcagcatgcgttaatgtgcactggtatctggaacctcggtttttcccatcaatgagcagaagtggcattttcctgaagtagtcaataatatctgacacagacagaaagtcctgaaagagtcaagatagggagatgagtcaacattggaatgaaaagcaggaacttcactttcagtttttttatctgcataatatatgctgcctcttcaagtgatgaggattgtggggggaaaaaatgtaaatgtggcaattagtttaatgatttctgctatagaactttgaaaaaattcctcataaacatccaacaaaccatagataaagataaaatatgggccgggtgcagtaattcacccctgtaatcccagcactttgggaggctaaggccggtggatcacctgaggtcaggagtttgagaccagcttgaccaacatggtgaaaccctgtctctactagaaaatagaaaaatattagctgggcgtgctggtgtgcgcctgtaatcccagctgcttgggaggctgaggcaggagaattgcttgaacctgggaggcagaggttgcagtgagccgagattgcgccattgccgcactccagcctgggtaacaagaaggaaactccatctcaaaaaaaaatagataaaatatgtgcatgcgtgtgtatatatatatatatatatctacatatctatatatatatatatgtaatttgaaatgcatatatttttaacttcatatgaaggggtcatttaaatagtcactattacaatattcttgcctcgggttgctctgtttttggttttggttttggtttctgcatctctatttcacccccagtcattaatagtgttaggaaacataaggactcaggaggtcagacacggttcatggtgtctagaggtgggatctgcagcatggcacaggagttccttcatgatctctctgctgtgtcctcactgccaccttcacactcataaaggctcagcaaccaatatttgcagccatagcctggatcgccccagccttgattgcttgctagagagggaaaagcctaactcatttttctagatgtgggtcacaactcacctaggaaccctaacaggataatgcacttcctttaagactaatctgctaggtgcctccctccatgggagctgcaatgagtggttggtctgcacttgtgtgtttccacactggaccaagataaatcttgaagggcaaatacctctgctcctatagggtctgtgcagctctatccactgccaaccagcgattcaaacatttgatcacaagcatgcattttttttctattcattaacattatcataacagaagtatgtgaagcagaagttatgggtaagctgtttctcattctggacatgtttgattcagctggtcctcctcttggaactttgaacttagagtatgtttggggcgttaccttcagttgttagtttcctttgcgaaaaactagccctgagggtttctttccatccgttctgattagcactcaaaaagtgactggcatgagaatctaaaccttggcctaacagagaatttctttggcgatctggccatcctcacagagccaaacctccattttgttaagaaatgagccaagtatttgaataatcaccccagcaaatattctaatttttccccttttccaggtggtgtcaacttaaaatgcagcctacgttaaaattatgccacagaggtgaataatagtgggaactttcctttgacaccatctaaatagatttttttaagttaacatagtttttcttgattttgaaaattatacatgtgattatttgaaagaaaagatatacaagaaagaatcctatggcagaagtaaccattgtaaagattttgctttatttctcttccaataaatgaagggcttcactcatgtgatttaatcctaaatttgccatacagcacggactctcaaagatcgctccatgaaggcatgcagagtggcataaataaagactttgggaaaatgtcgaaatttgaaatccttacctctttccctcggagtccagttcccaacaagtaaacttgactttccttctgataacggatctggatgttgtaaactttatctttgtacaacaccatgaggacatatggattggttgttgtttttttagagctgtctctgaccagaaatgtgccatcctaaaaagacaaattcctgttattatgggagcagtaaaagtcaatatttttgttgcttgtaagagtagtagacaagcctctagggatctgacaaacatgtcagttgcactttgcagcttcttgagtgcaaaacctgtcattcaacgaacattcagttctccaaacagctacatatcccatgtgtcatgagttattttgttattaagaaaggcaacagagattgtatcaaagaaatttccaagtcaatctcgttaaagcctcctgataaaaacggaatcttttgttcagtaataaataatgggtggttgagtggataaaaggccaggagaaataaaatactttattggttaactcaagatatatcttcctagtattcctgtgagttaattccctaaactttcttttccacatccaaagtcagaaaacatccacatgccatgaaattcacccttcttaaaaccctgtgatctctagatagtctttccttcatcagacccttgagcaaaattgaatgcagatgttctcttttcttttcttttttctgatatttgctaaactactgttttgattgtcctgtactttaaatttccattcaataaattattgctacataatattaatactgtaaagatctaatattaaaatagaattaattggtaaggactcctttaaactactcccttctcctcataccaaatcaggatagctttaaatagccatgagttggcaataatgactttcctttgttccttttattgcaagttaattgagcctgtcagaacatctctgctaaacaaacatacttctggaccagtgattcacagtcttggcttcaaattagaattacctgggaagtttgaagactcccagagctgacacagcacccccagaataattagaatctcaaggtgagacccaggaatcgggatttttcaaaagttctccgggtgatctaaatgtgcaactactactgagaactactggtgtggagtttaagtgtgaaagatgaaagatttttgctttcccatttctgataaataaatctaaggtaaagtttcggcactggctacgggaaatatgtttaagactttatgatattaaaggactagctagaaacgtctagggcaaaaagcaaaaagttgctgccatctctttaatattggtcctttcacatcaacatggatggcacgtctgtgttaagaggaagatagaactggtacgatgttggaactttgaaagagagtctccttctgacaccatgtgattcctatgacaagacagactctttcattaataaaatctcctaagatgctgccaaccaaatgactgccttgagattcttctgccagcctaatgattcccgagcctaggaatccctgctatgggtgctggtagttgtgaagctggcactaatgggtctcctaggtattacagaaagcaacagcacctagcagaattcctagcctgtaattggtactcaggacaggtcagttcccttctctgccattaatatttacaactatgttaaaataaactatagcacaatacctggtttatctttctaagagcagcttctgcctctggtcgggtaatataagaaacgtaccactcttcatttaatgaattctgaaaatgtaaatttttagaaactgaataaattttacagttacagatgtaagtgaaaagaaaagcctctgagtaatcatttccataaatcaacacctcaattccaggaggtctgaaacatttgttttcttaatttgcattcagagtcatttagctggggctaaatagaagatattttgtgcgaactgctttttatcatgacactggttgcaaaaatgcctgtgaataagagttccttacagtatggaacctcttcaggaaagatacagatacaataatttcttcagtttagcataataacctgcttgattaaaaaaatgggttattgagcagttaagtgacgaatcaaggtcataaacataaaaaacaggattatttttcttgctgtttaatgcaaaacacatgtttgccattgaaagcgtctgaaagaacgccaagggaaaagaacatattgttcatctggatcttctcctttaacttttttttcaaataaataaaataaaacaaagggaagataaaagtacagaagaacattcaatgggagtttctggtgattcttttaccagggaaaaggcaaacaaacaaaaataaaaacatgctctcttacctcttcctccgcgggggatgggggccgaggtttgtttggaagtggcaaggggaagtttctgccttcggctctgataggtggtctgttgctagggccttcaaaagtatagaattctgacagttaatttactgtaagctattgtttgctgctatcaaaacacaaaacacattccccccactcccccaaaaaaatacccttgcgattggtcctatagttcgcattttaagaaacaagggcttcaaaaataattttcatctgtttgaaaccatgggggctgctcaggcattattctgtaatcatgccagtaaaactttgagaagagaacctcaactttgagtgatttttctaaatgtgcatgttacataatataaagtgactagatccctttataaaaaaattcgcaattgttttaatgaatgtgaacgtcaaaatgaatgctcaagagacaaatttttcatagattcttataatatcatcataggcagaatggattcccaacagctgatgtagggacaatgcaatgatgaagataattatgttcttaatgtttccacaaaaagaaatgtaagtgacccaagagaagacaaaattaccttgagaatattgctagcttttagaatcaaagttggctacccgctgttctaactaaacaggtagactgttcaactcacatagaaggcactacagatcaggaagtttttactgggcaactattaattacccagtgcttgtgcctcatcttctctaaaactcttttttctcatttacagttccttgaaactttaggagaatgtttcctaatctcaggaaaggtttagttgtgtttattgcagttgcccagggtattttctatgtgccaggctgtggttaaaaacagaaaaattctgtgagtcaaatgttctcttaattatttaaccatcattcattcataccttcaacaaatatttattcagcacaactctgtccagatcttgagtaaggtatcgtgtgtacattttttttaatcctcacagcaacattacaaggtaggtattgtcttcattttgcatatggggaaatacaggctcagaggctaagcaaatcatgcgctatcagtggcaaagccaaaacttaaacctgtggttaccaaatgctactgtgcatgagtcagaatccctgggcgacttgcgagcacctggggctcagaaatctgcatgttagcaagtacttccggtggttctacaccacggattgtcactacgtctaccttgttacaccactgaggagaggagagtcacctgtaagggctaaagcctcctgagccgcatcatcaagattatttatgatggtccttccctgtttttaaacaagtctcctgagccacatcaacaggattgtttaagatgctccttccctgtttctaaacaagctggccctgagctgccagtgccttccttctccaagttcccagtgcctagacagatcttccccatccccattttttttgcagtccaacacttgcacttttataatgcttgttgaatgaatgaaacctaacaatacaggagagtaacagaaccaaggcccgcattgcatggccattctacagttaagaaatgattctctttctgcctctgcacctgcaggccagcatcatagagttctaagttacaacagagaagcacatacacttttttattgcagtcacctaccacccttaatatctagactctcaagggagtcatgacaggtttttgggcaatgcacagcacaaactttatccttctgatgttggaacaaccagtagaaccagtagagaagaccgaggaccaggtgtcctggcagtcttaggggaaaagagatcaatttggatcaagctaatgttccaaaaataattaactatttgcattaataagccccatcacagactcataaaactggagatctgtggaacttgctttggaaaataatgctgtgatgtgtctgggactcagatggctacagaggcaaggaggtaacacaaatgtgtgtttgcaaaacacagagaattttggggattgtggaaaattaggggttgggcgagaaactgtgaaaaccatgtggtgaacgtggacaccaccataacctcaaatgcttagaaaacattgaaaacttagtgggtgccactggcgtcagcagtgggatctcgcccctctatggaatgatgcatccaactgaataccctagatgtgttcttggaaaaaatgttgattctcaggctatcaactcacatttactaacatagttttctactgaacacacactggcccgtgcacacactgcatgtggaacatgactgcaaaaaaagtggcttttctgttgtcattcttcacagcattttttaaaaatttaagtcaacatttaaaaattaaataatttcacttttcttgagaaaaaaattggaaaatctggcaatgctaagccagtttcctggaatgctacttactagagttgggtaactttccctagtcatttgatgctcattcgacaagcatttttaaagtgcctaccaagtgcctgtcacttgcaagtctttaaggataaaaagcacaaattagtcctgccccagtgcctttcaaagtggttcatgaaccagcagtcacagcatcgcatggaatatgttagaaattcagaaactcaggcctcaccccagacctcctgaattagaatctgcatgttaacacaattcccaggtgatctatatgcactttcaagttgcagaacactctaagcgaatactaatcatggacgtccagaggtggtattattaaaaacacaggtccctgacttcactccggacttactgaatcagaatctgtgacgttaagttctcttagtttgtattttgaacatgctccccaactcacaaccatggacagattgatcatggaaatctaaaactgcagagaaaggcaaacaggattctgaggattccgtagggaaaccggagctggaggaatagttctgcacaggaagattggggatgagggctggcttcctggtgaagtgtgtgtaggtgtgtccatgtatgtatgtgtgtatgcatgtgcatgtgtgtgcatgtattgtgtatgtgtatatatgtgtatacctgtgtgcacatgtatatatgtgtacatgtgtatgcatgtgtgtgtgtgcatgtatatgtgcatgtgtgtatgggcatgtatatgtatacgtgtgtgtgtatgtgttgtgttttaggtactatcctatcattccgacagcccttggcacactgcagacacggaattaaatgttgaatgaggaaatcagatgcttttaggaaacaataaaacctttgtcgaaagcttttgggacaggttagggatccagtcataaaggcttgatggctgaagcacgtcacaaaagcccagagtacaaaccttgagagaagtatggtggcagggaggcactctgtggaaaactgctgttactgaggagacagaaaaagaacaaaatttatttggattggggtgatggggccagacaggggagctgggttagggaagccaggctgcaaatgcttcttgatttggtatcactttccctgctgcccccaaaaccatgggggctgggcacagggacagaacacagcacacagggaatggaactacattccgctgtggaccatgccaaagtctaacaagctttataaagcagaacagcaacaacattcaactgtgtaaagggcacttaacagttactttaaaaattggctgcaacttgagctctttgagttgggagaatacagaagtcctcttctcagaagacttcccttttgctaggaaattatattaatgggcttgtctttggtgagcagtgaatccccagggcttagggtctgcaaggagagagtaagccaggtgagaagggaagtgcatgttaggtgggctctgcagcagacggtgatagcatttgcagggctggggtggggaggcgggcccagagggccctgaaatgcagtctgttccctccacactgagcagcaactcctgcacccatcagtctaaacctttgggaaaagtctgctctgcacagcaaccttgtgtgagtgggattttgtgcaaatgaaggatggggttggggctagcatggaggaaagcagcaggagggtcagcagacaagggcagcagatgccagcgggaagagggagaagagcagcagaaactcagggccagagggtcccagggcagaggaaacattgtgagaatcctgctaggagttggtgggggtagatgagtcttgtgggtggttgagttttctacaatattagggaaggatcttggcttctctccttgaatattaagggagaaggtaagcctacagggctggaggacttgggggacaccacaggctgcccgtgggcttgtttggggacaatgactgggcctttctcctgttcatgcatctgcccctgggcggcctcataccagccctgagaaacacagctgctactgagaaaacagggggacagagactgcaatgaattcctagcatcagccaagcacgaggcgcattttctcagtctccccaactaagatgcagatgaacttcaagtacttagactaactgggtttcttaattattgttgtttgtttgaactcataaagtgaaaatattctttgttttctaccaaaaggcccattctatctggagggatcaaggaggaagtcaattcctcacccctctcacctcaagcagagactcagaggacactggtggattaacatatcgttcttaatgctcagtttggttttatgtcttaagacccaaaatgttcagaccctactatctacccgtcatttccttctttctcaatctgcctggcattacttcagtactggatggacctaaacattatattaagctagaatttcatgacagagctacaaacctttctgagaatgctccaggcatgtgagaggatgggagagggttcatgggacttggcttagtagatcttgaagggaaagtgttggagctcataggaagtagtgctggctggggcaaaggtctctgatgcactgtgcagaagtagaaaacaatgaatgagattggcaggccccagctgtcactaagaaacattccataaccgccccccagttagaaacagctagtataaagaggacacaaaaataaagcagatcagatgtaattaggaagtagtaggatggaaccttgctcccagggtgtttctagatgacttaaccaccatagaatccatttacaaaggggcgcagatctagatgatactctaaaatacacattgattttgtttttcatttttgaaatgttaacttggcagaaaattgtcagctggaaaccttataaatttcagaaatgatttacaagttttgttttatgaaagtcaaaattttatgctatctcattcattggcagttactgattctttacccacgtgtgttagaagacataaatgtgagaaatgtttccatcaaaccatgcatgcaattttacattttgtgatacaattaaataatctgcactgttacacatgaatttagtcttcttcggtaatctaaccaagtaatccattttacgatagttatgcagtatgccaattgacataagtctacttaatactaatttaagacttataattgattctatggggttcctgtactaaacaattccacttgaatgcctgagcaggaaaatgaaagaatgagttataggctgtaagaatgtgtttccgaacataccatcatcttcatcctgggaaggggaagaaaaaaaaagatattaagctatcatcaaaatacaattcttaaaataaaaactgcatttctcaatcaaataaatcaaataggtatctgtttctttctctggcagttatacatcttcataataaatatactgtggagaataatagaagttgctaagtgttttacaatttcttaatacaaacagtcatctaagggcattccagtatgagactctcctcatatactcagcatgaaatagattctgaggtgcctaaaagggcccaaagatgtaataatattgacaatatctacaatgtgtccaaaagattcatacacaagatttcattcagttcccctagtgaccccccaaaaatttaacatcctcattttacaaaagcatgatgctgaggaagcttccttagcttgccaggagttgcagagatggattcaaccccaaatatgtctgaccaaagctcagtcttctttttggctctcttttgcaatggccactcttcttaagatcaataagaccatatttatacggtggcttacaaggttcatctacaaccctcaccatttttatcttcagagcaaccttgggaaattagacaagggaggggctattttctcttccactcagataagaaatgaggttcaaagagaaaaaatgatgttgccaccaactagtagaccaaaagggccagcttgaacttgtttggttaggccagatctgtaatgatgaaacagcatctttctcaaagtgttgttagaaggattaaattagctactacttgtgtctggcttatgttaagtgctctttaataaaagtttgccatcatcaatcctatcacacactgagagaaggcgaaaaaggccacagtcaaaatcattcatcccagttggccaactgggagtcccagcaaagagctgcataaataaacacacatgggctcataaaccccacacaacaaaatcacttttcaatacttttgcaagtatattccctctggttccagaaaacacaactcccagattctcatgagcacaagtgtcaatccttccagagacagggaacctggaatgtgatgttatcctcactgtccagccttacctctgccttgttcctatctctgcagccaagccactgttctcactgtccctgcagcctccgtgggcactggtatccacctgctcaggacactcctgaggggaatccccatgggctttctttaagaatgactctattctgtgtcctccctatcattgaatgaccagcataaatctcacctcctctaggaagtcactgctggctccttgagccacatggcacactttcttccctcagccccacagagcatcccgtgattgcatgctgtctggcatgaggggttgtgagtgtgcctgcctccataagatctcagcacttcatcggaacaagcacagcatctagcacagagctgcaaaaatagcaggcgcttttgggctgagcccttgaatgacagcaggggtctgatggccttcagagggcttatggtgtagagaaactcagcagatctgggttcagatcctggctctttataagcatgcaatttgcaaagagtatcttattccttctgagcctcaatttcctctccgtaaaagagaaaagatgtttccttatgggttcattatactcatatgtaaagcgagaaatactcaactatcctggttttcctaggatggagatagttcttgggacaggggacttttcagtgctaaaactgacagcatccctcgcaaacagggacaactggtcatatttaactggcatggcaatgtgcatatggtaagcattcaagaaatgctatttcccctctttttcaggttgtggaagtattgaaaaggaaaacagtagccttggaaatttaggcatggtccaaacttctggccttcccttactttatcctctttttctccttgtgccctgtaattaccggcccctggtaatggagctgcaattaagccagccactctgggagctcttagagggacatgagctaaacaacacagcatgatgggctccagacaatgaccaaggcccaaagacagaggcaccagcccttaagagacgagacccctgggtgcaggacctgctccaggttctgggccaaggccaaggtggatggagtcccaacctcctaagagcctatgcttcttttccctgtatcaagcacttacaaactgacattttgtacttacattctctcttctgtctggtccccatccatgcctgaaatgaattagggcaaataaaaagaactgagcatgaagagtttcaaagagccagccttagaatacagttttgcttcattgaataatgagaaatcgaacccactgagcctagggaagatgggaagcaacagacccccacagagcaggggagagggggtggaagggagatctggttactccatgttctgccatcattgcaagctgagctaggcaaacctttgttctgcataactaatgcagcaaataattatgtgtgtgtgtgtgtgtgtatatatatatatatacacactctatatgtatatgtacacacacactatatgtatatacacacacacacacacacacatgtggtttagtcagcaaactaactctttagtagctattaaattttactgagctgttgtttttcccaagaaatgaaaacattttaggtaatattctcccttgctcttgctttaaaacagccctctcagggcccaccttggtgtaaagagaagacaattagaaaatgttgctgctttgggactattccaaagggggcttggtacactttgcccagatgaatgagctagtcaaacagacttggggacagctgccttagggctgcgacaggcatctgcactgcctgggccgtataatgtcctctctggggagaaggggaagagctggacaatttgttgaacacctcctgtgtgtcagacgcttcacacatcatcatctcattctgtgtttatttaaaattttggaattttgttccttatgagtttgctgcatttattttgattttttaaaaacattactctaaaatgttatcaaactccattactgaggaggttttttggcacactttagccctggtcctaatttaatcctcacaacagccaagcaagggtgatagttatgacccctgattcacaaatgagatggaagctttggttgtattctttgcaagtagcaaggttggccttaaccccaggtacatgcgcgccatttggtaaataggctgaaaactacttcacagcaaagttaaaaatactaaggcagagctcagtattctgcaattatcaaatgtggttgagcagtaaggaagacacttgcggtgacctgaaaaacctcccccaaccatttcctgtctgctacctgtattgaaaaataaaatggtgagtacagttcctatgcactgtgaaggctttgctataacgaggttggaaaactcaatgaaatatttgactggaatctctaaaaacagcagtcaccccttactcttgattagatgtcactctactcatttctcagtagagtccatttccttcaaagagaccctgatccttcatagccaacctgtgaagcctgaacatccctcaagccacagcaagaaaaggcccaccctgcccgggagcaccgaggagcctcggttcccactgcagagtcagcacagggcagcctgtctgccggccactgtgagtgacaagctcaagcaacaccagacaattactttggcacaggtggcttcttccctggcagggggctgctcctttcatgtctttccgtggtcggtggtaaaggaggcttttgaatcttgggtaaatgctccccgagtgacctgtggagttcaggaaaaggatgtgtaagaaacaaactttgccgaggcagagttctacagaacgtcccatgtaccctcatgtagatgcaacagtcttaccttcccgctggaatcgagggctgcaagacaggaggaaaaatgtatgagtgtccaagcacttttcaaagaataaggacaagatgtgaaacaaacaaacacaaccaaaaaacaagttcacagcttaccttgtcagaaaatggtggtttctttcctgtaaatgacagagagcagatgggccatgagttcagaacttcataagcatgaggtttaaaaacacagtttgatgaaactatgagtctgaaccctcttgggggttgatggggtttaagcattaaagaatcagaaacttcagactaggaagggtccgttagagaccaccaaattttataagctcagagaaattaaatggcttgaccatttaatttgaaggtcacacagctttgtgtacatacaagtagtgttgtggattctgtgctttttttaaataaaatcacattttcttttatataactgatgatcaaaaggattaatgtttccttgggattttatgcctctttaattggccaaagtatttcttctgcagcctaagttttatttttatatctgaaataaatccacttgccacggagagggtaacttttatccaattctgtgaaacacttgatattaaatgaagcactccacttagtttctgaagaaacttttcacttggggagagcatttcaggagactctcctggtatgctgcaaatcttttttgtctgcttgtttttagttagtattgtttgttttgcttttcttctagaacggatgatattcaggctccctgaagaaatgccaggtgtacttgataattgtgcatcacaaagttattcaaagtaatttaatttgtattctatctaaagtcccctagaataaatatgccctttgtcttcaatgtgatgaaaatattactaacaaaattcaaccaggtctagaagcaaatcccacatgaccaagaacaagttatttaaggtttttgaatcccaatgttatcatctcaaaatgaagattatagactaaaactctataggtttgccataagaattgggtgacaatttgcatgcaggatcaggcacttgattgtgaaagttggtcatacaaattgggaattttatcacctccaaggaaaacagagtcgagaagccagagggaaaagcactcaggacacataacattgctccagaaatgtgattctatgtgaggttggctgttgtaacctgaaaccagtttcatctagtagttgctgaaataatctgctgcaactcgaagattaattttgccctctgccattgctcaccaatcaaaacttgccagcccccagaaccgatgaactttctcaaggagcgatattgtaacacttctcctttttataaaacctccaatcttctttttgttcttcagacatactgaagaccctgaagaccaattgccccaaattgcaattctttcttcctaaataaaacaaatttagagattttcttctacgtttttattttgactttgatatggtccatgtgggctgacaattgttagttaactcgcctttctttcccttccttccacacccaggcacagttagtgccctatggcgaatggtgatattatctccctggagttgtattttcacaacgtgatttattctttaaggaccaagtacatgccaggcccatgataagaatattgcctcactgtgaagagcttactgacactgagtgtggtggctcatgcctgctgggaggccaagacaggagaatcacttgaggccaggagttcaagatcagcctggtgaacacagggaaatcccagtctctacagtatatttaaaaattagccaggcatggggacatgcacctgtaacctcagccccttgggaggctggagaagaaggattgcttgacccgaggagtttgaggccgtaacgagctatgatgctgtcactgcactccagcctaggtgacagagtgagaccctgactcaaaaaaaactaaaaataaaaaaataaaaataaaaaggagcttgctggtaatggggagagttttgacggtataaaagatgcttataaaagtttggtttggggtggaacctctactttagaggggcacccaggaaacttaaatttatattctttggcctgaataagtatttcaaaatttgcctttttttttttttttttttttttttttgagacagagtctcgctctgtcgcccaggctggagtgcagtggcatgatctcagctcactgcaagctctgcctcccaggttcacgccattctcctgcctcagcctcttgagtagctgggactgcaggtgcccaccaccatgcctggttaattttttgtatttttaatagagacggggtttcaccgtgttagccaggatggtctccatctcctgacgttgtgatctgcccgcctcagcctcccaaagtgctgggattacaggcatgagccaccatgcccagcaaaatttgccaatttttgcatattctctgagcatgttaaaagtctcaggtggggtgtaaacattttaagaagacagtaatccttccaaaacatcacagaaaacggactaattcaagggtaaaacagaaattgtcagaaaagtgtgtcatttaaaaatgcttttaaatatagaaaaaaagaatattttaaaagaataacttttgtgtcaggaggtgattgcgaaggatttgatgtcagtgttccacttttctgatgtctcggctcgtggtagtgagcagggttggaatctgaagtcaaatctatcttcatttccatgtaattatacagctctctacagcagacaattccaagccaaaccagccagcacagctttgcatgacacagcagagctgtgatgtagttcggggaaagagcagcgagcagcagcctcatatccaagaactgaaagtcattttgttgacagacaaaaagggattgaggccacagaaagctaaatgccttgctcagagcatagccaagaaaggggtgggggcagctgggattctgggctcctttccgttcagttgcagagttccttcctcagactcatgtagttcacagcaagttaaaacccagggtcctcaactgcagcctgatatggtggaaaagagcccccacttagaagtcagaaagacaagtgttcgaatttaggcaaatttaggcaaattattcaacttctttgacccttaattttatcatctgagaagtgaggttaaaaatgcacctcctttgttgagttgctgtgaggattagagatactgtaggtgtatttgtggtaggtagagcacttgccccatagcagttgctcaataaatggtagctaagaattgaattgaaaatagctgcacgtgaaggtaactgcaatccaagaatattctgcgtaaattgtgaagaaaaagcactgtggtatacccaatgtttggtcaattgcatacctaaaacaaaaacatccctgacatttgaatagcaccttagggatttataaagcattttctatgtacagaacatccaccttacagattaggagactgagctctgaaaaactaacatccctgtggtctgtgagctattaagtagcaggcaaggcagcagacaacagctcccccaacccttttgtctcaattcaggtcctctctctgtaccctaaagcctcttggctgaaggacaatgggatttgtatacacagatcatccacatcacatagagaagcagcacagcccccagaagctgcaagcaggagctttctaatgaggctgatatgggctttggtcgctactcccaacacttggtagctgtgtgatcttgggaaggtacctctttgtgtctccgtttccttatctgtaaaatgaggatgattctactagtctccacttcctagtattgtggccatagttaaatgagatggtacatgtgaaacgtatgcaggaagcactttataacagcttatcattattactatgcattaaatgtgaatcatacccacctagtgtgaagggttctctatcaaacggagctaatgaacgatctaggggaggtttcgtgcttctgtctattgaaggagcagggactggaaggggaaaaggctgacatcaattaaaagaagaaagcagtcggctgggggttgggcggggctaggggagtgcctggtgggaacagggcaagagagagcagcccttgtactcacgctttgccgttttgtggtttctgcttctgctgggttcttcgtggttggtctggggtgggggcagtggctgcataaagatccaaacgttaggaagcacttccaatacatcagcaagagccggcactcccaaaacctgtctggatctgctcacttttcctcatcttcatgttctgcctacaaacatccatgtccatttcttcactgaactaccgcagtagcctcctatctgagctccctgttctagactctgccacgcaagctcttttctgcaggcagcagagtgagcatgtcactttcctgctaagcctcctatcacattagaaacaaaattgaaactcgttaatgtcctgcgaggccctgcctgagctggcccatgtctgccctctcaactctttcctgtgatcccttctcagtactcatggggtccctaccatagaatcttcttgcagttcctggaaaatctcaaggttatgccctctttggcatccctacacttgtttccttctgcctagaacgttcttctcccggctcttcccacaactggctcattctgtcccaggtccttgtcacctcccccccccataccgtcatgttacctggtcttccgtcccccgaaccacacataactactcaaatgatctctttcagacatctgtctaccgtctgataactagccctagttgagttttatgaaagcagggaccttatttatcttgttcacactttatccccaacgcctagaactctgcttggcacatagtagctgctcagacaatatttgctgattaaataagtgaatcctgcatctcaaaagaaggtcttcaaatctcaaaagcaatatacatctgtagataaacttgtgaagggaacacattcctaactatcaagtccttagtctgagcttctcagggtcactctgggaacttatcagattcacaaggaccgggctgtatgctcgaagaaggagaaaacggggtttgctacctctgtctcctccggtctgaaggctcctgtccttggaatttcaggtgtcggccagaaggtggcgcaagtctttttgcaggagagaggaaggctcggtacccaggcaacaccagtaggtgccacggacttaattcggttctctttgggtttattttacagttttcacttctctcaaatagtgggaagtaaataaaaaccaccagtattttaccccaaaaaagaaacacgtgtgaatgcttgggtttgcctttccccagccgagggaaaagattataatcttttcttacaaaattagaatgagataaagatgtttatagttttatttttctctctggcggaggaaataactgcagtggacaccaagtactgtaaaagaacgggaggaggcctaccgagtgattccggccggctggtgggggcgggagggcggccatcggtctctgggggggcacaggaggctgctggggggttttcccagaggggggccggtctgtggaaacacaaggttattaaagtgaaaggggagtatcggccaagctcaggggtctccaggaacagatatgcagctcggggcaccgggggtgcatgatccttgacccccaggcccacatgagccccagccacggggagacccagcctggatctcacccacccctccctgcccattttttctgtcctagtttgtgtcactctccttatacacaggctcagctttctttgcatttcacaggaataggtatttatcagagattttgccaatcaagaaaggcctctttgtaaccagctcagccagaactggaagggaggattttcagacaattttgtaagaagtaaacatacgcatacctctgtatgcagacacacagatatacacatgtgcacacatgcatgcacacacatgcatatatatgcacacacctgcatacacagagacacgagtgcacacagacacacacacatgccaaaaatctcacaggcacacccagctgcctgtgcagggtgaagtcagctctcactgccatagggatcttgttctgtctgcccttccttcccctctccagtgtcctgggctatctcctccctgacacttcctcattttgctcatctcttcccataaagggaggagctgatcaccaacttctgttaccagaccacagactcttaagtggaagctagatttgcctcgagcagaaactcacattatctgggcagaaactcacattatccacatctccacggaagtgtccctaggccaggttgacaggctggcaatttcctacccctttgacagggaaaggccaggacaagaccatcaagcaagaggggtgagtgggtagggcctccttacgctttgtgccctgggtgcctctcttgcccgactctagtcccagccttggggaggtgcagctcttccacagggaaaagggtaggagcaaggcccagcctgatctaattccaccctgctccacccgcactggccatctctcagcttctctaataggccatgctcctttgagcctcagggcctttgcacagccatttctactgctccaaatgttcttcccttaccacatccatttccacttggccaacttgtatttatcctttaaccttggtttaatatcacagcttaaagatacaccctcaggcaaacgctccagcctcatctgtgcttgtcttcgtgcctctgtatcacggtttcaccaagtaacctcatggctcatttgttggagggtgcgtcacctgccagactgtcagtcccttggcgagggctgtcttattcactctgtatcttaatgactggcacacacaaggcactcaacaactgactcatccattgcttttccggacctccacttccctgtatatgaaacagacttgatcatggttgtccttattacacagatgtttaaaaaccaccatgagatattgagacagcattttgtgaaagggctttaaaatggaaatgggttataccgcataaaggattaaatggtattcgttttttgtggtactgaccttcaattttcagcgtactctctgaaagtatattatttaagaatatatttgtttattttctgtcaacaccactactagaatgtaagccccaggaggcaggggctatttcttctttcctgatcatttctaagcactgagaatggggcctgggctcccagcagatcaacaatgtttgttgaatgaatggagagagaagtgggctaaaaggacagatagacaataaaaatcgtaaacaccatctaatattttttaaagttatagtcaaaccctactcaatatcttcatgtttattctagcataataatgccatgtaactataatttggtcaaaagatggggaggaacaggaaagtactcttggagtacctgagtaaactgcagaatgagttgaaactgccaaatagccttaggtggtagttcaatgctgatatcagccaccataggcaagaattggttgcagtcttagtagtcctcacaggaaacctatgtggtctgtacatttattatcctatttcacagatgaggaaattgaggcccagagagacagagttacttgtacaaagccacatagctgttaagaagccgagcagatatcgagacccagagctttctgctacatgggcaagctggggcatcagccttccatgcagcagtggcgagcttgcctttgggctgctcgggccagaaaatccggaaacgggcccttaccgatgtacatggagttggagttggggaaaggcttggcaggcaggatggagttctgcagagcttcctcgtcattggagggtggcggctcataatccgcgtcatcttccacgggtgcctcttcctcctcattgggggactcatagtctccatcatcctccccatcctggtcatcattgggactttcataatcgtcttcttcctgcccacacagtgatagggacagtgcagtttgtagaggctctgtggccctcgatgtgcctgtgcctactctctccctgccaagcctcacaacagtataacccgggaccaggcagcctgaagatggttactcccattttacagatgaggaatctgaggtcagggagcactgtaccacaggggcagcaagtcatggacttgagaccttggtgaaggtcttcggaccacctttttacacaacacctttctgcacaacagagagagaagaaaggggaaggatgctggaatagaaggtaccggaataggctctgtcttgagtaaacacattttttgctccaggcatcaccatgagaaagactaaaggcctggagcatttgtgatgatactagttaattgccatttctgttcaagggtgcctgtgctcaaaaaatgtcctctcattataacctggtgcagcgttgaaggcccggctaaggggaaaaacagataaacaaagcctgttaagtggaaggcagattaagttgtgtcgaggaggggaccgtcagaggctgtgctgttctttttgctgaaagttgagtgtatcaacacatccattattcatgaaatctgacactgagtttgaagctgttctcttggaaagaatctctaaattttagattttttattgtattttatttttgcttcttcttggatctcagggaaagtaagcccgaggtgctggatgcttgcctttgaagcagtccatgaaggtgaatgagcatcagaatgacctcccaagcaaaggcggcaccatcagcagcagtgatgagcgctcatcatggtcatgccaaagtccagggggtgagtcaatgagcccagacctcaacactcaagggcagtgtgggaaaaagcaatgggaagtggccactttttgaggaaagaaatgttccagtgtcctagaaatcctgacagctttgggtggcctcaggcagactgtctttacgttgttctgttgagagagtcctgtgtttgtttttgacttgaggaatattaaaaacatcaacaacagaggggcaaagtgagcattgggtgccttcccaactccaaaaaaagactttgtcctgccctgtcagggttcttataactttaggagcaggtgggcagagccccagaggaatgctgcttcagatcaagagcctcagcatggaggtccgcaggcacgtggcctccctccaggctgctgaccctttcctcaccctgtctaccctaggcccatcattcctgactttacaccagctctttaccccatcaacctttctcaaatgacagaattttcctctctgcttctagaacaattattttctcccaatcatttggctcctaaatttgtatgcatgatgttgttgctaattatattctgccatatgtgtgttaaagtaaattaaaatggagaccaggcctgaagaatccctgagcagacaaaaccagttgggcctcatcagtgacctaaaccttacttgatttgcagcataagcaaaagttaacttgggctatttcttgtaaatgcctgtattaaagaaaaacagaacttaagcccaaccaatcagaagtagccagccaactcataattatataactaggagctttccagcaagatagactaaatgagatcggttataactgtaacccatcaaatattttctttttttttttttttttttttttttttttttgagatggagtctctctctgtcaccaggctggagtagtgcaatggtgcaatctcggcttactgcaacctccacctcccgggttcaagcaattctcctgcctcagccgcccaagtagctgggactacaggcacgcaccaccacgcccagctaatttttgtattttttagtagagatggggtttcaccatgttgaccaggatggtctcgatctcttgatcttgtgatctgcccgccttggcctcccaaagtgttgggattacaagtgtaagccaccgcacccggttcaaatattttctttgtattacatctacattcactttataaatgcttgtccctcatccttcttcagcaaagcctccttctggtttggtgctgcctgattcatgaatcactgtttgctcaaataaactccttaaaaaaaaaaaaaaattgcattgtgcctcagtttacctttttaaaatggggtatccatactgtaaaatgcttatgattgggtcctttatctccactcatttcccagtatgcccttgcaaagagctgggcacataacggagctgccaagctctatagccactagtgaatggaagccctcagtttacagagaggatcgaagactagcctcaggcacagcacaagagaggctgcatggcaaggattctgcctctgtgagtaaacagaaacattccagcggaaactctgggctattttccctttgtaccagagaaatctgtcaaattccttcattttcaggtagaaagcataaacttagctaaatcttttttttgttttttttccaattaaatactttcttttaccagaatcccaataggtcaagggacagtttgtttctgccttctgaaggcactagaggtggcctcttaccagaaggcccacgtgactgagggtctggttacctgggtcctaggtctgcctctaactaactttgtgttctacgcacgtcacgttctgctctcctgtggactcagttgcctcatctgtaaaatgaacagattgggctacggtccataatagagttcttagcctgagactgcttcatgggtggtgactgtgtatacaggttcctggggaggggttgtacaatccgtcagactctcagagggggaactgtgacctttcaatgtaaaaatcaactggattgcaccctctttgaggtcttttcagggccaacagttggttctgaagttcttttccctccgtgtcaccgatggggacttaagtccatgagaaaagctacttgagagtagatttctaggagtgtccatttttggagacgggggggtagtgggtgggggttggtaacagtgggtgaagtgcagtcagcaaagtacagcctagggccacgtgcagcctaccctctgtgtttgcaaatgaaggtttatgggcgcaaagccaagcctgtttgtttgctcattgtctgtggctgcttttgtgctccagtagcagagttgagtagctgagacagagagtgcatggctcccaaagccaaaactatttcctgtctggccctgtgcagagcaccttttctgggccctgggtgggtgtgctggcatcatgttagagccccgcttcacttggctccatcctggctccttatcacaaagctgccctggacactgctgtaaaggtgcaagaacagcccacaccatactcacaaaggacgaccagcccccattgtcctcttcgtggctttctgtggaaggagatgacaccaccatcagcactgaagaaaagccaccacttgagggaaagtcaaagcagcttccccatctgatgccttccctcaccaatgccccttccctggcctccacctacctcccacacccctgcaggtttagccacttactgtcagctccagcgaccctgcccaaggtgctcattctaccagagaaccagggggtggcgatggttctcaacctttctcgtgtgtaacagtgacttaggaagtgctttaagacctgtagatacctgggggcctatgcctacagcttctgactcagtgggacaggctgggccccaggaatctgcattgcaacactatgtgcaactgaacagttgaaaagctgctttactgtaatcctagcactttgggaggccaaggcgggcagatcatgaggtcaggagatcgagaccatcctggctgacatggtgaaaccccgtctctactaaaaatacaaaaaaagtagctgggcatggtggcgggtgcctgtagtcccagctactcgggaggctgaggcaggagaatggcgtgaacccgggaggcagagcttgcagtgagccgagatcgtgccactgcactccagcctgggcgacagagcgagactctgtctcaaaaaaaaaaaaaaaaaaactcagatgcagggggactagctaagctcaggtgctcactcagaggtggggtccctctgttttcctctacagagctcccagagctcctcagtgtgtctctgaagatggtcccagcagaacaggggccataagccaggtggcctgcagagcaagatctcctcccctccatctagacccaaacccttttctgggtaagaactggctgacagacaagtcagtaaggtcacctgaatgaactcaaggagccccaggaaccagaaaggcaagaaaactgaaatacctatcacctcctaaagcaatcacctctgagccctgagagctttacctgtctcttcaggaaaccgcgggacttggggtctgcaaaggtaaatagcactgcattaatggtcttctcgatttaaggggatctccctctttcctcaacctggtccagcgagagggagtccccagtggagggcatgtctcactgctcaagagaggtttgtatccttgctgctcagcaactggggctaggataccctgaaaattctggaaatcaccaagccacatcagtggcatgactggaagctcatgactgtctgatgctgtagaggaagttcccctgatgtcccagacccagggacaggatgcagagcaggggagggaaccccttcccctcgttggacaccatcttccagacccctgggattcaggggacaaatgcagatcaaaaagtagggcaaaaacagttctgtgcctcccttttaaggttcaactcgggactgaaaaatcttgcgtttccttacaccagccgcactcacttgcgtgtgaagatgctcctcctctcttcgttcttgttgatttcctgacttaacttactgagaatcctgcaagataaagagacagatgaagagataaaaccatcactcagtctcaaccttccccctgacccttgatatcccctggtctatagaaacttggggcaccagggccaactttggccaggctcctctttgtcacctctgcagggaccctctgctcttcacttcctcccagaacttgccatcttattccccgggccagaccttcctcctgcccaggaagccctctctcctccttgctgatctgtgtctggctgagccttccaagtccagctcagagctcccccttaaagacttgtcagctcacacctggctttccctccaaaaatcaggagccttaggatctggatacgatagctgtgtattttcttgtcttactattcctggggctgaggtcccctggcttttgcatgacctggcagtgctgtcttgttcctaagaatcttcagaccatcatctagacccacaggaatcagctgctccttggagatttcttatcacaacctctagtgggctgttctgtggcctgccttctccttccatcttcccctcccagactcccacttggtgatgcggattcttataaaagtttggggaggtattctctataaaggcaggggttgcagaatgagagactccctgaatcactcatgcccttgaggccagctttgaccaagacacttgaagatactcttagtccctgggttccttcatgtcagaactagcaaatccccaaatcccaggatggagctgggggagctggggcaggagggctttgccgacagaaccatatctccagcatgccctagcaacaagcatccattccaatctctcagatatccagaactcgagactgcagccccacttagtacccactgatgagaccagcgagacccttagtagtcaataggcttagtgtttcctcgagatttggggcaactggaaggaacctcagattatcagtccaatttcattttacagaggagatggcagatggcggatcatgaagtcaagagatcgagaccatcctggccaacatggtgaaaccccgtctctactaaaaatacaaaaaaaagctgggcatggtggcacgtgcctgtggtcccagctacttgggagactgaggcagaagaatcacttgaacctgggaggtggaggttgcagtgagccgagatcacaccactgcactccagcctggtgacagagggagactccatcttaaaaaaaaaaaaaaaaaaaaaaagggagtagcttgaagccacatagtagttagtggtaaaggccaccccttttcccacaactcacaccagcaccacaagctagcctttctaatttccaagccagtgccctttcaacgcacacacccctgtgtcagttccctttctgctgcaagctctctggaggcagatactgttgagtccctggcctgcctatgagaacggctcatgatctctatttcttctgcttaatgaccatctcgaagtaacaagtttagcctaaaataaacttgctaagttagcaaaggaagtccttagcagccaccatttctcgattcctccatcacctcccctgcccctcaactccctcatttctcccaagatatgggctccaggctgggcgcggtggctcacgcctataatcctagcactttgggaggctgaggtgagcagatcactgaggtcaggagttcgagaccagcctggccaacatggtgaaaccccgtctctactaaaactacaaaaattagtcaggcatggtgcacgcctgtaatcccagctactcaggaggctgaggcaggagaaccacttgaacctgggagtcagaggttgcagtgagctgagatcacgccactgcactccagcctggggacaggagcaaaacttcgtctcaaaaaaaaaaaaaaaaaaaagaaagaaatggtatccaaacctcctacctcattagagcaatgggataaacaaattttgataaacacactggtacttaagaggaaagagaaggaggaaggggagggaaaggtttactctctgtaataatattgttgacaactccaggcttttgtgactgggcagagagagcgaggctttaagagcagcagcgggggcttcctagttgcctcctgaccatgccgtcagaatgcttgtgacatggttctttttggttcccttaagtggttgtttcaagaagacgatgggcatgtgggataaaaggactcctacagagctggcaagggagccccgttagtgtcctgtgtcctggccgtgtcaggtggtgctggctgcagcagccactcccattctgtcacctgtttattcaacaatgtgcactgagggccttctaagtgctgggaacttagaagtgctcaaggtgcatcaatgagcaaaacaaagatccctgctagtggagaggaaactttaaggaggtgaaatgtgctgcatatgcaccatgcacatgcagagtggggggctggggagggggatgggagtgcaggggggggctgggggggatgggagtgcaggggtgggggctggcgagggggatgggagtgcaggggttgggggcgggggggatgggagtgcaggggtggggggctggggggatgggagtgcaggggtggggggctggtgagggggatgggagtgcaggggtggggggctgggggggatgggagtgcaggggtgggatgcggttgccatttaaaatgatcaggcctcactgaagaggtgacatttcagtaatgacttgagcgaggtgggactgaggctcacctcaacgccctcctcctacagagtttgacagggctctgaccagctcacaaggctgctttggatcttgaaagaacctcctgctctctgcggtgttgcctctcaccagtatctctagcagccaggctggaggctgccggggctcgaattgggtgaggaaggaaatgtcaaaccgcaggcctcagcagaggagcagcaaagagctgagtgggggcagaacaggtcctggcagttggcttgcagcaaagtgtgggctcccagggtcctcctgctttaaggggctacagaaagcaccttccaagcctgtgggaccactgccagggtctggtggacggtgcaacagtgatggtgggcatagcagggaggtggttgctatggctattgctaggtgcaaaccttcaaattacaccctacccccagaggaccaagtgacagtgagtggagggaggtgactcattctcccttcaccccataaacccctggcctcgctcaggaccagagcaagaagtgatgggggctgggcagccatagacagcagtcctctctgcttgcctttgtttaagggactagctggccctggaaatgggctgaacctccccacaggaagccaggcccgtgtaggaaggcagcattctacaatgacctaggttccagcccagctgcatccctaacttacagcatggtgggggccagtcttcatcttctcagtctaaggtctctcctggtaatgtacaaggtacagggcctgcaggcacagacagtctaactacaatgtctggccccaagggtggcgcccactgtgtgatctcagacaaggcagctgccctcacttggccccagattccttatcagcacaatacaggggttaaacctgattagggaatccctgatgggcctgatcatcatgattacttagctgtacctgttgcaaacactgatcaccaggcccagcctagacctacctgaacggactctctgaggagaagcctgaggctcagtgacatcaaccggcccccacgtgatttttattatcatccaaaaagcttgtgaaataaatcctgctattcttgacactgatgaaattgtttgtttgtttgcttgttttaaaaaaggaggagaaggaaaggcaggagaaggaactttgtgattatgaagggagtgaaacaggagagtgggggtatgcggggccttagctggcctctgatgtagccctttaattctccccacacttgaacaacagtgaaggaagccctactagtgggtctagaaatcaactttgctgatgacacaagaggaaagaaactatacaagaaaagaaggctgccaggcaggtggaaaaggagggagagagagaggggggaagggaagggaaggggaaggggtatagaatagaaaatatcagtgcacaaagcatgcagtaggaataggcattgtcctgtgaaaattccatctttgtttcctctactgtggcacgtgtagctgtgtactggcttatgatgtagagcgcattcttgccacagctcacatagtaagagctttggccaacttctgaccaaagccctcccacagtgggagccttattccctgggctcagatttcagactgcctgctgatccctcctgggacaaggctcccggctcctgggtagggcagatgcctctccccctgtgctgttctctcagtgggaccctggaactctccttctcctccccacccctcctccctgcacacattcccactctcagccctgctctcgctctgcattccaatcctccttccaaggaacaaagtgttctttccgtctttaaagaccagcccccttgaaccaagagccaaaccttctaaattctatccttgtcacctgagaagccgggggcagccagatgttttaagactcaggaaggagcctttcaccatcacctgaggcctcggtcgagagtgtaagagtaggacataataatttgaggacacagtgttctccttacttgtcacccatgtcccctacccctgtagttttacatggagtgttttcctggtgcctcacgatcattttcctggtagacaagtataattattctcatttttacaaataaaaaaggcagggctggccaggtgtggtggctcatgcctgtaatcccagcactttgggaggctgaggcaggtggttcacttgaggtcaggagttcgagaccagcctggccaacatggcaaaaccccatctctgctaacaatacaaaaattagccaggcatggtgatgcctgtaatcccagctactcgggaggccgaggcaggagaatcgcttgaacccaggaggcggaggttgcagtgagccaagattgcgccactgcactccagtctgggcaacaagagtgaaactccaactcaaaaataaaaataataataataataggcaaggctctgagggaggcatctgtctaaaggcacgtgaccagcatttatggggagaggaggcttcacgtcgagtgctgtgggcttgcactggaagagaagaagggacagccaagggaggcacctttcctgtggcagggcccttgaggactgacaagagctgggtccctggacggcaattagccactgaatgggacaggggaggaccatgttggagagaggccctgttttggttttgctggggtctggccatatttcttttttttttgagacggagtcttgctctgtcccccaggctggagtgcagtgccacgatcttggctcactgcaagttctgcctcccgggttcacgccattctcctgcctcagcctcccgagtagctgggactacaggtgcctgccaccacactcggctaattgttttgtatttttagtagaaacagcgtttcactgtgttagccaggatggtctcgatctcctgaccttgtgatccgcccgccttggcctcccaaagtgctgggattacaggcatttgagtggccacattctttaacaggcatgagaatgttcctttcgcctctgcgtcccttcctccacacctttcctgtcttctctgtctcaggtagagaaataggtacaaaggagatgcctcagtacgttgtttctgccattagactcacagccttacaggaagacagacaaatatttctgcattacttctcagcttgagtcttaggttttcccagcctaattgcaccattggtaatggctacagggataaccagcagaaagagcatcatccaatacctaattgctgcctgcaccacccaccccgtcactctcttctccgtaaagttacactgtgcatttaaatataaaacttataacatcccatcctttaatgaacttcaaataggcaccagcagatttgaacgtgtattcgtgtattctatcgatttaaccagaccgttgtcagctgtaccatgagggccaacctaggccctataaagggagccttcattttttttctttaaaaatcctccacctttacaatgttgcaggtgtcttgggatcaaccatgtcctgagagagtgactgcattttcaggctgagagagccttccttaccacaacttaccttcttaaaaatctatttaatacttatattgtaaacgtcagggaaggaaatagagacattcagaagagtgtaatattgttttggttttctgtacatgaacacaatttcttttccaaaggcctttggggtaatgaacaagacaaataaacttatgtacaagagatggaatgaataaagtattgaacgcctgtaagtatccaggacagcaccaggcaatttctgtgtgctgcctcctttaatattccccactcctgaaaagttagctcttttcccttctacagacaaggaagctgaggctctgattgcctaaatgacttccccaaggtcctacagctggtgggaggcaaagtcagctttagagcctggatctccctcactccaaaaccctatgtcctctctattctttaattcctcctctccagaaagatagaatagttaaaaagctaaaattgttctaattgggattttacataaagcaagaatagccaacacttattcagtgcatattgttattttcccattatttcccctaattttcccattaaccctctgaggtaggttctatcattattagcattatacagataaggaagctgaggctcggagagctgagctagcttgccctcaagtctcacagcctgtgaatggaaggattgggtctcaagcatctgacctcagagcctgcgctttttctcactaagctctcctgtctgcctatttataccccaaatagtagcacttaaaattggtgagcttgtagagtctctctaacccattccttccttttatagtttaggaagctgagggtggtctagggatgtgtcccaggtcacacaactcattggaagtagagctggaattggtccttgttatacatttctgccaagagggacagtgagtctctaagtcacctcatcagggcagcctggaccttcccttgatattttctccatcattctccatattaacccttcatgttctatgggcaggcttcacagtctttctagggtgcacattcaaacacattggaggaggggattacatcgcaggccaagcttttgttttagtttccagagagctaaagaaagatcccaccccagcccattcgcaatgtgttgataattctcccgttcacactaaccagaaaccatttcccacccctaccactttctccaggctctcaaaaaagccagaagacatcagttgagcttagccttaagatgaaaaaggatcttccaagctgaaagtgccttctttatctctgtccttccactgttctgattaaatctcttccatccccccatcttcatagctacagccctaggggaggctcctagctcactggcaggatcttggtcaccaccaactaactcagtcccatgtccccagctgggctgtcctccaaatcatcacttacatgccctggacagagataagacacaaatttaccttgatgctcacttcactaacactctctggctcctgagaatggctcacgggacctttataaattgagggacacaccccacaacaaccactcacttcagcctctttgctttccactcccccaggtatatgccccagctgctctgccccactgccgctccaccaggcacactgggtggtgcctctgtaatatgttcccatttctagaatgtcctacaatccatccctcctatttcaagatttaacttagggtcccttcctcccttgtctgccctgaatactgtggggaaaattactcctgccttcctacgagcgcttgaacttgtgcatgcatgtaccattgcactgttgtaattgtagtgtaattgctttgcttgtctgtctgacctccctttagaatgtgagtgtcctgaggatgaggattctgtcccatgtctttgcagcctgaataattttaacaaaggcctgacacattgtagttatctaacagcagttcattaaatgaataaagtattattgaaatattaatcttgtatagggaccacaagatgcaaactcaaatgccctcaagggccacgtacatacacagacctaagtagttaccatttctggcacccttcattcctatgtacacatccctttccacttgaaggacttttaaaaagcacctgtggcagtacagttcagattttgtgtgtctgaaaaagtctttatttcgtcttcatttttgaaagatatttttgcctagtattgaactctaggttgacaatatttttcttttgctattttactttcgagaaagctgttgtgatccttgcatttgttcctctgtatgtaatatgtctttttttttttttctgactgcttttaagattttctttttatcattggttttgagcaatttgattgtgatgtgcctcagagctagttttcttcctgtttcttagatttggggtttgttgagcctcttggatctgtgggtttataattttcatccagtttgaaaaatttttagccattatgtcttcaagtgttttatttctgtctctccttccccgctcacatacacattctttcctctcctttagggactttagatatatatttggttctttgaaattgtcccaaagttccttgatgctttttttttttttttgagatggagtcttgctctgtcacccaggctggagtacagtggtgccatctcagctcactgcagcctccacctcccaggttcaagtgattctcctgcctcagcctcttcagtagctggaactacagtcgcctgccaccaagcctggtgaatttttgtatttttagtagagatggggttttgtcatgttggccaggctggtctcaaaatcctgaactcaggtgatccacccacctcagcctcccaaagtgctgggattacaggcgtgagccactgtgcccggccccttgatgctcttttcagtgttttgttttagttttttttctctgtgagtttcaatttggacaatttctattactgtatcttcatgtctactactattttcttttgcaatatctaatctgctgttaatcccaagcagtgtatttctaatctcagattttatagtttacatttctagaagttctgtttgggtctttttttgaatttcttatgcccaaatttaacttctagaacacatgaaatacactcaacattctccttgtctgctaattctaatctctgtgtcagttatgggtcagttttgatgttttagtttttctctttgttgtgggttatattttcctgctcatttgtgtgcctgttagtctctgattagatgcctaatatcataaattttattttgttgggtagtgaatatttttgcattcctataaataggtttaagttttgttctgagatgcagttaagttacttagaagcagtttgtttcttttgggtcttgcttttaaggttttctagccaggacctgaacaatttttagattagggctaattattccccaccactaaggcaagatccttctaggcactctaccgaatgactatgttttccagccaggctggtagaaataagcaccatttccagccctgtgagtggctactctttcctccaatactgttgggtagttcttttgccacctacaggtagtctctcctttcatgcatggactgatctgtgctttgctaaagaggggcccctctgaagctctccagaatgctctctctatgcagctctctcctctctgacacccgttgaatgaactctaggctcctggactctccgctgcctcctcaactcaagtcgtccaccagacccagcactgtgctccctgctccctgtgccaaggcctggagattctcaaagcagcaagcaaccataggcttcaccgcctttgttttccatccctcggtgtctgatgctcaatgtcttgaaaattgctctttcatatattttgcctggttatttggttatttcagttgggaaagtaaatctgatccctattacttaatcttgttcgaaagccaaagttcccatgatataatataaatggttgacgtaccttaggacgatccctcagggaatggtgggaccctggtgaactggggagcacaaatcccaactaaacagggcagcagacatcagatccggctgactattgccacagtagaatataagccctcaattgccacatctttcacttgtttctaaagaggctggattttgtgaaagttttcctgatttcaaagcacagtggtcaccaaatttaacatacctgcagtctgggactagcccaccagccaccaattctgacacctgtgtggaaagttccctcttttgcaaagaactatggtttatctctacaacatcacatttctgcaatcatagaaatgttctatatctgcactctccagcatagtagtcaccagctatacgtagctattaaaatgtggctagtgcctcaggggaatgaattttaaatttaattcaaattgaagtagccacatgtggttagaggatatccttagaaagatcaagccatcttcaacaatacgtgtccctggagatagacagcaccaaaggcaaatccttattcctctcttttccctcccccttccggacaagggaaaccctatagtcatgctaaaaatattctccttaattgagctgccagcattcctacctattcatgagatctccccacctcctactcctttggcctacttcccttttattatgatgagctctgagacccttagagtaagagaagggtccttatagaatgtccagagaagagaactcaaactggtaacacacagactatatgtagcccttaggtgtgtttactgtggcattcacaatacttgaaacatttgagccaatgtttaaaaatggagatatagcacatgaaacccatatttctagttattcttgataaatttgaagataggacattgttgggtccacattagctggagctgaggagctgctgcactctttgaatggaacatatgatatctgatttgccacaatccccaccattctctattgcttcaccaacaatgaggctttgcgatggctacttttttcatcatatgataaccgtgctattatttttcttataatggagaactatttcttcatacagaatatttaccactgttttgtccaatgatgataaaacaaaacaaaacaaaacaacggggctttgtgttttcaacctgaccaattttaccatttatagcacctgcctggctcctgtaggtatttgagtgtgtgagacctttactagagggatgaaaaatacatggcatgacatgcatactgcaacttcccctttcagcacctatggcagacatgaatgatcaatcacagctccctttcctcgggattcttctcaacataacacccctgtcagatatttccaagcactcagtatcaacacataattatatccattgctgtcatctgctttggctctcattttactgtgtgagaaatggaggtcaagaaaacttaagccatcactgagtcagtggtgatgccatgatgaaaccttgacactgatgctattttcacaggcccaagcaccccatgagaagagaggaaatgaaaacattggccagagttgggcttgtttttggcaagagcatccaggtcaccagctgggctggatctgtgacttctgttttccagctcttcatgtaacttctgttccccacatcctgcccttgccctcatccttcctacttgctttcttatttcaagccgacaatgacatagaactgacccagcccccactcacactactccccattcccacctctgctcccagatcacccatagagttggaggagtacttacggcacccggagcttggggaacttctggatgtcattttctgtcaggttctgaaatgaagacacatatggcaggcaggttacaacccacagaaagggctctgagcaggaggggaagagtgatacgtgaaacaatatagggagtggtggggactgtggcaaacagaggagaaaccgccctgcccacccaccctccccaagtaggcagcctctagatgttttgcctaaaagcctgtgggcctgctgttgctggatctgcttttacaaagggaatccttaagtctgggttttatgtgaaatgctctgagttccaaatgttggcaaataattttgacttaaacactgtgagagctaaatctgtgaaaccaaacgactcgttgtgtgggctgcatttggccatgttaggacctcttccctacaccccagacctcaggccctctcagtctccacaaggtcagctgcagagaagccagcctggaggagtctgtgcctcttttaccaacatcacatcccagagaacctctttcaccagggttgttggtagaattctcaagatatggggatgccatgaaaaggctttcttgagggaactgagaagggaggggagaaagaaactcatatttgtcaagaactaactctgggcctccacctcttaatgctttagtgaatcctcacatcaactctgtgatgcaggagttaccagcattcccattttgaaagagagaaagccgaggctcagggatatcaaggggatttccacttgtgggggatgagctggggctggaattccactctgtgacatccacagtctattttcttcctgcaaacctccatcctaccacgtctgatccttttgacggcccctgtggcctatgttggagaggattatggggggaaaggtgaaaggaggcatctggaagggaggaggagaggagagcatgtcagaattgggagcagaaaagagactgggcatgctttccatagaaccaatgatgagccaacaaagggctccaccaccattctagttaaggccagagggctgggtagttagggtgggagctctggaatcagatgggctgggtttgaattttggttcattcacttagcagctgtgtcatttagggcatgcactttgcctctctgagcctcagtttccttatctgtaaaatggggaccataataataataatgatacccacctatcaggattgtgaggactgagtgagatgatgtatgtaatgtgttttggcacagtgcctggcacagtgtgtgactgagaaatggaggagtaagatgaggaattactacccctggtggggaagcagcaggggtctgggtgagtcttagagtttagtgtttttgcttcttttccgttctgggagctgcctgtcaggttttctgaccactggaaagatctgggcactcttctttgagatcagctggcacagaggctggggctagggcatcttagcaatgtgttcactggatccatctgatccagctcacaggcatggtttctgatctggacgctgatcagaccacctgcggcagggtggggctggtgaagggagtcagccagaagtcctgagggcatcgggcttttggttaagcttcttaactactccttttctttctttctttctttctttctttttctttctttctttctttctttctttctttctttctttctttctttctttctttctctctctctctctttctttctttctttccttctttctttctttcctttcctttcctttcctgtcttttcttttcttttctttctctttttttttttcatcactgagcagcatctccctgcttctgaactactcccactcagggaggtaccaagactcatgttttgagtgtggtgtgaggagttgaagccttcctaagggctgccagaggggtggcggctgagcactgagcagctggccaccagcttctgctctgctgagacgagggcgtaagctgagggaatttcaggaagattgtggaggaggaggtggacatgagcctggctggagacacagaggagcagggtgtcaggaaagaggaagacattcagaacggggacaagaactgtgaggaaagatgagagatgttgaaacagaatttttggagagttttgctatgtgatgtaaccccctcctccaccttttccaaaagcctccagtaaactctgggttatttgcatgatgattttggagttaagatttatggctttgtgggagtatgattatatgctgtgggtgttgagaagaggggtacagaaagaggaaagccacaaactgggccctggtgggagaggcaatgtggcagacatggctgcttgcctacccaatacccactctccctttgttttcctactgacaggtcctgggtttcattcagggcagtaaatgtgcttgttcaaaatatttaactctccaggctcccttgcagatggtggaggtcacatgactctgttgtggacagtaagatataaccaaagtctgctggatggagcttctggaaaagttactacttccctggaaaaaagggagcatgcatttaccattcaccatacaccttctcctctttgcctttctccccgtctccctgcctgccatggagatatgatgcctaaaggtggagtagccaactgacaactgttaggacagaagccacaggctttttccatcggttagatgaagcctgggttcttgatgtcttctttcaccatcccctggcacccgcctatacatttattacttgaaacagactgacctttatttggttaggccactgtggtcaggtttctgcaacatggggtcacatgccttcccaactgacacaagtctcaagctccttttctcttctttttataacttctagaagcatagcttctaccagataaggatctaaccttttcagtggaaaacaaaaatggcaaagaagtaaagaaagaagagagagaaagaagaaagaaagaaagaaaagaaagaaagaaagaaagaaagaaagaaagaaagaaagaaagaaagagagaaagaaagagagaaagaaagagagaaagaaagagagatggagagagggaaggaaggaagaaaagaaagagagggagaagaaagaagacagggaaggaaagggaagggaaaagagggaaggggagaggggaggacaagggaaggggagaggggaggacaagggaagggaggaaggaagaaaggaaggaaagaaggcaggaaggaaggaaggaaggaaggaagaaaggaaggaaggaaggaaggaaaaataactagggcctttcacttttgccttcaatagcagagtggccctggatattacagagctggaaagggtgatagattagtaattagagcttagatcaagcgtcccaaattgtacccagtgcactaggggtggagggtgggtttcagcagaagctgcctttacatcccccagttgcagggacaggcactggattcttcttcttttcttctggttcctatcaccctactttgcacttcctcctcttcatacaatgaacagaatgtgccacattgtctgaaggactgatagaggactgattggagcagaggaaacatagctgcctagataccatctctcaaacaaccctgttctaccaggcctgacactcgcaccaggactgttgtggggaattacagagccgggaggggccatcacccactatgacccagtccaatgtgctcagtcaacagggtaggaagcaaggcaggctcagagagggcaagtacttgctcagggtgacccaggcaacagggcgtcgtaggcaccatcctcaaagatgtcttcctccctttccattcaactgtgataagtctctgttctcagtgctaatagcaccagaatgaaatatttgggtttagcagtaatttgcaagaatggcactaaagctccaggaattctactgactcaaatctcaatacaaataaataatactgttaaaaagtcaaatggtatcagactaaattaagtgtatgccttagttcaattagtaggtatgtgacatagaacaaatcacatcacagctctgcatgtgtttcctcatctgcaaatgaggtagttggaagcctttctgaacatacctttctgctataaaacaagtttctagaaggcagaaatcacatcttagccatttctctatccccaccacctataatgctctccagtatgtaaaagcagttcgggaaactgcttgtcaagtgaacgaataggcgaatgaatgaatgatttaggtggacagtgaataaacatgtcttacatggcacctggaagcaaaactcagaccaataggagcacaggttagtttcagcacaagacttgagagctgcctagaaaggggcagatgactgtgggtggtggtgagctcaccatcactgaaggaattcaagaagatgttggtagcagagatgtaatataagaaatggattggtgttctctgggggcaagctggagcttgtgatctctctggtctcatccaactggcctgaagtctcatggtcaagttcccttactgacagtgtcttacagggagacacaacttagcttactctattcactctgaatttaaattaggaacatctacccccatgagacccttgaagtcttattttcaaagagtaaagcaaagttcccagaaaggatggattggtgcagtcagggtctttcttaacccatgggcaaaggtgtcatttcagggaaaatgctcaaaccacctccccgaccacaacctagcacctctgtctccaccattagagctgcatccttttccctttaatggcttagtctttaatacatacctgcaccttggtcttagacttcaagctttttgaagtataatacagtggagacagccatatcacatgtgtgcttgatgcaaaatcagctttatgaatttggtagtgagaaagaaggaagtaattgaaacaatgagggtgatgccatcctttattccactcatgagtatgtgctccagagtgagagattggaggtgagaagcttctgttcacccatatggtccttcttccccttgggcttctcaaaggatggatggcatttaaatagattttccagattatttgtttactatacttggattcctccttaaggtgtaagtggaagatcagagaggggttctggatgataggatcctgaaaggtagtgagagagggggccctaccaaatttctggaaaaagcaaagggatcctcgggtgtccccagggaaagggtaggccagttggccctgcagccatggggaaaagtgccgaacagtcttggtttcagtgtgttggactagccagagcttaccaagaagcgagccccatcgatgtggtacttcttcactgccttctcacagtccttatagttgagctgcaaagagaaggggaaggtgttgttagtgacgggcagtctcttaccattggttcctctcccttgcctgccccagaaacttagcactttgcggtacttgtggctagccaggctccccactgccctcccttggctaacagagggcccagtccccacctcagcctcgctttcactacccccttgggactgcctgaaatggagaaattgccttgctctaaggcttcggggccaacccttacagaaagactgccttcaaggcatgcagagctctgccctatgctcctcaggaaggagagctaaaagaagaaaagaaataccatccattgtctcgatgcccagagacgacctcggtgtttctttccatgctttcttcctagcatgtttctaaacataattgaggttatgatttatattcaatctcattattctgacttttttctcttaaattacctaaagggataatataaacactgcctagtgttatgcaaactcaatttaaaataattttaatgaccacaacattatttaatcatgcccttattgctgaacatttagattatttaccaagctgctgtttcaataatgataataaaaacggcgaacaattatcgaaagctttctgtgtggcaggcagtgtaccaagtagttaaactagtcttcaatcatttaaccctcacattttgcagatggggaatgagaggcacagacagcaagtaacttgcatgaggttccatgggttttaggtgacaagtttcagaacaggctttaatgtctctttcagaaatattccccttttaattacagcataacttatatacagtaagtaaaatgagcaaatgaaaatgcagcttcatttgtttgcagtacctcatcccaatcaaaatagagacaatcatggatactattttgcgaacttttttctccctctttgagataaattgtttaagtcagaacctcagaaccgagttatataggatccataggaacgagcatttttaagatcttggttattttcctagaccaatcagcaatcatatgaggtgctagtttcaacttgtcctcaacagcataaatgttcacatttgaagtatctctcaacttgctgctttggggtggagcatttgaggttaaatgtttctccttgaggatcctaggttcttctcacaagggtgggcctcatggtttgtggcagccttcttttggagcacattttaagccatatttttatcttatagctagcaaatccaaagaataaatacaattgttatgaaatcttagcttggaagggtgggatgattatcacactcagaaagctgacttagaagttgatattgaaagcacatcccatctatggagccctggtatcccctttatctacaggcagtggggggtaagtggttcttggaagagtcaactgcctttaattcatcattctcactgttatcattatgagataaaccagatgattttgaagagtgctaactttgtgtctagatcagcagagagtcctgcagactgggacccaggcatttgattctgctccagcaagatctaggcttgtggacctcaaatctgtatttttaaggagcaccctagacgattcctatggcatccagcattggtaggcactggtccagaaaagttacctggatttgtagtaaggaagactgaggcctctagagggaaagaggctggtctaaggtcacacagtgagctgggataccagctgggaccccacctgggattaggacacacagctctgagccagtgcctctccactgcacgacccaaggatgttctcctgcaagtcaaaaggaattggagagattgaacaaatatgtaacatggtctctgtcctcaggagcttatattccagacacaggacgaggtacccatgtcagagacaagaagacgcaaagtcccaccagtctgcatgggtgtccccagctaggagccagttaatagagaaggtaaaagggcagaaggaacacgcattaggatccatttgtctgctgagtgccttgcacacatcatttgctttaatcctcacaaccaacccattgggttagttactgttcatatctctatttcactgatgaggaagttgaggcacagagaggcaaagcaactacaggaaagtcgccaagctagcaggtggcagagccagggtaaagtgtgtccgacctcagagctgagtcgagagctgtctccaagggaggcctgaccccactacttgggtagagtttgcatctgcagatcaattctttacatgtcatgtttgacagctaagatccattcccaaatgactctgcggtccattcgtttggtagtttctttcagggggctgaggtactcagaatctgaagggtttctatccaagtctgtggagggactagaacttccaggatcacagatttgcctcagtctcctagtttcttccctcagtccatttatggcagaagaaggaacctgcctgggtgctgtagatttgtcctggggtctgagatctccaggaagaaaactctcccttcccccagctcaggcagtgaggtcttcctgtaccatccctgacccgtggtccatctccctgtactgatgggagttttagggatcaattctctgttgctcaattggattgtataattctcctggtcacacctgaatgttaggcctatctgtgcctctcagcccgtcccaagtctttctcttcataattctcaattcctttctttttcccttatcaaggtaacatgccactttattccctcttggcaaattttaccttgttgccctatcttatttggtctatatttgagcaagatatttagaaacatccttcaaaaaaccagttgcgcaacaatatttgctgaaatctaagtttattatgaccttgcagaaggaaaataacagaaatgaaagcacaaaatatggcaaaaaacaggatctgtgaactgtacccctaccataccacacctagttcaacatgttctcattttcttcttcaggttgggggagaacagctgtgactataaatgcctcggaaatgcatagaccccaggtttggctatacgtcctagggaacctcgtctaccctcttgaatctcaatttccccaggaaaaacacgaagctgaattagatgacttctaccatcttagctttacaatctcatctttatgacagtctggaatatcaacagaatccgatgccagcctgcagggatgagggtgttagaagcttaaccgtctcgcacaagtcatcttaccacatggtcagggtagagggactataactaagtcatgtggcttgagatctgcccaagcagatgcgttgtccccttctgccaatgaccaagcacagggatccttcaacctttcctctaagtccagaagataagacagcaacgctctggtcccagcaccgccacaagcctcttttcctctaggggcctcagttttcatagctataaattggggctcacatcagttttctgtcctgcttcacaagactctcataaggctccaaggagactgccccaggcgggagcttgaggaccccccttagggtcgtgagcagtgaaagcccaaatgctgtgtctggcactgctcatcatagtcctctatccagccctcccaccctgcctattctttctcctgcctccaggacaccacgtctcccctttctagtaagtagcgttgatctcattagcagttacaacagttctctgcatctcagagcatggactttaaaaccagataggtgtggcttgagtcttgcctctatcacatgtagtccctagggcttcggaccatttcacttccctgagctgattttgcagctgagtcaaggggataacaatgctgacctcacaacatagtagggagcgctaaatgggacagtgcctgtgagacaccgaattcaaaccctagcacataataggcacatactcatttgagggcttctgctcccatccttctctccggaactcatggtcaggaaaactcagcggtctatatggcgctcactcaaccagtaaagttgccatagggttccattgctatcttatacacctcccacattctgccccaattccatcgtcaagcctcagctcagcccaccaagggcactagcatcatgaccattcacacaagagcaaggcttaccttcttgaaatagtcagcaaggctgtcggggtcccagcccaggacctctgagcgaaagggcacattcctcagtgccatggctgctctcccgggaagaagctcacaagctgagcatgggcgcttcacccatgggcagagaagctcaaatccagagctcggaggcgttcttggctcttccaactcccagctaccctgtggaacacccctgttggagccgatgtcttttctggcgtagccagatcccagaaagcaacggcttcctctgcgaacaaatatggtctcttc

SEQ ID NO: 1845 - DNA, 54858 bp, Homo sapiens
agctatccaataattatttattgaaagaaatgacgggatgaatcccagactccggagtaagccaccccctcacacacacacccctcccctgactctcaaaatccacagcctgccacagcagatttgctaaaaagcaaaggcaataataaccctggggtccgtccaactcatgccctgtacccaggccctaggagggcgagggcttagtaggtatcttcagggtcagagcctgagtcctcgccttgttggttctgaatctgactttgcttccggtacaaacaggccacctgcggagagagggtgggacggggtggtcagaagctccctggctgctcccacctccacaaggttccagagaggccaccacgctaaaaagctggtagggccaagcagctgggcggcccacccctgcttcccaggacctcacctgagcactggtggtggcctgctccggctgcttgtcttcacggactcgaataaaccgagggaagcgaagggagatgcccttgtcactatccacctgcggaagcgggatggagactcctgcggtccagccccagcgaccccctgctcagtctcctccctcctccactctggactgtttcctgatccacatgacggggccgaacgatgggttgtcataaggattaaacaagttgacaaagtgcttggaacagtacccgggcacagtaagtgctcaagaaatgctgcctgttggccgggtgcggtggctcacccctgtaatcccagcactttgggaggccgaggcgggtggatcacgaggtcaggagatggagactatcctggctaacacggtgaaaccccgcctctactaaaaatacaaaaagaaattagccaggtgtggtggcgggcgcctgtagtcccagctactcaggaagctgaggcaggagaatggcgtgaatccgggaggtggggagcttgcagtgagctgagattgcgccactgtactccagcctgggtgacagagcgagactccaactcaaaaaaaaaaaaaaaaaaatgccacctgctacagccgttacgataatgacggtaattcgggctgagaggctgaactacggcgccagggtatgggttctagaatctgactgtgggattccaatcccagctcccaactctcaggagccgcgtgatgcaggggcagttactcaggctctctagggctctacatcctcaccgtaaaatggagatgtttgtgtcactacgtcttacggattttgagaggattaaatgagtgtctatgagtgacacgctgatgaccacacagtgcccactgcacagcaagggctggatacacaccggctcctgtgccttgttactaagggtccctggctgtctaacgtgcagcatggtaaaacatttttaaaaattagatcaaaaatgtaagttcttggctgggcatggtggcccacacctgtaatcccagcactttgggaggccgaggtgggcggattgaggccaggtgtttgtgaccagcctagtcaacatggtgaaaccccgtctctacaggcacgggtcaccatacccagctaatttttctattttttggtagaggtggggtttcaccgtgttggtcaggctggtcttgaactcctgacctcaagtgatctgcctgcctcggcctcccaaagtgctgggattacaggcatgagccactgtgcttgccctgggaattcttttatttaagaaaagaattttcttttctttttttgagacagagtcttgctttgtcacccaggatggagtacagtggtgtgatctcggctcactgcaacctccgcctcccaggttcaagcgattctcctgcctcagcctcctgggtagctgggactacaggcacccgccatcacacatggctaatttttgtatttttggtagagatggggtttcaccatgttggccaggctggccttgaactcctgacctcaagtgatctgcctgcctcggtctcccaaagtgctgggattacaggcacgagcccccatgcccggcccatttttaaagaaaaaatgttttgatctttttatctgacactcaaataaaatgcaagctcatcttcctgatccttacctggaagagcagatgtgagccaaggtcccctccctactctgctctctgtgtgcccgcccagaatcccacacagggccacggccaggtcctctgccactcaccaggccccgcgcagcagggtagatgggagagagggagaggtcagcgcacttcacctcccacacagcgctggggtccagccagtggtcgggaatcacagcgccatctatccgcacgtaagggcgtgggctgggcagcaccagcgcctgcagtgagcagaggaagagaggaacagagggtctggaatctcaaagtcaaggccaagtgttggagggctggggagagggaggaagggaaaaaaacaggcacccccttgaagtaaacagaaataggaagtgaaataagggaaaagaaacaagacacccccttgaagtaaacagaaatagaaagagaaacagaaagtgaaagaagggaaaagaaacaagacccccttgaagtaaaaagttgagaaaggtgggagttgggaggaatgggagatggaaagaaatgaaaggccctgggggctgaggcaggacattaaagacaaaaagaggcagagaaagggccagagacctggaggaaggagacagagacacagtgggacagggacagagatgtagagagagagggcaatggagagagagaaccaaagagtgggacagagatggtgtcagggtccgtgtgtccccacccacatcttgtcttgaatcatagctcccaaaatccccatgtgtcgtggagggacctggtgggaggtaactgaacgatgggggcaggtttttcccgtgctgttctcgtgatagtgaggaagtctcacgagatctgacggctttataaagggcagttcccctgcacacgctctcttgcctggcgccatgtaagatgtgcctttgctcctctttcgccttctgccatgactgtgaggcctccccagccgtgtggaactgtgagtccaggaaacctctctttataaatgatccttttttttttttttttttttttgagacagagtctcactctgtttcccaggctggagtgcaatggcatgatttcagctcactgcaacctctgcatcctgggttcaagcaattcttctgcctcagcctcccaagtagctgggaccacaggcatgcgccaccacgcccggcaagtcttgggttatttcttcatagcagtatgagtatgaaaataaactaatacagatccaatatgtaggacagacactcatgcctgaaatgcctgtgaccatgacaacattcattcacattgatcagggctcacaggcacttcacaaggagcagctatggcacctgctgtgtcctttggctaacccctggtgtgaatgaggcacagggcttggggaggtgaggctgcttgagcagggtcaccagctagtagccggcagtgctgagacatgaacctggagatgctggactccaaagccagctccactgcctgctgccctcctgcccacacctggagccccaagatggtggaagccaagagccctgcatggaaggactgtgctgtcaggggcaggggggagaggggtggaggctgaggcgcagccgccatggctcaccttgaggctctggtgatgctcctccagctcctcatcactgaagccagttccaagctgcagggaggaagcgggaggtcagaggctcagccagccacaggcccagcacttgctcctgccatctaaagctgtgtacactcatggcccccaccccactctggtctacgcagtatccacagaaaaccagggaagtagggagctgggggtgcggagcatccatccagagactcccgggtgggaatgttctcccagcaggcctgccgtgaaccactccctgtcttctgctttatggagaaactcttgctgcttccactgtctccctggccccaggaagtcactcccttatgctcacccacatcctcactgcccagtaactggctgtcctcacttccagtctttttttttttttttttttttttttttgagacagggtgtagctctgttatccaggctggagtgcagtggtgcaatcttggctcactgcaacctccacctcctgggctcaagcaatcctcctgcctcagcctcccaagtagctgggaccacaggcatgcaccaccacgcctggctaattttttaaaaaagtttttgtagaggtggggtctcactatgttgcccaggctggtcccgaactcctgggctcaagtgatcctcccacctcagcctcccaaagtgctgggattacaggcgtgagtggccatgcccagcccatctccaatgttaacactgccaagagcttctttcacctaccaaaataggaaaggctaaaaattagcagtaatgctggatgctggcagatacgcagcaagtgggcaataatcaccaatataaacgtcacctggaaagccccttttgcattgagagtcttaaggattctttttgccttttgtcctgacaatagctcatttaaaaatctattctaaataatgcaaaatggtgacaatgtagattggtggccaaaacatttgtgatttataaaagtcacttctgtcactgatcgtttaggttaacggacactaagtaatcacattacccatcagaacaaagccggcaacaacttccccacacagccacggggagctggttcaggacacagcactatgtgctatggggcacagcacttgaaaactcttgtgcgggcattcaggtcctgttgccatattgcttaagggcatatacaacactgaaaacaaagtacttccagggtaaaaaggcagaaaagaaaattactcatagagaaggatcacaactttgcaaaaatgtaaataaaacattccctcaaatgtcactactgcgtgtctctgggtggtacgattctaggtgatattttgttctgtttctgtggcaaaagacccaaatttgttggagaggggaatataggaaatacgtaagaaaatctagtccaaaatgtgcacagctttaagaaaaactttaacttgaaaaaaagtaaatcactttacatttcccagaattccttgcagctaggggtgagccatggagcaaagtgatgagcaacagaacttgagcagaaggtgttcactggctgaggctgactcagggtccaaccccctttgctcttccctggtgcgtggagcaggcatggccatgagggctggaactcctgcagccacattgtgatgatgaggccagaggcacatggcagaaaaaaaaaatgtggggacaaaaaaaaatgtggggagaggaggaacctgaatccctaatggcatcagactgccccctccacacttctcatttcataacaaaaaaattcttttcttatgtgagccaccactatttgtagctaatctcaatctctcactgacacacattcctgacatctttctatcccagcctgtttttctatatgaagcaagagttgctcatagaaccagaaaaagtaaataaaaactggggagaacggatccttcacagggggatgtgagcacccctcggtctgggttgtgcaataggaaatacccccgggagtctaatctccttccctcctgcttctgccatcagccccagttccccaggaccttgcatatggcctgcagctcctcactgtcctcgtcgtaggaggccagcaggaagcccccgtaccggccggcccgcttcccccggcccaggtaggcgccgatcaccaccaggtccagggtgtcacccacgccatcaaggtagtccttcttcagctgggagaaggggaggcaagagatgagaagggggagcgcccaaggcggggccctcactgctggggaggggctcctcagtggactgaggagggactagaagtaagtctgaagggaacttccagaaggaaccccaaggatggcccctgggaagagactggacatgggaagggtttctaggtttaaataagaacaaatggggccgggcacggtggctcatgcctgtaatcccagcattttgggaggccgaggcgggtggatcacctgaggtcgggagttcgagaccagtctgaccaacatggagaaaccccgtctctattaaaaatacaaaattagccgggcgtggtggcgtgtgcctgtaatcccagctacttgggaggctgaggcaggggaatcgcttgaacccgggaggcggaggttgcagtgagccaagatcgtgccattgcactccagcctgggcaatgagagtgaaactccgtcttaaaataaataaataaataaataagaacaaatgggaaacgcaggcgggatcgatgggacctcaggagtcagccttgccgccgtctttccctcaggacagagacgtggccaactcactctggccactcctccaaagggagagcattttcccattcgttcagaaacgttcactaagtgctaaccatgtgccaggcagaagctcagccctgggggcacaacagtgctatttcctgagacaggaaaggtctgtgctggagggaaaccagccacagacagacataagtacacaggaagagctagtcagcaggcctggccggctcagtgccacaatgcctcccgctccagtccccttgtccacccctcactgcccctctccactcaaacatccatcaactcttactgatgacaggctcctgctcgctggccctcaacacacccgtcctccactcgaggggaaaccccaggagcttcgcacaatgacaacctgtgactcccggcacggaacccccactgacttcctgaaaccttcaagaggaagatccagttttatctcacagtggccccaggtgctgcctcatctggggcctgctccccactctgagctcacctcccgcctcgcctgcccttgctccctgcacacgcagaggctgctcctccctcagggtctctgcaccgggggttttcctccctagtgctctgtccctcactttgggaaagactcttcctgatcatccggggcactcccagccccgccttgctggcccggagctgacttgcttttcttcatggcgcccactcctgcctgactttctcttattcatgtcctggcttaattcctgcccaagagcctggcccgacacgggcggcaggctcaggagagagacacctcatcacgctgcacctcgtgggatgtgcggtgcttgggctggggctgttctccatcagaactcgtgagcaagggctcgcagcagggagaaggtctgaactcagttgcagcagggggctggggtgggattgtgaaaaggggccctgagctcagacagggtacacagtggaggctcgaaatccactgcctagctgggacagacctccagacccggggtggagaaggcccagttgggggtcgagaatcaccttgagccagttgtgcgatctcttggcgatctcgtaggtggcatcaacatccagggtcttcaccatcagcccctcgcaggagtctgagggagacacagaagcgtggtccttgggaagccctggctcacaagcgccggagcaggcaggattctggtcaaacggtccaggactggggacaggctgggaggccggggtcagcgcaagctgcagacctcaggagagaaaagtgagcaccctcacctttcactgactgctccaggaactcggcgatctgctcgatgtccttggtgtccagggaggtggcgaagacaaactcgccctctgtctccacaaagttctcccggagcagctgccggcgccgggaaaggggctcacgtaccagggactgcagggccggcagggagaagagagatgagacatctttgtgagaataaagacaataagccctaaatgtgaggcgaacaggacatgtgcgggtcacaactagtgacagggttcgtggaaagccttgagagggaagaaccctgatgtcagaaggattctgagagcttaaagcatggggctagtcactggcaagagggcccgacaccatttagagtcggtgacttcaggagcatcagacggggggctgcggccttgctggagcttgaattaacactttacgggcatctcatcagttttgttttttgtttttgtttttttgagacggaatctcgctctgtcgcccaggctggagtgcggtggtgcgatcttggctgactgcagcctccgcctcctgaattcaagcgactgtcttgcgtcggcctcccgagtagctgggactacaggtgcacatcacaagagatccacccacctcagcctcccaaagtgttgggattacaggcgtgagccactgcatccagcctcatccccaagataattaaaaaaaaaaaaaaaagtcctcctttccttagaattccaaaagttttcactgagtttttccagcacatttacagttttgtgttttgctttgaaatcagttccagctggaccttgcaagagtgtgtgtcagagaggaaggaggtgatctgagtgtttttaaacaaaggacaaagcagttgtctccacatgtcaacactgactaatccgtcttgtggctttgaattgcttttctcttttgttcgatcggtccccacccacgcgcagtgtttctggtctgccctttgctcagggcttctctgtgatgatgttaaactaccttcaccacttgccctccagggggacattcacgtgttttccatggacagcttttttctgttgtaaaattgtgctcatgaacattttgtatgaaaagatgagagagaggagccacaagggttaagcaggtacaatttatctggggtcagaccatttcaggtttacatcccagccacacgcttcctagctggtgacttcaggcaagcgtttccctctgtgtacctcagagctcccatctgtaaaatgcagcaatacctactcagggcacgtctgggaagatcagctgagcccgtgctacccagtgtagccgccaccagccatgtgtagcaattgagcccttgaaatgtagcaagttcaatcggagatgtgccaagggcaaaacagtcactggctttagaagacttaatccaagaaaagagtgtaaaattccatgttaataatttcttatattcatcacacattgaaaggataatatcttagacattggattaaagaaaatatgattttatctgtttcttcttaccttttaatatggctactagaagctctaaaattagaaatgtaggctactgcagtggctcatgcctgtaatctcagcgctttggaaagcggaggtgggtggatcacctgaggtcaggagttcaacatcagcctggccaacatggtgaaaccccgactctactaaaaatgcacaaattagctgggtgtggtggtgggtgcctgtaatcccagctacttgggaggctgacgcaggagaatcacttgaacgccagaggcggaggctgcagtgagccaagatcacaccactgcactccagcctgggcgacagagactgtgtctcaaaaaaaaaaaaaaaatcatggggatgaggacacattaaacagaaaaaaaatgatatacttgactacataaaaatagttcatccatgttcaactactactaataaaaaaatttgtaaaagtaatagctcaaacaagtcctatacaacaaaataggccatcaataaattttaaagaaggaatatttgaaggaatgagaagaaatatttgaaatgctcatgggagacaaaggaaccagctgagcagggatgatcaaatcctgcagaaaaacccacaaagtatccagtgtttggaaagcacctgatacttgactttcctctccccagacatcacgggaaacaaaaatcagactctgactgtcttcctacagtaatttcatgtagtgaaacatcagtctgcatcatgaaattgggggtttgagcatcaaaggcatctctgcattagaaccactaccagctccacctgtcccggcgaaggacagatgggcctaacggagaaaaaacgtttacagaccaggaagacatgagtgagaacccaccagacaggcaggcaaaagacacgcggaggcaagtcacggaacaaatgcacgcggccaacaaacctgaaaagatgattgatcatcaatatccattaataagacagaagtgaccaagttaccacaagatcgtggttcatctaccagatgatcatctgggatgggccgggcgtggtggctcacgcctgtaaatcccagcactttgggaggctgaggtgggcagatcacgatgtcaggagatcaagaccatcctggccaacatggtgaaacaccgtctctactaaaatacaaaaaattcgccaggcgtggtggtgcacgcctgtaatcccagctactcgggaggctgaggcaggggaatcgcttgaccccaggaggcggaggttgcagtgagctgagatcatgccactgcactccagcctgggcaacagagtgagactccatctcaaaaaaaaaaaaaaaaaaagattatctgggatattgatgattgcagctaattttttttgagagcttccatgtactaactactgagttccacacccctatcccactgtttagccctcaccctaacagataaagcacctgccactgttagctccttactgtagatcaagaaactgacacacagagaggctgagtcattcatctgtagccatgccgctaggaaggttagggctgggatatgacggcatgtggcctggctccagattcctgacatcctaaagcaagctgttctcaaactgttgtcttgaggcctctttaacactcttaaaaattattcaaggccaggcgtggtggttcacgcctgtaatcccagcacttcaggaggccaaggtgggcagatcacctgaggtcaagagttcgagaccagcctggccaacatggtgaaaccccgtctctactaaaaatacaaaaattagctggacctggtggtgcacatctgtaatcccagctacttgggaggctgaggcaggagaatcacttgaacctgggaggaggcagttgtagtgagctgagatctcaccactgcactccagcctgggtgactgagcaagactcttatctcaaaaaaaaaaaaaaaaattcaagactcactccatagagcttgttcatgtgggttacataatattatagttacacctattagaaatttaaaatgagaaattaaaaaaataaatccaatatgctcacccaaataatattaattttttttttttttttgaatagacacaaggtcttttctatattgcccaggctggtcttgaactactgggctcaagcgatcctcccacctcccaaagtgctctgattacaggcgtgaaccacagtgcctggctctaaataacatattttgatgaaacataacccaagttttgagaaagtggtgagactagaggcattattttacacttttgcaaatcctctaatatctggcttaacagaggctggattctcctgcgtgcttctacgacacactcttctcgttgcaggacctgaggaagatccacctcacgccaatgtggagttggaaagagagggaccttgaagatgtccttgaaagaatcttaaggaacctcaggggtcctcagaccacactttgagaactgctgcccaagtgtggcttcctggccatgtgaagtggcagagtcggaaatggaagtcagaggggcagctgccaggctcacaccccaccccgtcacccctcagctgcccctggacaggaagctggaactcacctctccattgaggtagatgaggtcgaaggcgtacaaacacacctgcacctggatctcagacgcatccacctcctgggttggggcacaacggagttcgtgagtgcaggaaggtgagacggggcactgtgcctgaggccgacagcattcatctaccggtctccctctcgccccacctaactggctgcccatctgtgagggcggccatgctgctggctccaggtgctggatcgttaacggctctcagctaattccgacaacctcattccccttcaccagatatttgctctcctagacttttctgcagctaatggcagtgacatggcacagttctggccaatgagatggaaaaggggaaacctgtggggtgcaggttgtggggttttccagaacagatcttctttcatagtaaaacaacagagatgcccgaaaagggcccttcccctcttcctacttgggatgctgggatgagaatgcgatggctggagctgtggcagccattctgcagaaggctgagagaagtgcatccagactgacactctgcccttctgggcactgggcaggacccacagccaggactgggtggaagatgaggaagtacggggccttggcaggcagtggagcgggtgatgctaccttgcgtttgcgggtggtgagcacttggaatggctggatctgcttcttttcccggtcccaagccacggcttcggtgtccaggatgaaggatgtgaccgatgggagtttaatctgaaaagtgaagggagagacccagggcctgagagaggtggaagatgaggtggaaagacaaacacggggagataaattcccttttccttctgcagctctcaagatgcactaacaaagaggcaggtgcacacagatgcttttcttttattccccaccaagaggagacagaaactaatgtctctgagaatgtaatatttggtctcacaagctggaaacctaggagctcttgtcatctccctcctcctgtcacccacattcagttcctcagtgaacctgatgatttcctaagccgtccacttcccaccaactccctgctcagcctcgcctactgggcttccctgtcctgcaccgatcccctccaatccagcttccccatagcagccagggtgacactggcaagccccaaatccgatcacagcacctccctgctaaaaaccatccccatgattccccaaagctggggggactctcccgggtcagcctgggtcgtccctcgcctcacctggccccctgagcctctcttcaccccagcacgtgagcctctctgtttctcaaataagtgggcaatgcctcttccactactgggcctttgcatgtgccgttccctctagaacccctgcccctgtctgtctcctccactggcaagccttcttttccctcaagggaacactgttgcccaagccgggggcagcattcatgttgtatcctggagccaggtagcttccctgacaccaagtctaagccacacctatttctttttgagtcagagtctagctctgtcgcccaggctgcagtgcagtggtgcgatcttggctcactgcaacctctgcctcccaggctcaagcaattctcctgcctcagcctcccgagtagctgggattacaggcacatgccaccatgcctggataaattttgtattttagtagaaacggtttcaccatgttggccaggctggtctcgaactcctgaccgcaagtgatctgcctgctttggcctcccaaagtgctgggattataggcgtgagccaccacgcctggcctcttttcttttttgagacagtctcccactgttgtccagcctggcgtgcagtggtgcaatctccgctcagtgcagcctctgcctcccacgttcaagtgattctcctgcctcagcctcccaagtagctgggactacaagagcacgccaccacatccagctaatttctgtatttttagtagtcagggtttcaccatgttggccaggctggtctcgaactcctaacctcaagtgattcacccgccttgccctcccaaagtgctgggattacaggagccactgtcaccggccaggcctgtttgttacataggctcacagaatgctggtcctttcctgtggagcccggatctccacatataatttacagagccagctgcaggactctctggtgaaggtctgcctgctctgctgggctgtgagctcagtgagggcagagaccatggcaggcctgttacactcccagcctccagcatggggcctagctcggagcagatgcccagtaaatacttgctgaacgaatgagcaaaagcagccagatgcaagagactagtgccatattataccaccaacaggaagctctagaacaggtaaaaccaacctgtggcgaccaaaaagcagacctggggttgcctctggtggatgcatggtgttggacagaggagggggccttgcttggccagggacacaaggaaatatttgattttttatttttatttttttgagatggagtcttactgtcacccaggctagagtacagtggcccgatctcagctcactgcaacctccgcctcctgggtacaaacgattctcgtgcctcagcctcccaagtagctgggactacaggtgcgtgccaccacacccagctaatttttgtatttttagtagagatgggatttcaccatgtcagccaggctggtcttgaactcctgacctcaggtgatccacccgcctcagcctcccaaagtgctgggattacaggcgtgggccactgcgcccagcggaaatatgttagaatgatgagaatgtggaaatattttatacattcattggggtgtcggttacttgggtgtatgaacttttcaaaactcatcaaacagcatagtgcacactgaaaatcactaacttttagggaaattacatcttaagaaaattgatttaaagaacagtgcttggcacggaacaggagctcccctaacacgtgcactgaactgtgcctctctctgtcactgtctctaacaggcagaatgatgggcaccgtgccccctgctttcttaaataacttatttcctatttaattaggggcaggcaaagagaaaggctctttgataggggactcctcgaacaggcacgagacccctactgggtgcagagaagtccccaactctggggcctgtgaggcccagccctgtatgactctgagctgctatttctgaggcttggggcctatccacaggctggccccctccaaactcgtcctgactcctcctccccgcgttcctggctggagaggctgcagagttagactctggctttccgaggctttgttgcactagggtggccatggaacccagtgctggacagtgactcccagctgcagtccacggcgggggaggggttgtgggtgggaggtgtccaggaaagtgttaactcaagctagaatcccttttccctctttctgtctggaagaatgacatctgtttgggaaactctaaggggacaagcattggcactaaaagccaaccagccaaggacagcaggggatagaggtagcgataagcttggttcagggggacatcagtgctcagccaagtcggtgctggggtgcccacctctagatgtgagaaaaaatcatatgggcttacaccacgcaggactgagtgctctgtcatttgcagccaaacgcaacctgatctcctcccaataaaccccgcactgtgccacactggcctagatgggcctcaggcctttgcacccctgaccacagaccctggcagagtgcaagtgtgtggcagacgcccaccttggggatgcggctgatgatgtccgggtacttcccagtgttgtcttcctgattcctgctgaagatcttcacctccccgccttccagggcgtggatctgtcacgatgggagaagggaggggaaatcagctgagtcccctcatgtggcctcagctttctcttctgaccccacctgcactggtagaaggttctggaagctctggaggaggaactggtgcagagacttgagcgaatcatctcctcagttccaacagcacctcccagccctgctctggaaggccctaccatcattttcttcttcatttccaatccctacacctctccccatgtaggcacatgcaccttgctgcatgtgggtgctgatttgtttaaatgtcattatgctctagatctcattctgatttttttttgaggcggagtctcgcccaggctggagagcagtggtgcaatctctgctcaatgcaacctccacctcccgggttcaagagagccttccgcctcagcctcccaaggagctgggattacaggcgcccaccaccacacctggctaatttttgtatttttagtagagccaggctggtcttgaactttcgacctcaggtgatccgcccaccttagcctcccaaagtgctgggattacaggcgtgagccactgcgcccagcctctatgtctatttattttaagacagtccggtcacagcccttgagcagggcggcatatatagcatcttatatgtttgttattatttccaggaacagttgtcaagaaatcattgtcactatcgtaaatcatcttgtgtcttttttctcaacactattttggagatccatctctgatcctgtgtctgttggatccaccctttttttttttttttttttaaaagatggagtctcactcttatcgtggaggctgtagtgtagtggcacgatcttggctcactgcaccctctgcctcctgggttcaagcaattctcctgcctcagcctcccgagtagctgggactacaggcacacgccaccacactggctcatttttgtggttttagtagagatggggtttcaccatgttggccaggctggtctcctcaggggtccacttcctgtaactgccccgagccctgtggctcccacccactttgcctgcttacctatccccaggtgagaaggccccacacttgccaggacagaagagacacaacacattcttacagaccccaggaccaaggacgcctgaggccctggatcacaggacacacatgcacgtcacggcatgaaggggtcatgtaggcacctcccagaacggctgttaaaatgaacacacccaccagcagcatcagcggagcccacgtttcatgagctcccactatcatcggtcaggactctggaggattgtagcttcggataagctggtgaggtagttaagaccacaccctagaggccaggcacgatggttcatgcctgtaatcccagcactttgggaggctgaggtgggtggatcatgaggtcaagagatcgagaccatcttggccaacatggtgaaacctcgtctctactaaaaatacaaaaaattagccgggcacggtagcgggcgcctgtagtcccagctacttgggaggctgaggcaggagaatcacttgaagccaggaggtggaggttacagtgagccaagatcatgccaatgcactccagcctggatgacagagtgagactctgtctcaaaaaaaaaaaaaaaaaaaaaaaaaaagaacacactcactgcatggaggtggatgctgaagcccagagagatgagcgagggctcggcagtctgtggcgcaggccggcttgaagctcaggcctcagtgaccccacacccctgctctttgacgttttcctgtctgtggaagggacatgtcccactccccatacctgtgccctctgcccgtcatatttgtattcgcaggtgaaagctgcctcctcaaagcgtttcaggacctcgctgatgccccgggtgggatgggccaacattggtttcaggggaatccctgggaaaggaggagagtgagttagaggagagggaaggcaatggattagagggggaacatggagaggagaactgctaatgggccccaggaccattctgctttcttgctattcagtcacgaagcctcccacgttttagaaggggacctagcctcccactggggactacagcccccggccttccttccaggtgggaaaggccatgtgattggaacccacgcagcatgtgcaatgtctggctcacatccttgcaaggaatctggttgcctcccctccctcctctgcgtccctcctcccacaattagaacagggaagtgagccacatttgatcacagacattggggtgacaacctttggagggcagagggacacaggaacctgggtccccgggtcatccctgggacacagctgcacacctgtaccttccctggccacctcccttgctctggacacttctgtgtgacagaaagaaattctatctggcctgacccactgccttctggcccatttttatttacttatttattgtctcactctgtcgcccagctggagtgcagtagcgcgatgacggctcactgcagccttgaactcctgggctcaagcgatcctcccacctcagcctcccgagtagctgggatcacaggcacacgccaccacgcccggctcctgtttatcacagcagtgtcacctacaccctatctactccacaaggggaaattccaaggagaaaagcagtgggtttcagcaccagggaggagcatttggttttggtgggggagaggactctgcaagttctgagaggggcgcctacgatggccaccctcacgccgactcaggagggagcagggctgctgccaggctggtgagcgcccctggggcctgtacctgggctcagcttgcagtgctccgggagacgttccaggccgtgctccagcagcacggggataattcggtccaggtcgggaacctcgctggggtggcgggtgagaacaagataggggaagcctttctagaactcacacagtttggaaagagagctcggcctgctcccagaagcctgggctcctggatgcctctgcccactgagtcaccacctgccaagctcctcttgccaccctgtctctgtgctctcccttcgtgtcactatctgttgctttgtctcccttagtctggccttgcccctgttccctatctgtcaccacgagaccagcgattctctactcggctacacaggagaccactcaagaatacagtttttaaaaaaaggtttttggccgggcatggtggctcatgcctacaggcatgtaatcccagcactttgggaggccgaggtgggtgcatcacttgagcccaggagttcaagaccagcctagccaacatggtgaaatcccatctttactaaaaatataaaagttagctgggggtggtggcacgcgcctgtagtcccagctactcaggagactgaggcaggagaatcacttgaaccctggaggcggaagttgcagtgagctgagattgtgctgctgcactccagcctggatgacagggcgagactccgtctcaaacaaaataaaaatagacaaaggttttcaaggctaggttccacctacaaagattttgatgtagctggtgtggggtaggcctgaggtcagcagctgatagagccccacgtgcaggcagagttgagcttgctgcccgggcctgttcaccactctctgctcagcacccagtggggggccctggcccagagcaggtgctctgaggccatctgtggaactgccatcggccctcctgcctctgacatcctctctggggcagtcatgatcttggagtcaccagccctgggtcagctgctggcctaggtccctccacatggctctctctggagccctcgtggccgctccacggatgtcctctccatgactgtcaagacccttcaccatgtgtcagtcacctgctcctctctgggtcccttaaggcctttctgcatgcacagccctgtctggcactcagaaacctcatgttgccggctgccctcccttgctgtcagcgtctttcttttttttaagacagtctcactctgttgcccaggctggaacgcagtggcgtgatctcagctcactgcagcctccaactcctgggttcaaatgattcttgtgcctcagtttcccaagtagctgggattacaggctaatttttgtatttttagtagagacagggtttcaccatgttggccaggctggtctcaaactcctgacctcaagtgatctgcctgcttcaggctcccaagtgctgggattacaggcgtgagccactgtgcctggccgctgccagcgtctttctatacctctcctggggtcactgacccttcactgtttgccaccttcctgatctttgtcaccatccttgtgtcaagcaccagccttgtctagatcaccacctctgctctcagtcaccccgtgaccggcactcgtgatgcctgtccgtcacttcactggccccacccactgctcctctggctccacccccaccctggcactctgcccacagcccctggcaactccacccactgcccagctctcaccagaacgtctgcttcaggatcatgccttgctcctccagccacgtctttctggcctctgctgtcttgcccttcccagcatccaccatggctggtgggaattctaagaaaagacccaccagaggctttggaaggcacccacatccttggctacaccagggtgcagtgggtggtttgctgtatggcaaggaatgcagatgccgcggcccaagacgccccctcccccccacccaggagagaggagcctggtatggcaggggcccgctggggaaggggcgggcatgggcctctgaagaggaggggggaagcctgaggtaactccagcgagggatgcagagacgggccacaggagctcaccttggcccgggggcgtgaggctcactgcctgggagagggcagccagcaccgactgctctgccagcccaaggcgcagccgtccgctcagggacctggggagagagcaggccagggaagggggcttgtctgcacctccccaatcttgcctcctcccttctctgatctcctcgaccttgatgtatgtagaccctctcctcaaaaaccagaagaatcttcagagcctggaagggaccccagatatcacacagccccatgtgacagatgaggaaactgagccaggcagtaatgatcctgcccactagcatagactggggaggggcacaagtaggtgcaccagcacctcccatctcagctgccctgaggggttggcgaggcttgaggaggatgagtcagggagagaactgagcctggcgcccgccctggtgactgtaatggtcaggaccccagcatggtccttgctttgagccagtggcaggagacaagtggcttagtttgcctccccatgtctccatttccccttctataaactggaggtgagggtaacaagaccagtctcacagagttgctggtaggaactgatgaggtaaggcacggggcacagggcagggctcccaagaaatgctccatgatgtgagccctcaatggatttgctctcactgtcatggcaaacaaaccctggcttcctgctgcagggcccgcgcccaagccgaggcagacctcaccaatcaatcacagcatgcttcacccacaggggcccaggggccttctctagacagcactaccaagggacagaagctggcctgtgaaaggaaatggtgtcccttcccactctttaggggctgggcctcctgctcatgcttttctcatccaaggatggtcagggcatttgtgatgattccagctgccagtccctccctcctttcacctccgagcctgcagtccccctctgtagcctcacaggcccacacgcttacctagcgatgaaccgggcttctgagtggcggcaggccacaaagaggcctttgatgatgtctatcttcttggctgtggactggagagtcaggggaagagccgtcagtgcctggtgaaggcagggaccacacctccaccccaccagccgtgctgctgccctgcattttggaatacctgccctccttccctcaccccatccccatgtcccagctcccatggccgcccactcttagggcagtaagaacgagctagctctcctccttgcctccctctccctttatccaggaagtatttactgagtcctgtcatgtggcagccatggcattaggtctgctagactctgaagaggagactcccctaggattgggtgcaggaaggaggagaggaagctgtgcaccccatgagaaggactgatgcgacccagctgatggtctacccagaagccttcctgacacacgcgtggcctcaggtccccaagatgtctggggtccgggatgagcggcccgccccactcacagcactgccagtgagcctggcgatgtcgcggaacttgctgaagaccccggaggcagtgagcggaggtggtggcagcatgagcctctgggtgctgcggctgttctcggccaccagccccacgtcgcctttctcggctgcctcagcccggacggactccagctgccgaccttcaggggagagcgcgggtgggggtgtcgagggtgacagttgtggctgcgtgtctcccttctctcgcggcctggatgaattttctccagctgtgtgtgcttgtggcgagtccctgcacctccctgtgtctaacgctcacccacttggtagaaatggcttggggaacgtgcccccagccacgctggctgtaggaagtcagcaaacatgcacgtggagccaggaaagcggtggatgaacgagcatgaccacactcaggggagacatctgggccggtgtcatcagggcgcggatgggatttaaagccacaggcgggacaaggtcactagggaagtgagtgtggacagagcagagaaggccaagggaccctttcctctggcgggtcatgaacatctctggcagtgaccaaagacccttcggcttgttttggagccaccagcttacacacgtgggatgtgctctggccccacttactgtccagagctgggtcccatgggcgcctgggtgtaagagctggggagatggagcctcaagtcacggtgacagctgtgacaagcagctctcaacctatcagaaccaacacacccttgtcaccagatactgtgtgtcacctcttttctggtctgaaataaaatgtggagataacataacctgcctacacctatcgagataacgccctaaccctaacacagaaaagaatgaaagggaaagcaatccgtaatgaacgaacaagtgcgcgtttcagtccacagatgctcagccgcggcacagagcacatgaaggtgggcctcgcgcctgaagcgaaactgccacaaatgggagagccgacagtgtgagcctcaccaatgggatgttatcgaatcacacatcaaaggggacgggattctccaaagtggccaacaactcacaacaaacccgggacttggacagccacgggggccacaaggcggcacggagagcagtgtgagtgtgaacacgacccatcaagggtggaggcatgagacagtggaagaggccccagctgccatggattgttgggcaggaaagccagcatctgcaacttcttttgtgagaaaaacagatccttctttgtccaagccaatgtagttgggttttctgttacctgcagctcagagtattcttaaccgaccccgtgtgtgctgggtctggtatgacgtcagtgctcccgaaacacatcttgagtgaatgagtgagaaaatcttgagtctcatctcctctggctcccataagcccgtaactctttcctgatccaagtcaacctttctcagtccctctgtcctctcatgaaagcctgaaacccctgccttccctaaatgttggtgcccatggccctaagccagctccagtgctcccagcacatcctctccccaggcggatgagaacccaccagtgggtggtcatccctcctacactgaccagcccgaaccctgggctctgagccagacctggtgagcctcagacccgtttccaaacttcctggatggccctgggggcccacagatagaggttgctcatgcctgccccacgctggggtgattaatgccccctgcaggtgcctgcccctcaccagggtcccaagctgccgacggctttgtcatccatccagtcacccagggagatcctggaggcattcctcctgcctcctcaccctgacatccactgtctgccagatctctcctgccctcttctctcttctctacagctggggtccagctcctcttccccctggatgctgccccttgcctgctcacaatccttccatggctccccagtgtcctcatgataagcaccgagcactccaggcccttggcaggcgggccatccgcatcaccagcctttccacccagcactggcggctgggccccttcaggctgctggccccccacacaccatgttctttcctcccactccttccaatccctccagtcaaagtcctttcagacctctctaagccccaaccttccatctcagcccccaaatcctgctgtctctgcctccagcatctttccccagccctccccttccctgcaccccacaccccctgtcccagcacatgcctggtcctccctcacctgaactgctgcccctgtgttctctcccacacccctgcaaatctgtccccatcaggctctcctccctctcagccttctcctcaaccctgtttcacagcctctctccaccatctctccgatccacctgacctctgcattttctctggctgagctcctgtccttctggtccctccaaccacagtcccccttacctgtggcctgggccactgccttgagaaggacaccatcacccacgccaagctccaggccctgctggggtggcccaaggtggttgaggctgaggtagaggacagggaggaggtctggaggcgacagggccaccacggagcgcagcaagttgctcagcgtctccaccatccggagcctggaggaggggacgggggtatgaacacgtggttcctcaaggtcaaagtgtggtgtcggggtggggtgggtttaagggggtggacactagaaagaaatggagaaagaagaggaaagggctcagaacagtcccaggctctggggcctggagccatgaggacaatcacagattgctggaggtgaaaccgcctttgcaaaaccgtaactgaggaaattatgacagtggaaagaaatcacacctaaccgattccatcttgcttctaacctttaagctgtccttgttcagtcctgggcataggcagaactaactttgggaaggaatttggttcgtggcttgactctgaaacgaaattggtaatagccctttctggaaaagacccctttttgcctaaggacctgccttcgcaagactcacaaattagctacaagattagaaatttaggtttaggggtcacgcagcctctggcttccccgattgctcctggggataacatcactactgtaaaacctaagatgagtgcttaagatagtttgcagaccctgcactcagtctgacgccacccagactgtaatctggctcaacaagttctgccatcccacccaggaacagaagacagcaagaaaacctcccttcgaccccctgtgagtccatcttcaacctgaccaatcagcactccccacttaccaagcccctacacgccaaattatctttaaaaactctgctccccacatgctcagggagactgatttgagtaaaaatgaaactccggtctcccgcacagccagctctgcgggaatgactctttctccactgcagttcccccgtctagataaatcggctctgtctaggcagcgggcaaggtgaacccaccggacggttacagtgggggagtaacttggtgtgacggtaacaatgatgaagatggtgatgatcagcccagagaaacgacagctgatgctacggagcattttctaaattcaggagctggctttgagcactttgcaccttttttttgagacggagtctcgctccatcgcccaaggtagagtgcagtggcacgatctcggctcgctgcaacctccaccttgtgggttcaggtgattctcctccggagtagccgggactaccggtgcgcaccaccatgcccggctaattttttttaatttttagtagagacggggtttcaacgtgttggtcaggctggtctcgaactcctgacctcaaatgatccgcccgcctcggcctcccaaagtgctgggattacaggcgtgagccaacacggccagccctttgcaccttttaactcatagaatcttcacagctcccctctgaggtaggtaccattattatttccattttacggataaagaaacagaggcaccgaaagagtccgtggcttgcccaaggtcacagagcgagtaagtatgaagctgagatgtacaccaaggccgtgtgcctgaggactgtgctcccagccaccaagctgcaccacctctaaaacgaaaaccgtgtttctgtctaaaacttcaaagctggaaagaatggctttgttactgaaaaacttagggggcctcattagaaacagaagctgggtttttcctacagaagtctcattaccgaggtttttaaggtgcagagaagaaatacaaaaaccaacatcagggaaatccctcagtaatcattgtaggcaaaagccaccattggatggtgcagtggatggaacagcccccccaaaattcaggtccactcagagcctcacaacatgacctcatttggaaagaaggtctttgcggatgtacctgtagattaagatgagagcatagtgaatgaaggtaggctctgaatccaaaaagcatccttacaaaatacagaagagggccgggtgtggtggctcaggcctgtaatcccagcattttgggaggccgaggcgggccgatcacttgaggtcaggagttcaagaccagcctggccaacatagtgaaaccccatctctattacaaatacaaaattagggccgggcgcggtggctcacacctgtaatcccagcactttgggaggcggaggtgggcggatcacgaggtcaggagatcaagatcttcctggctaacacagtgaaaccccatctctactaaaaacacacacacaaaaaattagttgggcatggtggcaggtgcctgtagtcccagctactcgggaggctgaggcaggagaatggtgtgaacctgggaggcggagctgcaagtgagccgagattgcgccactgcactccagcctgggcaacagagcaagactccatctcaaaaaaaaaaaaaaacagagtgctgggaacagcctgaaatgctccactcatgttggggaactgagaaatggcatgtgccatgtgagaacgaagggacactacagagcagtcacaacaggctcgaaccactcaaccaacatggacacatgtggaaacgggtttgatagtgaaggcaagcagaatgagccgtacccatgataattttgtttgtttgtttttgagacagagtctcactctgtcacccaggctggagtgtaatagcgtgatctcggctcactgcaatctctgcctcctgggttcaagtgattctcgtacctcagcctcctgagtagccgggattacaggcacccgccaccatgctgggctaattttgtgtttttagtagagatggggtttcaccatgttggccaggctggtcttgaactcctgacctcaggtgatccacccaccttggcctcccgatgtgctggaattaaggcatgagccactgcacccagcctccatgataatatttatataaactaaatacacaggggcgagtgctgggggtgaggaggacaaggagagaagaggaaatggggacagagaagggggctggcagggaccagcgatgctaacatgctgctgagaaggaccagggtggggcagtgctatgcactgggcatcactggggtgggacgctctgcagggaacctctgtgaatgagtagggggtcctcgctataactgagacctcaccttcttttgtgaatatggagacatgtaagcaagactgaagtcacttttgatgactcagggtggactagaagtaatcacggactgtgtgcaatggtgccagtcatcccgagatggagcctgtctccttaccctgcacatctgggctcgccccttgtgtcttgctctgaccatgagaatgaggcagaaagtcaagaggacctgcagccgcttttgtgaccatgtctgacatccatgatcatacgcccgagcggggtcagaggccaagttgacagggtttggcggaacaaggcagcacagaccgccatgcagaggacagacccagaagcgaccccgccccccacccaggcagtcctcattagttaccgagcagacacctcctcgatcttctcaaacgtccgggccacagccaggtaaggaaccctagggaaggaaaagagacgcaagagtgacagtggtgcaggctataccatgctgcccgtctgcacccttgcttcctcacgcctcctcgggacacccttgccaatacccaaatgcatgagctcacttcccagggctgcctctctgtccctttcaatgctgctgattgtcgccaaaacacaggagggagagacttgaccatttctcccaaccaagactctgcttagagagcctccggtggcaacagggaccggagggggacagtctgaaaagggagaaacctcacttctggcccggtttccagcaggcatcttccacgggatgatagttgttcttggcaggattgtaaccagatggatccaggggtctacggaggcaaaacggagattgaattgcatagagccctgggtcaaagcaaagtcattccttccaactgtgatgtgccaggctctgttcaaggcacacggtgcagagctggatgaaaacaaagtttgctaacctggagctcacattccagcaggagagtcagaggaaagtgggcaaaaagcccccacataaacacatcattaattttaggtgttaaaaaaatctttcagaaaacaaaagaaagccgagtagaggaagaggatgagatgagggtgctgcttcacagggtggtcagggaaggccggagacatctgggcagaatgagggaggggttagcacagtgggcagcaggggacgagcattccaggcagagagaatagcgtgtgcaaaggcgctgaggtgcagacaaacttgagaaacagaaaagggattgcgtagctgagctgggacagagggaggtgcgtatagtcccgggtgtcgcaaagtgccaggtgccatgctaacaccacatcgattaacaatcagacatgggaggaagggacctttccttttttcttgagacagagtctcactctgttgcccaggctggagtgcagtggcatgatctcggctcgctgcaacctctgcctcctggcttcaagtgattcttctgcctcagcctcccaagtaactgggattacaggcgtacacgaccacacctggctgatttttttgtattttcagaagagacgaggtttcaccatgttcgctaggctgattttgaactcctgacctcaaatgatctgcctgccttggcctcccaaagtgctaggattataggcgtgagccaccgtgcctggccagaagggacctttctaacttccttttccggataaggaaactggggcacagagtgattaactcacccatggccacacagctggtaagcagcgcagctctagagacagttcccaacctctatttttttttgagacagggtctcactgtcgcccaggctagagtgcagtggagcaatgcgcactgcagcctcaacctccagggctcaagggattctcctacctcagcttcttgagtagctaggactacaggtgcaagcaaccatgcccgactgatctttgtagagatggggttttgccgtgttgcacacgctggtgtctcactcctggacttaagcgatcctcccacctcgacctcccaaagtcctgggattataggcatgagccactgcgcccggcctcaacctttatatcgtaagtagctcacactgaccccagccaaactctgcattcagactcatctgggttccaatctgctctgccccggccagctgtacctgctgaggaagcagcttcccctctctgaaccacagcatctccatctgtctggggagctaaggggtccctactatgacaggttgtcctgaaggttacataaaaaatgacagtgagggttcccactcctgggtgcacttcatggaacaatgaggactccccagccccaggcctacatctgtaccaaaatggggacaagggttgggggggagaaagagacctcaggatatttttcagctcttcagctgattctgatgctcacacagggcatggatggccaagacagatagtgccactgcagggctgtgcatggcctttggtatgaacttggggtttaacaagcggtggccggcattacaatgaggcagcagagtgtggtgggcaggggagtctagagccagtcagcctggctagaaccacaatgctgccactccccacctgtgtggcctgagcatggcattaaaaacaaataagaatagtagcagcagttaccgtgacaacatgctggtcataatcaaggccagaccctgggctaagtgtttcacatcctcagaagagagacacagaaaggctaagtcacttcctcaaggtcacacagctgagagaggtggagctgggattcctagccagtcctcaatactgtcccacctccccgctttacttttctcacccaggaaaccaggataacaacagaatctactcccagcagtgttgtgaggatttggagcattgcgtcagggaaagcccgttgctgagtgcctggcacgtggggaagagtgggtggaagaacatgcttcctctcatcactgtgcccccatctgagaggtgaggaaattggagagtgggaaagtttgcctgtctcttggaggcagccattggagacagaggggaagtgaccaggctaggaatggtgcaagaaaagcagtcatgcctggcgtggtggctcacgcctgtaatcccagcactttgggaggccgaggcaggcagatcactgaggtcgggagtttgagaccaacctggccaacatggagaaattaaaggggtttggaataatccctgctgttcagcagaaaggacaggtgggttaaaaagtatgacgcagtgagtccaaaatctctttgatgtcatgcctctacaaatgaaacagataacgacaagaaattctttcagctttaacatttcatgattaaagtttaagtctaacaaaaaagtgtctgtctctattaaaaatacaaaagtagccgggcatggtggcgcatgcctgtaatcccagctacctgggaggctgaggcaggagaatcacttgaacccgggaggtggaggtcgcggtgagctgaaatcgtgccactgcactccagcctgggcagcaagagcaaaactccgtctcaaaagaaagaaaagcagtcgtagtatcacttgaaatagaaaacagaactttatatacagtaggacactgattttatttggaaaacatatttataaatacacaaacacggacacacactcaggaggcacgatatggcaatggggaagaaataactgctaggaatcaaaaacattccttagggtcccaggcctggccctacccccacctccctgtgtgacctggcgaggcccgacctaacctctctgggctaatcatgtcaatgtgtgtaaaatggctaaagtgctcccttcctccacaggaatactgcagagaggacgttaacgtgctatttaacctccttgataaggtctcaattgggggtacaaaattgatgtcaagaatcctccgaacacttttttgttagacttaaactgtaatcatgaaatgttaaagctgaaagaatttcttgtcgttatctgtttcatttgtagaggcgtgacatcaaagagattttggactcactgcgtcatactttttaacccacctgtcctttctgctgaacagcagggattattccaaaccccttttccgttaatttttttttagctttcaggacatcaagaattcaagaggggatgaagtccacgctgctaacaccatcacattgtatttgaaaacacaatctttagaggaaaaaaataacttcagatggatatatgattatgtaagaaatcaggctggccgtggtggctcatgcatgtaattccagcattctgggaggctgaggtgggaggatcacttgagtccaggagctcgacctgggcaatgtagtaggaccccatctctacaaaaagtaaacaaaaattagcccggcatggtggtacatgcctgtagttccagctacttgagaggctgaggtgggaggatcccgagcccaggagcaccactgcactccagcctgggtaacagagcaagaccctgtctttaaaaaaaaaaacaagaaacaaaaaacaaaaaacccaaaaaacctaagttctataaagaggaatttttgtctgatttgtttcctaccagatctcaggcacctaaaatccagtagctaacacgtaatcagtcctttgtaaatacttactgagtaaataaatgagtccatgattgactagtgaaaaaaaaaaatctgaaagtgctcatttaaatttctttcatggcagatttcctgggcttcctaggggccagccccagtgctgggagctaggcaagaagactaagaaggctgggacctcccacagccctggctctgtgggaaggagcttatgtctggttagggaggctctttaccatgtgacaagacataaaagacagtctgactcaagtgctggggacacgcacctcctctcacacatgaagggagaggcacccggcttccctaagcaggtgcaataggagttggggcctgagggaagcctgctgggcagggtgggttagggacagtgttgtaggccggggtcaagcatgttcagaagcagggaggaggctgggtgtggtggctcacgcctgtaatcccagcactttgagaggctgaggcggccagaacacctgagattaggagttcgagaccagcctggccaacatggtgaaacccggtctctactaaaaatacaaaaattagccaggcttggtggcgaggcacctgtaattctggctacttgggatgtggaggcagaagaatcgcttgaacctgggaagttgaaggtgcaatgagctgagatcgtgccactgcactccagcctgggcaacagagtgagattccatctcaaaaaaaaaaaaaaaaagcagggaggaatgacagcacgtggggacatggtgtgcagagggagcaggaaaaggctgcagatgccaggaggctgcaatgtaaggtggacagggctggctcatgagggcactgggaagcccagcatatcctctatgctggggagaatcgcagatgggttttgagcatggcagagatgggggggtgacctcattactttataggatatttatccacccacgcatccaatcatccattcagccagtcttcagtgcggcctcctgtgtgcatgttagatgtcgtgggaatcagcccagacatctcttcaaataattaacaaaattacagtgaagcaattaattgcttaacaacctattcagtgtcccacagccccagcacactaagcacatcacgagggctggggcagggcggccggctctctatggttcatcctcgtgggccgcccagggctggcaaagaaggggtgttcagtgaattttaaggcagagtagacgcgcctgcaggcttccagcacatacactaaatctggtgagttcaggccaggtgtactggctcacgcctgtaatcccagcactttgggaggccgaggtgggtgggtcacctgaggctaggagttcaagaccagcctgaccaatacggtgaaactgtgtctctactgaaaatacaaaaattatctgggtgtggtggcatgcacctgtaatcccagctacctgggagaatcgcttgaacctgggaggtggaggctgtggtgagctgagacagcaccactgcactgcaggctaggcgacagagcaagactctgtctcaaaaataaaaaatctggtgagttcagagccagaggaacagagaggtaggaagtgaggccagagagggaggtggcagccagtggccaaatgggcttagattttctcctgacggctctggggaaccctagaggggcagagtcaactctgggtgttagaaagatcccccaggctctacggggatcagactgaggatgaaagactggaggcagggtcagagggtggctggggccacggtcagcaaactccgaccctggaccgtttctacaggttctgggatctaagaatggttttgcaacaggggccaaatgtgtcccataaagcctaaaatatttactctctggctctttatagaaaaggtttgccaagtcctgcaagaggaggaagcctgagctgggggtggggctgtcggaatgcagagaagggaacacatcccgaagaacctttccagacctggacactgactcacccctcagcagctccctcctttcctggagcccctggctcctcttccttcacttcttttttgactgctggcttccggggggctaggaatgaagacagaaaacagtgggtcttttctccttccggtagcccccacctcccatccattctgcacccagcaccaccccagtgctcagggagatgggagacaggctggtagagacaaggccgactttccaaccagcaggaaaggaagaagggtcttcgcagcatctcaggcctctggagagaggctcaccagcctcctgcctgtacaaccccgggaggtggggtgagcaagggaaactcactgaagaagctgctgagcgtcttgggagctctgcggggaggcttggtctgctcttcctcctcctgcagttcctgcttcgtggccacctcaggctctgaaacgctttccgtcggggtctctgcttctgcggtgagagagctcagacggtgatgcaaactctttgaccctgagactttttttttctttttttttacccccaagatcattctgaccctgcagatggaagatataactacacctacccttttcctttctgttagctttgagctgagatctcaggcctgctgtctactcctcagtgctaactagcggaattctagcacttggcctgaaataggagacttaggaatagtggtaaaaagaaatctcatcgtcatgagaagaaaatattcccactcctcccagcagctgcagaaaatcagatacaactctgtatccctaaaattctcccggcaagtgttgtttctaacacaggggcctcatggacacttggaccaccctgagagggtaacttcagcctctaaaatcctgtaactcagtttggttgtctaacttaattaataacatttaatttacacctatgacttctgaaagctatgaatactttttatcttttactttgtctgaggcgggggagttcttgctctgtggccaaggctggagtgcagtggtgcgaccataggtcactgcaacctccacctcctgggctcaagcgatcctcccacctcagcctcccaagtagctggaactacaggtacgtgccaccacacccaggtcatttttgtattttttttggtagaaatggggtttcgccatgttgcccaggctggtcttgaactcctgggctcaagtagtccacccacctcagcctcccaaagagctaggattacaggtgtgaggcaccgtacccggcctaggaagattttttaaagaatggctggctctttcctcctttcccacatgcatggggaaaaataataattaaaaaaaaaaacccgagtaataaaaactattattcttctagattcggcatttaagcaataagtttgagaatctatgccttgtttaaattaatcatcctccaaagacttctgaccccaaaatcaggaggtggggcagggcggaggagaggaccagaaactcactggaggtctttaggggcttgggaggcgtggtgggctggtccccgtcttctccttccttctctgtggccacttcagcctctgtgaggctttctttcggggtctcctcttctgacgatagacagaacggtcagatggcaaaaaaatcccattgaacctacaagggcattttgactctggagacagtctgccctcatctgtcatctgttcttttttttgagacagagtttcgttcttaccgcccaggctggagtgcaatggtgtgatcttggctcactgcaacctctgcctcctgggttcatgcgattctcctgcctcagcctcccgagtagctgggatgacaggcgcccaccaccacatccagctatttttttgtatttttagtagagatgggatttcaccatgttggccaggctggtcttgaactactgacctcaggtgagccacccgccttggcctcccaaagtgcaggtcttacagttctatcttgtgccaatccaatgtgcctgtaaagcagtgggccacgtaagaccctgctccttgtcaaccccaagcaaggcagcgaccttgagggggtccagcccgtttgcctatgtagccgagacataaatggtgtgtctttccttaccaatgattcctttagtgttattcaccccaaaatagaatctgaaagggttaaaaatgcaaatgacagcctgttatagacaaaaataaaaatcttcaaagttaaaaaaaaaatcttacctctagggtcacaatacaaactacaaaaaccaacttgggaaaaatctgccttagtagaaagaggccacccccgccacccctcactggacactgacagtggctaaaagtgtagtttacaataaaatttgtactaaaaattgtcaataagaaatcaaatcttttttttttgagacacagtctccctctgtcgcccaggctagagtgcagtggcacaatctcggctcactgcaacctccacctcccagtttcaagggattctcatgcctcagcctcctgagtagctgggactacaggcgcatgccaccatacccagctaatttttataattttggtagggatggggtttcaccatgttggccaggctggtctccaactcccgacctcaagtgatccacccgcttcggcctcccaaactgctgggagtacaggcgtgagccactgcacctggccaagaaatcagatcttaaccaaatttaaatctgccctggaaaatggaccttttatttgtttgcagaaacaaaaaaccaaatgacgttaaaggctgcaattggtgtaatctcatgcaggccccagatgatcaatcgatcagatctttatggctgttttcggtgggttcaccaacatgcagggaactcactgggcgctgcaagatattttagatttttcaaaggaaacccagcgacacctgctggccagtgtgtgaactactagttcgaggtatttcagttttcagtattaaatcacattccttgcaatgacattgcatctctgcaaagctgggttttcataggttgctgctataaaaatcaagtactgtacaaaaatcaacatagaacaggaaatgacgttggcagttttcaattgaattccactgtttaagatgttacagagtatccaaggcatttcccacaagtaattatggttatttaagaacaaaatacaggctgggcgcagtggctcacgcctgtaatcccagggctttgtgaggccgaggtgggcagatcatgtgagctcaggagttcgagaccagcttggtcaacatagtgaaaccctgtctctactaaaaatacaaaaattagctgggcgtggtggtgtgtctgtaatcccagctactcgggaagctgaggtgggagaatcgcttgagcctgggaggtggagactgcagtgagcccaaactgtgccactgcactgtagcctgagcgacacagtgagactgtctcaaaaaaaaaaaaaaaaaaaaagcacaaatattactttttttccaatgtatgtatagtatctaatagttgtttggacataactacttaatagaactgataaggtattggcctaggagcatcataaaaaaattactaagacatcaagggtgctgtgaactaagaatgtttgggaactgcaactttatggtaaaatttacaaggaaaaggaaatcatttagaggaaaaatagtttccattaaataaatataaaaatagcaaataaaaatgggaaactgtgcctgaattattactaaattaagatgtccaaacaaatatatcccacaatgttttcagaacaaaagttcccatattggtaggtggaattcctggatgcctggacacaggcatcaaatcggcagggtccaaacatcctgagctctcaggcccctgcccttgcagatccaaaacacacacacacacacacacacacacacacacacacacacacacacacacacacctctccttctgggggctcaccttcctcctcctccttcctcttggcttcacacacacacacacacacacacacacacacacacctctccttctgggggctcaccttcctcctcctccttcctcttggcttcacacacacacacacacacacacacacacttctctccttctgggggctcaccttcctcctccttcttcctcttggcttctctgtcctcgtcctcactctgctcttccaggacttcctgaatggtccgtttcgggagctgcttccgagctggggaggcaaagggcttggtgtatctgacctcgctggctcgtgtgctcccatcccggagagctcacacccactgatgtagcctctggaaggctctgggccctctccccttctctgcctgcacacagtcactgccccagtgcaggccgcacccttcaatccctcctgcttcctggctgtgtgaccttgggcaggttacttaatttctctgtgctttgctctctcacgactgcagaatagaaataatccccacgagtaaacaatgatgtaatgtacttggcacagtaccgattccagcaggtcccctgagctccccactgctcccctcagatcttaactgcctccaagtgttccagacagcttccccggaacctcagaagtctggaagtggcagggaataaactagccccaggagaggccctcaccccacgatcggcaggagttggtgtataaataccccagctgcctcgcatctcgggggtcactctggagcatttacaccgttccccagagaatcccacaaaactaagctccagctgcccaacacatagcagacccaacagcacatcctgtgttggctgctcccctgtcctgaatcaccctctgttccctgcacctcctaaacaaaccacttgcacttgaatccctgtttcagagcttcagaacctgcttctaaaagcctctaaactcagatactaacccatgatgaagagctcacacaaaggcagttgtacccatcttcactgttatatctcatgttggccattgcgccacctggtccccggtctcccggcccccagtggctccttcacgtggccccagagggaccttctatcagcatggctggcactgtctctccctgctcaaaacccttccatgactccacattctctgctttatccaggataaagtcttttgatgtctaccccgatcctacctaatctctctccatctgaccttctaacccttcccacaccacatactccaccttcttttatatcactgctaaactggggtgtttccagacacaccaagctgtgtcacccctccaggcctcagcatgtgaggtttgggacatagctcaatgttgctccctctgaacaagatcccctgacacacccccagggccaacctcagcgtccacctggagctcccagcatgccctcagccacactgtgacttccttatggccacctttcattcagggatgaacctgcctccccacctcacagcccttccatggctcccaggacccacagcacgaagcccaggctccttagctgggagtgcaagaccttttgagatccagcccccactctcctctctagctcacctctcaccacgtgctatcctcaaactctccctgcttcccaggtcgcatccgattctccagaaacaaggaagtagatgagaggccccaaacatcccatgctgttcccatctcgaggcctctgcacgtgcccttcttgtctgaaatgcatgcatctgtcctttctcaacatggccaaccccaacccatcttctaagactcggctcagccatcacctcccctgggctgcttgacttctgagctcccagagtaccctgcgtcacccagcatcgtccgatggaaagatctggcaagccacgtatgtaaccttaaactttcttgcagccacgttaataaaaagggggaaaaaaccaggttgaacttggtttgaagagtctattttgctcaatacatctaaaacagtatgattccaacattctgttttcatgctaggtcttcaaaatccaatgaactcactgcacatctcaagttggacaccagattttcatcggcaacatgatctgtgtaggtttcataaaatgtacagctattcacataccaaagctgttccaaaatgatgtggaaaaagtgcaaagtctttacgcactgaatcacatattagctttcaaatgtaaattcaactgaaaggatctaacatgaaagattcagctcccctgtcacactcaccacgctaaagcgctcaataggctagaccggacggcaagggctcacactgccccgcattacgaatgggtctctcgccctgttcttaccccacagcaaacattccaagtcccccttaggacaaagacgctgttccccaagctggttttccaggaccttctcacctcattgctcaccatccccaatcctgcgctctacacgccagcacaccaggccctcagcagcccccaggccttctcaatttctatgttccccttgcctagcatgctcccctcctcctttgcttgttgcctcttctttgtcctaaagggctcagcttggttagcctctcttctggaagtctcccttgagccatggccccgcgcttgtgttcccacatgagctgtgaggcctccatctcagcgcataactacagtcacaatgacccacaatgactgagccccgactgagggctgggcccagttctgagcagcgtacacgtgttatcttctaactcagatatttctgtgcggtaggtgctatcattatcatcatctctacagataaagcaacctaagctcagagaaggtcagtcatttgtcccaggtcatacagccagtggatggtggacccgtgctcttaaccacaacactaagaccagagctgttgtaaggatgactaccttggatgggaatccaagtggggagaaaggcaggcgactggctgggtgcggtggctcacgcctgtaatcccagcactttgggaggctgaggcaggcggatcacgaggtcaggagtttgagaccagcctggccaacatagtgaaaccccgtctctactaaaaatacaaaaattagccaggcatggtggcgggctcctgtagtcccagctactcaggaggctaaggcaggagaatcgtttgaacccgggaggcggaggtcagtgagccgagatcatgccactgcactccagcctaggcaacagagcgagactatgtctcaaaaaaaaaaaaaaaaaaaaaaaagagaaaaagaaaggcaggcgactgaaggggcaggggcccgtgtgttctcacctgtgcgacgcttcggaatccctgatggggaactgtccatgggagaggtgtcagagagggaagcattgttctcaggagatgtggcaggacggggcggggagacctgtgagcagtccagggcaggcttctggaagaggaaagaacagttctagagtgagcgggggaaggagggactccattttccaaaagttgagagtagaggggactgaaacctctctgtctaccctcctttctgaccctatggtctcagccctaactcaggggtggcctcttctcacctgggccatcatcccgccctccagtgcaggatcatggtcccatcaaggacccccatagctcttctgttttctacagtaacagaatcttcgattctcctgcttcagcctcccaagtagctgggactacaggcctgcactaccatgcctggctaatttttgtatttttagtagagacggggtttcactatgttggccagctctacacaatgggatgtcaggggaaatgatgtacacctcttcgtatagttttatttttatttatttatttattgagacagggtgtcattctgtcgcccaggctggagtgcagtggcgcgatctcggctcactgcaacctctgcctcccaggttcaagcaattctcctgcctcagcctcccgagcaactgggataacaggcgcccgccaccacgcccagctaatttttgtattttttttatagagatggggcttcaccacgttggccaggctggtctcgaactcctgagctcaagcgatcctcccgccttggcctccagagcactgagaatacaggcgtgagcccccgtgcccagccttctctccatacagtttagatgtttgttccctccagatcgcatgttgcaatttggtctccaatgttggaggtatgacctggcgggaggcattcaggtcacgtgggcagatccctcatgaatggcttgtaccctccttgtggtaggaaccgagttcttcctctcctggttcacatgagagctggttgtttaaaattcctctcttgccatgtgacacacctgctcctccttcaccttccaccatgactggaagcatcctgaggctctcaccagaagcagatgctggcactatacttcttgtatagcctgcaggaccgtgggccaaaataaacctcttttctttataaattaactggtctgaagtattcctttatagcaatgcaaaatggactaacatgcatttcctggttcaaataacatccacttaatgttgagtggggtgccctcctcttcctgttggcagaatatggatgttcacagggacaagggcatctacagagagcaaacgacagcacagaggaagcctgggcctctgaccctgtgagacggtcacatgaatcccggactctgcactcaggagagagaaaaataagtttgcgtcttgcctaagccactgctaccgtgtctcggtttcaaccactcacttatcttcttacagggccctgtgccagttattaagtgattttctctcagctccaaacctgtcactgtccagtctccttcatgctgccaggaccgggactccacaaatcttcttcttgctctggcgccacctgggcatcaggcagtgccaatggagggaagcagagggcactgcatgactggaggcacagccggcttgccgggggcagctgctggatcccactgacagttttttctaacattcacggggcttgccacgtggtacctgatcagagaccctggcatctcccacccagtgctcccttcctgaaagatcagagttgcaggctctcggggcaccttctctaagctcagagacctgccagcagtcccaccacagaggtgtgaatttcagctcaaaagccacagggatggtcactgcaccccacagttgctacctccatgatgccttagagttagttctctttttagcccttcagttacctatttaacaactgcatacctagtgaccatcctttaaactccctctgttcaaatcactggtatggtttctgtctcccattgagaccctgatggagatacaggtctcagataatttttttttttttttgagatggagtcttgccctgttgttcaggctggagtgcaatggcacgatctcggctcaccacaacctccatctcccaggttcaagcaattctcctgcctcagcctcccaagtagctgggactacaggcccgtgccaccatgcccggctaacttttgtagcagagatgaggtttcactatgttggcctggctgctctcgaacttctgacctcgtgatccacccgccttggcctcccaaagtgttgggattacaggcgtgagccatcatgcctggccagatgaatattttaaacactgcccaggactaaatgatctctgcctctcttctgcccaaaactcttcctagctccccagaagcctcagggtaaagtctaagctccaaaagagatctctattctaatacctggaacctgggaatatgttaggttacatggcaaagggtaattgaggttgctaatcagctgaccttccgatagtgggattaccctggactatccaggtgggcctgatatagtcacaggggccttcaaagtggaagagggtggcaggagaggaaagtcagggtgagatgtggccacagaagaaaggcacagaaggaggcaatgccacttgcttatttatttatttatttatttattttttgagacagagtcttgctctgtcacccaggctggagtgcagtggcacgatcttggctcactgcaagctccgcctcccgggttcacgccattctcctgcctcatcctcccgagtagctgggactacaggcgcccgccaccacgcccagctaattttttgtatttttgatagagacatggtttcaccatgttagccaggatggtctcaatctccggaccttgtgatctgcctgcctcggcctcccaaagtgctgggattacaggcgtgagccaccacacccagccacttgctttgaaaacggagaaaaggggatctctagcagctggaaaaggcaattcctggattctcccccagagcccccagaaatgaacgcagacctgctgacaccttgagtttagcccagtgcaacccatttgagactcacgactcccaaactgtaagacaataaactgacactgttttaagccactgcgtttgtggtcaattgttatggcagcaaatgggaagctaacataggtggtgaggaaagtttcgctgaggaagtgatatctgagcaaagcatggaagaaagcaggggactgagccaggcgtgtatctgggaaagagagttttaggctgggaaagaaggtagtggcccagaggtggaagtgcacctggtgggtgtgggaagccaggatggagcgagctgaggaggagctgtggatgcggctgcagatgtgatgggcgggggaagagaggagcagcaggaggggcctgggaggtttccacaaggcctggctttggcctgtggtggtaataccagggggtttgggcagggagtcacaggacctgacctcaccactgacagaataagcagcaccacgctttggacatcatccacaaagcaatgaacaagcattaaatgacttaaacaggggaagagagtggtccaatgtatttggagaagttaaaaagccctctgaccacaggagaggctagatatacttttgaacccttatttttttgcttttttttttttgaagcaaggtcttgctctgtcaccccggctggagtacagtggtacaatcacagttcactgcagccttgaacacccgggctcaagcgatcctcctgcctcagcctctcaaggagatagcaccacaggcatgcaccaccacacctggctaatttttaaaacatttttttgtagagatggggtctcgctatgttgcccagcctggtctcgaactcctggcctcaagtgatcctcccacgttggcctcccaacgtgctgggattacagacgtaagccattgtgctgggccttgagcccttgttttaccatcaggcattattctcagatctgtatgtaaatcgactcatttcatcttcccagtcaccctatgaggaaggtgttaccaggagctgcatgttacagttgaggcatccaagacctaacgtggtgaaggagcccacccgaggtcctagggcaggggcaattaggaccaggttgtgtctgcccccgacacaaccaggaaacacatctacctctcccgggcaatttctccagaattctcctgaacagctgctgcactctgttccaaaggttaatgggaattagtttcttctggtaaaaatgggcagggtgatggggacctacctggcctttagcagggctaagggcttcatcctcctcttccccttcgctgcccaggacccgggccgccttcctccctggcctcttcaccggagagtcactctcggacaccactccattccactccttcagtgccgccctggaaggtggggaaatgggggtgtaaaggggcgactacagcaggcagagtgggggcactgcccgcaaacactttggtttctttgctgtttccttcccttcctttcaagcatccaatgaacattttctggttgtctcctcagcaaatctcatcatttcatccatcagtgcattaatccacccgcccactcatccactcacccacccatcacacatctctggaagtctccagagtgcctgccctgtgatgggtgatgctgaggagcaaatggagtccctgcctaaggttgccattggtctccagcatctattgggatgcctttttttttttttttttgagatggaatcttgctctgtcgcccaggctggagtgcagtgggccgagatcacaccattgcactccagcctgggtgagagtgagactccatttcaaaaaaaaaagagtactgttgtcttctacttagatgagacagcatcaagacgtggccagtggccagcggccagcttctctgcattatggagaatgtctggttctagaacgaggccaagacctgcagaaacagagacgtacagacaactccgaggccctggatccagctgtgcctgcagctgctcttgctcttggacttctggccacctggctgaaaaagttttttgggccccaagacattttgcattaggtttgaacacttgcaaccaagacaatcctgactgctaaaggaaaaaattcaccatatcccagccctgtgacatactttggagggggctccgtctctctgctgctattggatgcctccttctcaggcttctttgctttaccctctttcttggggtggaaaaatgacctagaggagcataaaagggggtaaaaaaaggagaataacagcaccaataccctgcctatctatgctgtatcctataacttccttttttttttttttttttgagacagagtctcgctctgtagcccaggctggagtgcaatggcgcaatctcagctcactgcaagctccgcctcctgggtgcatgccattctcctgcctcagcctcccaagtagctggaactacaggcacccgccaccatgcccagctaattttttgtatttttagtagagatggggtatcaccgtgttagccaggatggtctcgatctcctgaccttgtgatctgcttggcctcccaatgtgctgggattacaggcataagccaccgcgcccggccgcatcctataacttctaacaccatttccatctcagcacataacagagaatttcaaataagccctttaacttaactgataaggaaactcagactcagacaaaggaggcaacactaatttttctgccctaacgcacctgcaagatatgatacatcccaagttttattcaacaaatattaactatgcactttttaaatcttttttttttagacagactctcgctctgttgcccaggctagagtgcaatggtgtgatctcggctcactgcaacttctgcctcccaggttcaagcgattctcctgcctcagcctcccgagtagctgggattacaggtgcccaccacaacgcccagctaattttttttgtatttttggtagacacgggttttctccatgttggccaggccagtctcaaactcctgaccttaggtgatccacccaccctggcctcccaaagtgttgggattacaggcatgtgcccccgcgcccagcctaaaaaaatttttttttttgagatggagttttcactcttgttgcccaagggtggagtgcaatggtgcaatctcggctcactgcaacctcggcctcccagtttcaagtgtttctcctgcctcagcctcctgagtagctgagattacaggtggccgccaccacgcccggctaatttttttcatttagtagagaaggggtttcaccatgttggtcaggctggtctcgaactcctgatctcaggtgatcctcctgcctcccaaagtgctgggattacaggtgtgagccactgcgcccggcctacctaagcacttattatgtgccagggcctgttctgggcctgaggggtttggcagtgacccagacacacgaagttcctgccttcaagaagctaacactctggtgaagggcagaaatattaagcaaacaactaaatataaaatgttggggcctggcatggtggctcacacctgtaatcccaacactttgggaggccgaggtgggcggatcacgaggtcaggagatcaagaccatcctggctaacacggtgaaaccctgcttctactaaaaatacaaaaaaaattagctgggtgtggtggcaggcgcctgtagtcccagctactcaggaggctgaggcaggggaatggcctgaacctgggaggcagagcttacagtgagccaagatcgcgccactgcactccagcctgggcgacagagcaagactctgtctcaaaaaaaaaaaaaaaaaaaatgttggaaggcgtgaacattaaaaaaaaaatctggtgaaatctgaataataaagtatggagttcagttaagagtaatgtactgacattagtatctcagtggtgagaaacggatcatagtaatgtatgatattgacaatggaaactggccaagggtatacaggacctctctgtactgtctttgcaactttcctgtacctctaaaattattccagaataagaggtttatttaatcttcaaaaagaaaaggaaaaatcatgcaaaagccagtggacagaaagcaatcgaaggcaccatcagccctggagagacaatccccagattcctcatcacgggagaaaaacggaacccagcatttgtgtaagccactaccgcccaggtttctgggatggatgcccttgtctgggtctctctaccatccattttttcctcctggtaacagcccctccgttttcctcttgggatgcttcttaccccacattctctcagtacacacgatttgagtgggctggcccttttgcctgtgaccaggggtggacacgtgatccaggctgcatccctgtggctggttcagggataggtatgtggcccaggctgggccagtgaaactgggctctaacaccctctttccaaggggaccgctaagaggggagagcccgcctgagggtgaggacaacctcaaggacagtagagctgaacaatggagagagacagattcccagggaggaagttttggcaactggatcgaaccaagcctgaggctgtttactccagcaggtttcaatgatataagtcaagtcatgccctttcttgtcttcctgaagccggactgcattaacacgaggtttctcaacctagacactattgacatgttgggcctgatggttctgtgttgttgggggggctgtcctatgaattgaaggatgtttagcagcatgcctggcttttagccactagatgccaatggcaaaccctctgtccctaggttgtaacaaccaaaaatatctccagacactggccgggcgccgtggctcacgcctgaaatcccagcactctgggaggccgaggtgggcggatcacgaggtcaggagtttgagaccagcctgaccaacgtggtgaaaccccgtctctactaaaaatacaaaaattagccaggcgtggtggcacgtgcctataatcccagctactcaggaggctgaggcaggagaatcacttgaactcatgaggcggaggttgcagtgagccgagattgcgccactgtactccagcctgggtgacagagcaagactccaactcaaaaaaaaaaaatctccagacgctgccagatgttccctggggagcaaaattgctgctgactgagaaccactgcgttagggtttctgctccttgcaactaaaaactgttgttcaatacactgtcttccatatcccacggctcattttccatactacttgactcctggaaattccaactcaaaatctaacgtaagagtttttgtttgtttgtttgtttttttaagtacagatttagagaaagaaacagaggacttggagaaggaaagactcaggggcaagggagggtgctcacatgatacttcgctgcatgttggcgtcagaattctcccttcctgtccagcacttttcttcgtctgtcagctgctcctggaacagaaatccaaacacttgttgaggtgattggttgtgcagagatctaaacacacataaaaccctttctttaagaaagaaagaaaaaaaaaaacagaaacatgaatttccccttcaaaaagaaactcctgtttttatgaaccaaaataatttgctggtgagatttactggtgcagaataaaagctccaaatcagagaaaaagataagaggcctcctttaccataagaagactgtttttcatctaatatgaggaatagactgaggacctgaaatgggtttttttggagttaagtttaaaggttagtgaaaaattgttttaaggtgatgacataattccgtgaaacaactgtggaagcttataaaattgtacccgctggtctacataaattagctcttgggcagtttctaaggtatgctgttatttcaaacaaagggcagaatatcacagagtgtgtgctactgaactgtgtaaaagagaaaggctataggtcaggcacagtagctcacgcctgtcatcccagcactttgggaggccgaggtgggtggatcacttgaggtcaggagttcaagaccagcctggctaacatggcaaaaccctgtctctactaaaaatacaaaaattagccaggtgcggtggcacgcgcctgtattcccagctactctggaggctgaggcaggagaatcgcttgaacccgggaggtagaggctgcagtgacccgagattgtgctactgcactccagcctggacaagagtgaaactccatctcaaaaaacaaaaacaaaagaaagactataaatgtatccacatatcttgtatatgtacagaacatctcagttggaagacaaaaaactggtaatgctgtcgcctcaggagggacagacgctggagggagattttttaatatgcatgcttttgcaggcagaacaattggaatacgttaccccttcacaatatatttttaaaaattaaatacttttttaaaaagtctgttatttaatgaaatcaataacagtcactggggcttccacagtttagagtaactctaatgaaagggttcctaggccgggcgtggtggctgctgcccataatcccagcattttgggaggccgaagcgggtggatcgcctgaggtcaggagttcgagaccagcctggccagcatggtgaaacctcatctctactaaaaatacaaaaattagccaggtatggtggtgcacacctgtaatcccagctagtggggaggctgaggcaggagaatcacttgaacccaggaagtggaggttgcagtgagatcatgcactctagcctgggcaacagagtaacactctgtctcaaaaaaaaaaaaaaagaaagaaaaagaaagaaaaagaaaaagaaaagaaagggttcttaatctggggtccacaaaacccaggagtccaagagcagaactcaagtggtctatgaaatttgacaggaaagaaattacgactttattcttgtaaacttctaattggaactgagcctttccttccattataaatattaaagatataaaaaattataaattttctatatctttaatatttataatggaagaaaataaattacacattataattatgtaattataattatttacattatatttccttccactatgaatatattttttaaaaaaggactagcaggacctctgcgtggattgcttgagttgagaccagctcagaccagcctgggcaacagaaatggttttctttgactttcccttcctttgcacagaaatcttcttcaacccatggggtcccctttcgttttctggaatcagtactctctgtcccgcaccacacgcctctaagtctccactactctctacagccttggccgccacatgttggcaccacaactcaaactcaattttggaatcaaaaaactcagtaggccggcactgtggctcacgcctgtactcccagcactttggaaggctgagacaggcggatcacgaggtcaggagttcaagaccagcctggcccgcatggtgaaaccccatctctactaaaaatgcaaaaaattagccaggcatggtggtgccagcctgtaatcccaactactcaggaggctgaggcaggagaatcacttgatcccaggaggcagaggttgcagtgagctgagactgcaccactggactccagcctgggcgacagagcgagaccccgtcttaaaaaaaaaaaaaaaaaaaaaaaaacaaacaaaaaagaaactcagcaatttccaaacagagtttctcagggccagttggggagcaggaagtaagcaatgcttcaaccaaacagttcacacagaaagcaggttagggacttagccaccaaaatcctgagggcaaaggagaaaactattacgatccctcctgagtgctcaactgcctaggtacttgacattctcaattatactgactctccacaacaactctgttacagaaactaaggcacagaggggttttcaaaggaacttaacctgcatctatagtacgttccaccccaggtcggcctgctccacagctcacctcttaaccaccagactgagttgcaagggaaggagaaatacataagcgtttactgggaagcctactctatgcctgacaggctgatcacattctcaaataccctcaatcctcaagtcagccctccaagacaggtgagatcatccccactttatagatgaaggtaatgaggacagaggaacatagctggggttcaggcaaggcttcaaaacccggtgtggctggctccaaagcccacgttcctttctccttaccacggtactcaaggctggcttctcaactctgtgtactgctgagttggggggaacaaactggttgatgcctctggaggaccacctggcgtctctatcggaacggcaaccccacttctgtgtatttggcccacagagaccctcacaggtggaccaagtgaggcacaaagttacctgctgcagcactaactgtaatgagagaagactggaaactggtggaatgtctacccttagggaactggttccctcattactggaataccatatggtagaatattgttcagggttaaaattaaatgaatgatggataaaaggtataggagttttttggggggatgataaaaatatcctaaaatcgattatggtaataactgcacaactcagcgcatacactgaaaaccactgacttgtacactttaaatgggcactttaaatacactgaaatacactttaaatacactgaaaaccgctgacttgtacattttaaatgggcaaaattgtacactttaaatgggcaaactgtataattgtgaattatatctcaataaagcggttaccaaaatgaagagataatgacaggaaaaatatcaagtaaggatgaaacagtactcagtaataaaaagaaacgaagcactgatacaagcaacaacttgggtggacctccagggcattgtgcagagtagaaaaaaggtaacatcctaataatatatgattccatttacataacaatctccgaatgacaaaactagagatggtgaacacattagcggttgccaggggcctggggaggagttcttatgtggagagggaactgttctatatcacaattacgatgggggttacacaaatctatacaaggaatcaagctgcacgggcacacagatgcacaatcacactcacaccacacaaactggtgaaaactgaacaaggtctgtaatctagttaacagaactgtattgatgtcaatttcctggtttcgatattgggactacataagatgtcaccattaggggaagatggatatactcttttcacaacttccttgaatctataattatttcaaaataaaaagtaaaaacaagaggtaagctccatccctttatcaagcatacattaggccagacgtctccccattcagatgattctccatcttttacgagccctttacctagacctggaccttaccactgacctctccctgacaccacccatctccctccagtagggcccactccttccaggtgatgctgctgcccgcgatttaccttcttctagccccgccccctcagcacttccaggtggcccccgccccctcagcacttccggttcccagccagccccacccttggcacctcccccttccaggtggccccgcccacacgcaatcttttccccggccccgccccttagctcccttcagcccctccccctcccagatagccccgccccctcggggggccttccgatttccagctggccccgcccacacagttttcccccccccggccccgcccctcagttccatttggcctctcccctttccaggtgaactcgcacctcaaggcctcttctcagaggacctgtccaactgtctctgtctctcgtctaccctctacctggcccccctccctctgggagacacctctctgcactctccggcggcccgcagcccgcgctcttccgtctccaccgcgctctcggcagcctcagcgtccccacgcccactcctctgcagacaccccgacatggcgaagcataggccccaagcattcggcgcacccgccgccctccgcctcccatctgcttgcggacggccccacttgccttgcgttggtcccgcgcgccgctgcccgggcaacacactcagatccgccaggcgcgcctctg

SEQ ID NO: 1846 - DNA, 10925 bp, Homo sapiens
ttaatagtgcattaaatattttatttaaattaagaagtataacaaaatcacatacatttgttccacggtttgaataaaatttccaataactttcaaataatgcacacatagtatcgcatggatcaaattccgtacatttcaatatggtcatgagataggctgtattccaaaatttggtatataaatccatacataatatatactatatacattgactttaaataatctaactatgtcatttttaaaagtcaaagcaacttatttctaatgaaagttacaatatgcatgccatattgacacctattcaatagataaaatctaggaaaatcttttttgtgaatactatttatactggaatgcaaattcacataaaaatacttcctttaaagcatgttctatttcacacaagaaattaaatgtgagctacttttaaaattgcaagctttatttttaatcaaaccaattcaattttaagtttttagatcattaagtctcatacaacttcctctaatttagctaaaaccatcgacagggttttattgttacatttggccttaaccttaaaaaacaaatttgtttacatttcatatttaaatgggacattttaaaccctgagtaaaaagacatatttttacaagtccagctgtaacaattctaccctattttcttgcagtgcttttattagataaaaactattgttaacgttttgactttttagaatatactgtttagaaggttaatgctttttcatgactttaaaagtttctaaatgtattttattagtatctaagtaaaaattctagatttctatatggatattataaaaacacctcttctttagactgtttatttcaccttgatcataaaaaatcattgaatactacattcaagataatttttctttcttggctttgggctattgtcttttcaaccttaaaagttaaaattattgttttcctatatgtaatgatactttttaggcatagatttttaagatacaaaaataaaatgtagtttagtattttatcattaccacctgctgcaatgagtctgccagatcagaggctttcctcactaggaaacctagctttaaatcaaatactggttttcttcttgtaattcacacttgtctattgaatcagttacccaactttcttttaggattttaaactttctcttaaaagttcttctaaaagctttaaaatctgcaacacgactatgatcttccccaattattacatgagacactccctcagctaaacaagaaactacttttgctccatgaaaccgaagctccaaggctttaatagctaaccttgtcccctcatttttggtactcaggtcattaataacagcatacgagtccaaataaacggtgtggcgtcgaaacatactgagaggagagcaatcccaggaataccgatattctaaatcagcaatcagagaagccatttcttcaggagtctgctcgttagaatttttaattcctgagaatacttccttcagttggttcaagtctgtatcaatgaaataactatcaccatagcaatcatattcacgggcaaaatgttctttggttgatgggcacatatgaatcataaagcgaggctgccatggtacaaagcttttggtcttaaaacattctaaaagccatgcaggcttgacaacatcatgtttatttgacaaaattatgtttttcactctgatgttctcagaccctgcaattacacagtacgtgtctgggcctggattttgtactatataaccaccaaattctgcaattctgttctccaggtcaggctttggctggctatctgttccactcataacacaaaactctacatcttcaaatatattagaaattttgttaacgttagtaaggttaggtgcttttaagtgctcaataattccaataactttcttcatctttggggcagctttccgctttttttcttgtggttcatcatcaccacctatataaaggtgtttagatgcgagcttaccagatgccttccccctaagttgttctaggtcgtccagggtcatgcactcatgccactccttgtcatctcttatcttttcaattcgtggaaaacgcaaggtgcagccagttttatacatatcactgggtacgatctctgctgctttaatctgaacaatgacagaattacaaggttcaatgtatacttctggcttctctgttccacataaaatgctgcttggtggagcttttctatgaaaaggcttccaatacttggccaatttcaaacccagatcatacagttctttcatggtgcagccagacccaacacgagagagagtatgaaacacagatggcttctcaccaggagggggcttctctgctactgcacacagaaaatgagacatcattccaccccgtgatcctttaccccaatatcctccaacaattaaaatgtccaattcatccattagtccactgacatactctggtttaatttttaaccacccttcacctcttttgtctggcttgtagatggatagaggttgttttaccataattccctcttctcttttatctattgcttcattcaatgcatcaattacttcattcttagtatgagcttgtgttttctgcactatttctattctacctggaattggtgtaaaaatactactaagaatctcatacctctttctcagagtctcatgccctagctttttattattaaccatcaatacatcaaaaacacaataacaagtttgcagatcagaatcctctaccattcttttaatatcaaacttagttcccttttgcatgaaagtttgtgtattaggattataggccatcatctcaccatcaagaatacagatttgtatatctgctttgaatgcattatgaatgaatggggtaagagaaccttcagtaggagaagcaccaaactgatcagtgtagttatatccatttcgagagaagtatttatatacatctccatctttgtgcatttgcatacgttcaccatctagcttggtttctatgtagaaactctgatgtttcatatccttctcaatgtgctcaatatctgcaatagcagctagcattggtttaaatgcagaaaataaagtgatagaaatatcactgagtcctacagaaggatcatgcagttgcctacagactttttccagatctgtagtgacattatgcaactcagcagcatcattatgaaaaacagaaaagatagtttgctgactaacaccaagctttaaatcctttatgatcatccgtataagccacttttgctcaagtgctgaactctgagttataagttgaagaaggctcttttttattaggtcttttcttttagcagaattattgctggcaattgagtctaaaaggtcgtttacttgctgtatggttaaacttcctttctgtaaacatcttggcttcaacacaaaatatgcaatcattgcaaagtctccagcatctccatgagttccagtgggtgttctgtagtttaaaagtttgagggcatcttttccatctctaggtaaattaagcaactcaatataaagcttagcaagcatagtttctttaattccataggccattctctctctttctagctgaggaagaattagtctcattgctggataaaaagagtctgtgacatctttgtggttcttatgaagagcatcatgaaattttctccaagaatctaaaaattccctgaagtgtctgattttttctgcacgtcctttacttttctgtattcgttctaaagttgaacacaaatctgcaaaaggaacgtgagatgcaacagtttgtgaagtttgtgaggcagccatcaaagcggtgatgaatcttctcgtttaactagtaaagcaaaaagagaataactttaagtaaaagataagattcaactaaatatttaatgtaaagatcttacaaagatcactgagatcataataaatgtttattaatgtttactaaaaaaaagatcaatgctctaaatgatgtatcttttcaacctctacatttaataactgttttgctccaaccctaatttgaagttattatgaaaagtatcatcagctatatagctgtatttcctgtatttataatacagaaatcattttaattttctctttaaattccagttattctatgtattaattatttagcacataatacaaacaaatattgctaataatggtgacaaaaaaactcatcaggcttaattcacttcacttctgagcttctgagggaaggcctttcatgtatgtctcttctttccctgtcagactaccacatagcaccagaaatgaacttgatcttcgaacagatatttttaacaaatcactcatttgctgaactgaaatttgacttcctagaaatcctaatcataggcagggcccttgaccaaaaaacaaaacaaaggaaaaaacaggtaccctcttcttccagccaaacaaagcctacgtctatgtttcctttcacttcttcactgctagctatgccaaatcacaccagcattcgattccaactcaaaatgccctacccataaaatcctcactttatctattttaccatagttacttactgtcttataagtataaatttattagtatgctgcttttttcatatttccatgccagttattccctgagtatttaatgactacatatgagatgtgctacatacactgtgctaggggaaaatactgcatgtttctgctttaaaagaaaatatattctgtaaaaaaaaaaaaagaaaaaaaagaaaagaaaaaaagggggggagtgtagtggaaactgagtataataaaatgccaagtgctttaacaaaataaaacaaacgtaaaatgtcctgaggggagagcttttccctaaagtatctgctaaagtcagagaagaaataatgggtaccttgctaagctagggcaagaatatttcctaaaatttcacaagtgtaaatttctttagttttaaatattcatacaagttctactggaagataaatatattagagtaattttaatatggtttaaactatgtaatgttaaataacttttccaaaaaaagatttcaagtaaaatgtatggtccatgaatagaaactatgttttatcctgtggtttcagacccctcctggcacaccaccatgtatcccaggcagtggagttggagaagttttgctgggagtggggagatctattacagtgcagaaaatatgtgactccccatcttccaattcgcaaacaaatgagcaacacacacatgcacaaggctacattatctagtatccagtaaaataaatcaaatggctaattacaatactacatttactatactgtcagtatctagaggccaggaattgtgctgtaatttgtgctctagtggcagacatgtaggaggtttgctgaatgaattactgaacacctagagttgactcctggataagcacactagggaaagctatggtctggttacataccacacactcacacacgcacgcagacacacagtgggtgagattcagtttggttaaaaatattcagtagctctgactgccctggcaatggtttacaacagccatttggtggcctatagagaaaaaaggtgcacttctcagtctaatttctgacaaaggaaacccagcttctactgagtgggttagatcgagggataaacgcatgacagaccactttcctgaaacttttatctttgaatatactgttgtttcctctctctgaatctggtttgcataactgactgtaacacctggttatgtatgttcactgccctatctcccaaaatttgctccctcaagggagtaaacagggtacacaatgctatatctacaatttctatataaactatgtaaaataaagtaggttaactaatatttctttaatattcaaatattggtatatagtttctacagatatatctatagattctacatggtctcaaagttaaagtttcgctcaacaaatcccaggcaaggacttaaattactttataatgacaaaatgtaggtaatggtgtggatacacatgtatcctaaaatggctacgcctataacaaggattccaaaattgccataaactagtcgtaagtatttttgctcattacaacggcataaaaagtcaaagattaggacttccattcatttttacatgctaattttattttttggattctgaggattttagctgattcattccatttgcagtaagacaaatgaggaggttcctggttagggctcaggttttagactctaataaatctgagttcaaatgtggatggtaacatttaacagctgtgtgatactgggcaattacttaatttctctaagcttcagtttcctaaagtataaaatggggttaaaaactatgtagaaattagaatgaagataaaaatcagataatctacaaaatgtgctttaaaaagtagtaagtcttgataattttaatactataatgcttgctgatccaagcaacatttaaaatataaatattgcaaaatattaacgagataaaaaggtgggaagaagcttcactctttaacaataagcaaagctttcaggagaatgaatgcaagcaattagtacacaataacgattcatcattcattcagttctgactaaattgtcctgaagtgacacatgaaaataaaccggcaggttttattcagtgactatggaaggtgattaagtgctatgctattgcacttaaaaaagagagaggaaaaaaaggagtaagtgacgaatgcaactgaagtatccttcatgcaacccttgacaagctgtgtttccctaggaaacaaagggtttacagctgcctatcttccacagcacttagtgacaatttgggacaatctcagcaaaaagaaatgagcagacaaagacgctagaagggctttgggatcccaaaagttaatgaaagaccaagtgtaagaagagaaataaagtaattccctccaagcctaaagtctctcccgctccaatgccccctgtaccctctcggaaaatggaaaatccctaaggagtctacatcattcctctgcccgttccccctactctcccccaacccttcacggattcccagtgaatacctggcctcgggcaagctccgttacctctgtgaaccagagaatcccagctgtaaaatgagatcttgatggtttcctgcggggttgccatgagaaagaatcaacatgtacgcaggtaaagcaggcaatacagttccagggagtcaaaaacgggagaaatcgtcccacgacctggggcttgggtctagatgaagagcacagcatcaggaggccaggcttctaatgcggcgcagtctacagcgctgtggactcggcaactcccatcacctgccgctgcacaaacaccctgcttgctgcccccatagaccgacccccgcctgacgcctcccagacccccccacctgacgcccctcaggccccccgcctgacgtcccagacacccccacgaccggatcccccagacccccaatctgacgccccacttcccctacttgactccccacacatcccccgcctgacgaccccccgacccccgcctgacgtcccagacaccacccatctgatcccccagacccccaatctgacgccccacaccccccacttgactctccacacaccccacacctgccaccccacgtaaaccccgcctgacacctcacagaccctaacctgacgccccacagacctcccccgcctcctgccgccacacacaccccaaaccccgccccgaacaccccccacctgccgccccacagattcccccctctgacgccccacagacccccaacgtgacgccctacagaccccaacctgacgtcccacagataccccgcctgacgccccacagaccttcccccggtctgttgccccacagacttctcgccgcctgctggaccacaccttccacttgactccccccacaccgtcaatctgccaccccccaccccccccaccccaaccccccccaacctcccaaccgcccccacctgccaccccacacccttcccacctgacgtcaagcctgaagctcagccgctaagccggaagctggcgccagaagatgccggttccgccagctgctcgccgcgcaggcgcaggggagacccggggccttgcagtcaccgggctcaagcacgccggcgcagccaggctcgcgatgggaggtgggggggccggcagccccgtggggctgcggaggcgggacctgcaggatcctggttagggtcttgagtacacacggctcctattggcctcggcagcagatgctctctgcaagcagttgatccacacgccagtggattttgtctcgagggagacctaagatcactttgtgctctggctagtgatagcctctaattcttgttctctgtacgtaaaacagtggtaactatactgatttcgctggttgtgaaaactcccaagagagaacaggacatcctcccaactcaaaacgttggttgtttcatttaaacttttaaaaaataggcttttgcaaactatatagagctgtttttttttttaaatgatgtttgctactgtggtctcagttctcttaatacagaaataatacataacaatacataacttacaatatagaaataaaccgttgcatgaccagaaatcaactatggactcttctagtatctgtttaaggtttaaaaataaagttatttaacaaacctttattgagcacctattattatatagtaatggtgctagatattcagggtggagagattataaacaaccccagtttttgtgttccaggagctgttggtttccaccgaatttttgctgtggtcagtcctctttcgccatggagaagtgagaagttattcataaagaggggtggaaacaacttttagaactattttattttagcataaaatattgctttacaataaaataaattttgctgcagtgggccctgataaaacatattagagctgttaagtgcccttagaggttgtgtaatgtataaaaacctcctttttcaaaactgacacatttcattcagtgctagtttgtagcggaggttccgtctagcccaagaacattcagttatttacttcgtatgtctaattgacctaatatgcctgaatatctaaaatcatctgtgatgttgtaaagtctcatgatattgttttgtgagtatctgctcttcaatttagttatcaatttattttggaggaaaaatgaatagtgttaaggtagaggagcctccacttgcccatcttaggagagggtacctatccgtgtacatttgtagcttgttcaacctctactgagctcctacaatgtcagaagctggactttgtattagttacatgagaagaaccatgaattatgaaaccaggcaaactccaaattgattcaaagcccagtctccatttcatcatgttattttagttgattggttcaaagacaatcaagggtttttttcactaagtatcttctagagttgccatgattattaatttatttatgtaaatggtctactttatatatgcttggcacttattccgtgatcaagattaggaagctatgattcaagaacccagctttgacctggagctctccatctggtagcaagacacatatgttcaataacaacaacaccacaggccgggccagtggctaatgcctgtaatcccagcactttaagaggctgaggtgagcggatcacttgaggtcaggagtttgacaccagcctggccaacatggtgaacccccgtctctactaaaaaatacaaaaattaggccgggcctggtggctcacgcctgtaatcccagcactttgggaggccgaggtgggtggatcaccagaggtggggagtttgagagcagcctggccaacatggtgaaatcccgtctctactgaagaaaaatacaaaattagctgggcgtggtggcgcatgcctgtaatcccagctactccggaggctgaggcaggagaatcgcttgaacccgggaggcgggaggttgcggtgagccgagatcttgccattgcactccagcctgggaaacaagagcgaaactccgtctcaaaacagcaacaaaacaaaaacaaaaagtagcggggcgtggtggcgggcacctgtaatcccagctaggtcagaggctgaggcgagagaatcgcttgaaccagggaggcggaggttgcagtgagccgagatcacgccattgcactccagcctgggcgacaagagcgaggctccatctcaaaaggaaaaaaaaaaaaacccacagatttatgaaatatcctctgtatatataaaataggggacatagaataaggaaagcccaagggaggggaggcacacatctgtaaacaagtgtgtacacttcagtgcacaggggggttgacagcgaagctaatgaagcccaagttttaagggcccatttttgcgaacacttccaaggccttgagaggggccctaacgaggtgttcccatggtcgtgtacctcggtaaaatttgcaaaaataagacaattttacattatttttctttaaaagggctctccaaatggcacaaggttcaggcctcacaaaacctgcattcgcccttgacagtccactctcgtagaggtaaaaggagaaaaatagttatggaagcgctttaaatcgtggacctcattgcgacacccttaacaaccctatcaggcagaacaaattgctccgcaaacctgcggcttgcagagcgatggtggactcccgagctcatcgggtccggcacctcttcaccacggaggcctcgggtacggaactggagggagtcctggtgctcggaggagggtggaaggccaagatccctaggtcctggagcagggagccgggcccacgccgccgaggtatcttttccgtccgggccaccgtcgcgggggctcactggc

SEQ ID NO: 1847 - DNA, 7339 bp, Homo sapiens
ttaatagtgcattaaatattttatttaaattaagaagtataacaaaatcacatacatttgttccacggtttgaataaaatttccaataactttcaaataatgcacacatagtatcgcatggatcaaattccgtacatttcaatatggtcatgagataggctgtattccaaaatttggtatataaatccatacataatatatactatatacattgactttaaataatctaactatgtcatttttaaaagtcaaagcaacttatttctaatgaaagttacaatatgcatgccatattgacacctattcaatagataaaatctaggaaaatcttttttgtgaatactatttatactggaatgcaaattcacataaaaatacttcctttaaagcatgttctatttcacacaagaaattaaatgtgagctacttttaaaattgcaagctttatttttaatcaaaccaattcaattttaagtttttagatcattaagtctcatacaacttcctctaatttagctaaaaccatcgacagggttttattgttacatttggccttaaccttaaaaaacaaatttgtttacatttcatatttaaatgggacattttaaaccctgagtaaaaagacatatttttacaagtccagctgtaacaattctaccctattttcttgcagtgcttttattagataaaaactattgttaacgttttgactttttagaatatactgtttagaaggttaatgctttttcatgactttaaaagtttctaaatgtattttattagtatctaagtaaaaattctagatttctatatggatattataaaaacacctcttctttagactgtttatttcaccttgatcataaaaaatcattgaatactacattcaagataatttttctttcttggctttgggctattgtcttttcaaccttaaaagttaaaattattgttttcctatatgtaatgatactttttaggcatagatttttaagatacaaaaataaaatgtagtttagtattttatcattaccacctgctgcaatgagtctgccagatcagaggctttcctcactaggaaacctagctttaaatcaaatactggttttcttcttgtaattcacacttgtctattgaatcagttacccaactttcttttaggattttaaactttctcttaaaagttcttctaaaagctttaaaatctgcaacacgactatgatcttccccaattattacatgagacactccctcagctaaacaagaaactacttttgctccatgaaaccgaagctccaaggctttaatagctaaccttgtcccctcatttttggtactcaggtcattaataacagcatacgagtccaaataaacggtgtggcgtcgaaacatactgagaggagagcaatcccaggaataccgatattctaaatcagcaatcagagaagccatttcttcaggagtctgctcgttagaatttttaattcctgagaatacttccttcagttggttcaagtctgtatcaatgaaataactatcaccatagcaatcatattcacgggcaaaatgttctttggttgatgggcacatatgaatcataaagcgaggctgccatggtacaaagcttttggtcttaaaacattctaaaagccatgcaggcttgacaacatcatgtttatttgacaaaattatgtttttcactctgatgttctcagaccctgcaattacacagtacgtgtctgggcctggattttgtactatataaccaccaaattctgcaattctgttctccaggtcaggctttggctggctatctgttccactcataacacaaaactctacatcttcaaatatattagaaattttgttaacgttagtaaggttaggtgcttttaagtgctcaataattccaataactttcttcatctttggggcagctttccgctttttttcttgtggttcatcatcaccacctatataaaggtgtttagatgcgagcttaccagatgccttccccctaagttgttctaggtcgtccagggtcatgcactcatgccactccttgtcatctcttatcttttcaattcgtggaaaacgcaaggtgcagccagttttatacatatcactgggtacgatctctgctgctttaatctgaacaatgacagaattacaaggttcaatgtatacttctggcttctctgttccacataaaatgctgcttggtggagcttttctatgaaaaggcttccaatacttggccaatttcaaacccagatcatacagttctttcatggtgcagccagacccaacacgagagagagtatgaaacacagatggcttctcaccaggagggggcttctctgctactgcacacagaaaatgagacatcattccaccccgtgatcctttaccccaatatcctccaacaattaaaatgtccaattcatccattagtccactgacatactctggtttaatttttaaccacccttcacctcttttgtctggcttgtagatggatagaggttgttttaccataattccctcttctcttttatctattgcttcattcaatgcatcaattacttcattcttagtatgagcttgtgttttctgcactatttctattctacctggaattggtgtaaaaatactactaagaatctcatacctctttctcagagtctcatgccctagctttttattattaaccatcaatacatcaaaaacacaataacaagtttgcagatcagaatcctctaccattcttttaatatcaaacttagttcccttttgcatgaaagtttgtgtattaggattataggccatcatctcaccatcaagaatacagatttgtatatctgctttgaatgcattatgaatgaatggggtaagagaaccttcagtaggagaagcaccaaactgatcagtgtagttatatccatttcgagagaagtatttatatacatctccatctttgtgcatttgcatacgttcaccatctagcttggtttctatgtagaaactctgatgtttcatatccttctcaatgtgctcaatatctgcaatagcagctagcattggtttaaatgcagaaaataaagtgatagaaatatcactgagtcctacagaaggatcatgcagttgcctacagactttttccagatctgtagtgacattatgcaactcagcagcatcattatgaaaaacagaaaagatagtttgctgactaacaccaagctttaaatcctttatgatcatccgtataagccacttttgctcaagtgctgaactctgagttataagttgaagaaggctcttttttattaggtcttttcttttagcagaattattgctggcaattgagtctaaaaggtcgtttacttgctgtatggttaaacttcctttctgtaaacatcttggcttcaacacaaaatatgcaatcattgcaaagtctccagcatctccatgagttccagtgggtgttctgtagtttaaaagtttgagggcatcttttccatctctaggtaaattaagcaactcaatataaagcttagcaagcatagtttctttaattccataggccattctctctctttctagctgaggaagaattagtctcattgctggataaaaagagtctgtgacatctttgtggttcttatgaagagcatcatgaaattttctccaagaatctaaaaattccctgaagtgtctgattttttctgcacgtcctttacttttctgtattcgttctaaagttgaacacaaatctgcaaaaggaacgtgagatgcaacagtttgtgaagtttgtgaggcagccatcaaagcggtgatgaatcttctcgtttaactagtaaagcaaaaagagaataactttaagtaaaagataagattcaactaaatatttaatgtaaagatcttacaaagatcactgagatcataataaatgtttattaatgtttactaaaaaaaagatcaatgctctaaatgatgtatcttttcaacctctacatttaataactgttttgctccaaccctaatttgaagttattatgaaaagtatcatcagctatatagctgtatttcctgtatttataatacagaaatcattttaattttctctttaaattccagttattctatgtattaattatttagcacataatacaaacaaatattgctaataatggtgacaaaaaaactcatcaggcttaattcacttcacttctgagcttctgagggaaggcctttcatgtatgtctcttctttccctgtcagactaccacatagcaccagaaatgaacttgatcttcgaacagatatttttaacaaatcactcatttgctgaactgaaatttgacttcctagaaatcctaatcataggcagggcccttgaccaaaaaacaaaacaaaggaaaaaacaggtaccctcttcttccagccaaacaaagcctacgtctatgtttcctttcacttcttcactgctagctatgccaaatcacaccagcattcgattccaactcaaaatgccctacccataaaatcctcactttatctattttaccatagttacttactgtcttataagtataaatttattagtatgctgcttttttcatatttccatgccagttattccctgagtatttaatgactacatatgagatgtgctacatacactgtgctaggggaaaatactgcatgtttctgctttaaaagaaaatatattctgtaaaaaaaaaaaaagaaaaaaaagaaaagaaaaaaagggggggagtgtagtggaaactgagtataataaaatgccaagtgctttaacaaaataaaacaaacgtaaaatgtcctgaggggagagcttttccctaaagtatctgctaaagtcagagaagaaataatgggtaccttgctaagctagggcaagaatatttcctaaaatttcacaagtgtaaatttctttagttttaaatattcatacaagttctactggaagataaatatattagagtaattttaatatggtttaaactatgtaatgttaaataacttttccaaaaaaagatttcaagtaaaatgtatggtccatgaatagaaactatgttttatcctgtggtttcagacccctcctggcacaccaccatgtatcccaggcagtggagttggagaagttttgctgggagtggggagatctattacagtgcagaaaatatgtgactccccatcttccaattcgcaaacaaatgagcaacacacacatgcacaaggctacattatctagtatccagtaaaataaatcaaatggctaattacaatactacatttactatactgtcagtatctagaggccaggaattgtgctgtaatttgtgctctagtggcagacatgtaggaggtttgctgaatgaattactgaacacctagagttgactcctggataagcacactagggaaagctatggtctggttacataccacacactcacacacgcacgcagacacacagtgggtgagattcagtttggttaaaaatattcagtagctctgactgccctggcaatggtttacaacagccatttggtggcctatagagaaaaaaggtgcacttctcagtctaatttctgacaaaggaaacccagcttctactgagtgggttagatcgagggataaacgcatgacagaccactttcctgaaacttttatctttgaatatactgttgtttcctctctctgaatctggtttgcataactgactgtaacacctggttatgtatgttcactgccctatctcccaaaatttgctccctcaagggagtaaacagggtacacaatgctatatctacaatttctatataaactatgtaaaataaagtaggttaactaatatttctttaatattcaaatattggtatatagtttctacagatatatctatagattctacatggtctcaaagttaaagtttcgctcaacaaatcccaggcaaggacttaaattactttataatgacaaaatgtaggtaatggtgtggatacacatgtatcctaaaatggctacgcctataacaaggattccaaaattgccataaactagtcgtaagtatttttgctcattacaacggcataaaaagtcaaagattaggacttccattcatttttacatgctaattttattttttggattctgaggattttagctgattcattccatttgcagtaagacaaatgaggaggttcctggttagggctcaggttttagactctaataaatctgagttcaaatgtggatggtaacatttaacagctgtgtgatactgggcaattacttaatttctctaagcttcagtttcctaaagtataaaatggggttaaaaactatgtagaaattagaatgaagataaaaatcagataatctacaaaatgtgctttaaaaagtagtaagtcttgataattttaatactataatgcttgctgatccaagcaacatttaaaatataaatattgcaaaatattaacgagataaaaaggtgggaagaagcttcactctttaacaataagcaaagctttcaggagaatgaatgcaagcaattagtacacaataacgattcatcattcattcagttctgactaaattgtcctgaagtgacacatgaaaataaaccggcaggttttattcagtgactatggaaggtgattaagtgctatgctattgcacttaaaaaagagagaggaaaaaaaggagtaagtgacgaatgcaactgaagtatccttcatgcaacccttgacaagctgtgtttccctaggaaacaaagggtttacagctgcctatcttccacagcacttagtgacaatttgggacaatctcagcaaaaagaaatgagcagacaaagacgctagaagggctttgggatcccaaaagttaatgaaagaccaagtgtaagaagagaaataaagtaattccctccaagcctaaagtctctcccgctccaatgccccctgtaccctctcggaaaatggaaaatccctaaggagtctacatcattcctctgcccgttccccctactctcccccaacccttcacggattcccagtgaatacctggcctcgggcaagctccgttacctctgtgaaccagagaatcccagctgtaaaatgagatcttgatggtttcctgcggggttgccatgagaaagaatcaacatgtacgcaggtaaagcaggcaatacagttccagggagtcaaaaacgggagaaatcgtcccacgacctggggcttgggtctagatgaagagcacagcatcaggaggccaggcttctaatgcggcgcagtctacagcgctgtgg

SEQ ID NO: 1848 - DNA, 8091 bp, Homo sapiens
ttaatagtgcattaaatattttatttaaattaagaagtataacaaaatcacatacatttgttccacggtttgaataaaatttccaataactttcaaataatgcacacatagtatcgcatggatcaaattccgtacatttcaatatggtcatgagataggctgtattccaaaatttggtatataaatccatacataatatatactatatacattgactttaaataatctaactatgtcatttttaaaagtcaaagcaacttatttctaatgaaagttacaatatgcatgccatattgacacctattcaatagataaaatctaggaaaatcttttttgtgaatactatttatactggaatgcaaattcacataaaaatacttcctttaaagcatgttctatttcacacaagaaattaaatgtgagctacttttaaaattgcaagctttatttttaatcaaaccaattcaattttaagtttttagatcattaagtctcatacaacttcctctaatttagctaaaaccatcgacagggttttattgttacatttggccttaaccttaaaaaacaaatttgtttacatttcatatttaaatgggacattttaaaccctgagtaaaaagacatatttttacaagtccagctgtaacaattctaccctattttcttgcagtgcttttattagataaaaactattgttaacgttttgactttttagaatatactgtttagaaggttaatgctttttcatgactttaaaagtttctaaatgtattttattagtatctaagtaaaaattctagatttctatatggatattataaaaacacctcttctttagactgtttatttcaccttgatcataaaaaatcattgaatactacattcaagataatttttctttcttggctttgggctattgtcttttcaaccttaaaagttaaaattattgttttcctatatgtaatgatactttttaggcatagatttttaagatacaaaaataaaatgtagtttagtattttatcattaccacctgctgcaatgagtctgccagatcagaggctttcctcactaggaaacctagctttaaatcaaatactggttttcttcttgtaattcacacttgtctattgaatcagttacccaactttcttttaggattttaaactttctcttaaaagttcttctaaaagctttaaaatctgcaacacgactatgatcttccccaattattacatgagacactccctcagctaaacaagaaactacttttgctccatgaaaccgaagctccaaggctttaatagctaaccttgtcccctcatttttggtactcaggtcattaataacagcatacgagtccaaataaacggtgtggcgtcgaaacatactgagaggagagcaatcccaggaataccgatattctaaatcagcaatcagagaagccatttcttcaggagtctgctcgttagaatttttaattcctgagaatacttccttcagttggttcaagtctgtatcaatgaaataactatcaccatagcaatcatattcacgggcaaaatgttctttggttgatgggcacatatgaatcataaagcgaggctgccatggtacaaagcttttggtcttaaaacattctaaaagccatgcaggcttgacaacatcatgtttatttgacaaaattatgtttttcactctgatgttctcagaccctgcaattacacagtacgtgtctgggcctggattttgtactatataaccaccaaattctgcaattctgttctccaggtcaggctttggctggctatctgttccactcataacacaaaactctacatcttcaaatatattagaaattttgttaacgttagtaaggttaggtgcttttaagtgctcaataattccaataactttcttcatctttggggcagctttccgctttttttcttgtggttcatcatcaccacctatataaaggtgtttagatgcgagcttaccagatgccttccccctaagttgttctaggtcgtccagggtcatgcactcatgccactccttgtcatctcttatcttttcaattcgtggaaaacgcaaggtgcagccagttttatacatatcactgggtacgatctctgctgctttaatctgaacaatgacagaattacaaggttcaatgtatacttctggcttctctgttccacataaaatgctgcttggtggagcttttctatgaaaaggcttccaatacttggccaatttcaaacccagatcatacagttctttcatggtgcagccagacccaacacgagagagagtatgaaacacagatggcttctcaccaggagggggcttctctgctactgcacacagaaaatgagacatcattccaccccgtgatcctttaccccaatatcctccaacaattaaaatgtccaattcatccattagtccactgacatactctggtttaatttttaaccacccttcacctcttttgtctggcttgtagatggatagaggttgttttaccataattccctcttctcttttatctattgcttcattcaatgcatcaattacttcattcttagtatgagcttgtgttttctgcactatttctattctacctggaattggtgtaaaaatactactaagaatctcatacctctttctcagagtctcatgccctagctttttattattaaccatcaatacatcaaaaacacaataacaagtttgcagatcagaatcctctaccattcttttaatatcaaacttagttcccttttgcatgaaagtttgtgtattaggattataggccatcatctcaccatcaagaatacagatttgtatatctgctttgaatgcattatgaatgaatggggtaagagaaccttcagtaggagaagcaccaaactgatcagtgtagttatatccatttcgagagaagtatttatatacatctccatctttgtgcatttgcatacgttcaccatctagcttggtttctatgtagaaactctgatgtttcatatccttctcaatgtgctcaatatctgcaatagcagctagcattggtttaaatgcagaaaataaagtgatagaaatatcactgagtcctacagaaggatcatgcagttgcctacagactttttccagatctgtagtgacattatgcaactcagcagcatcattatgaaaaacagaaaagatagtttgctgactaacaccaagctttaaatcctttatgatcatccgtataagccacttttgctcaagtgctgaactctgagttataagttgaagaaggctcttttttattaggtcttttcttttagcagaattattgctggcaattgagtctaaaaggtcgtttacttgctgtatggttaaacttcctttctgtaaacatcttggcttcaacacaaaatatgcaatcattgcaaagtctccagcatctccatgagttccagtgggtgttctgtagtttaaaagtttgagggcatcttttccatctctaggtaaattaagcaactcaatataaagcttagcaagcatagtttctttaattccataggccattctctctctttctagctgaggaagaattagtctcattgctggataaaaagagtctgtgacatctttgtggttcttatgaagagcatcatgaaattttctccaagaatctaaaaattccctgaagtgtctgattttttctgcacgtcctttacttttctgtattcgttctaaagttgaacacaaatctgcaaaaggaacgtgagatgcaacagtttgtgaagtttgtgaggcagccatcaaagcggtgatgaatcttctcgtttaactagtaaagcaaaaagagaataactttaagtaaaagataagattcaactaaatatttaatgtaaagatcttacaaagatcactgagatcataataaatgtttattaatgtttactaaaaaaaagatcaatgctctaaatgatgtatcttttcaacctctacatttaataactgttttgctccaaccctaatttgaagttattatgaaaagtatcatcagctatatagctgtatttcctgtatttataatacagaaatcattttaattttctctttaaattccagttattctatgtattaattatttagcacataatacaaacaaatattgctaataatggtgacaaaaaaactcatcaggcttaattcacttcacttctgagcttctgagggaaggcctttcatgtatgtctcttctttccctgtcagactaccacatagcaccagaaatgaacttgatcttcgaacagatatttttaacaaatcactcatttgctgaactgaaatttgacttcctagaaatcctaatcataggcagggcccttgaccaaaaaacaaaacaaaggaaaaaacaggtaccctcttcttccagccaaacaaagcctacgtctatgtttcctttcacttcttcactgctagctatgccaaatcacaccagcattcgattccaactcaaaatgccctacccataaaatcctcactttatctattttaccatagttacttactgtcttataagtataaatttattagtatgctgcttttttcatatttccatgccagttattccctgagtatttaatgactacatatgagatgtgctacatacactgtgctaggggaaaatactgcatgtttctgctttaaaagaaaatatattctgtaaaaaaaaaaaaagaaaaaaaagaaaagaaaaaaagggggggagtgtagtggaaactgagtataataaaatgccaagtgctttaacaaaataaaacaaacgtaaaatgtcctgaggggagagcttttccctaaagtatctgctaaagtcagagaagaaataatgggtaccttgctaagctagggcaagaatatttcctaaaatttcacaagtgtaaatttctttagttttaaatattcatacaagttctactggaagataaatatattagagtaattttaatatggtttaaactatgtaatgttaaataacttttccaaaaaaagatttcaagtaaaatgtatggtccatgaatagaaactatgttttatcctgtggtttcagacccctcctggcacaccaccatgtatcccaggcagtggagttggagaagttttgctgggagtggggagatctattacagtgcagaaaatatgtgactccccatcttccaattcgcaaacaaatgagcaacacacacatgcacaaggctacattatctagtatccagtaaaataaatcaaatggctaattacaatactacatttactatactgtcagtatctagaggccaggaattgtgctgtaatttgtgctctagtggcagacatgtaggaggtttgctgaatgaattactgaacacctagagttgactcctggataagcacactagggaaagctatggtctggttacataccacacactcacacacgcacgcagacacacagtgggtgagattcagtttggttaaaaatattcagtagctctgactgccctggcaatggtttacaacagccatttggtggcctatagagaaaaaaggtgcacttctcagtctaatttctgacaaaggaaacccagcttctactgagtgggttagatcgagggataaacgcatgacagaccactttcctgaaacttttatctttgaatatactgttgtttcctctctctgaatctggtttgcataactgactgtaacacctggttatgtatgttcactgccctatctcccaaaatttgctccctcaagggagtaaacagggtacacaatgctatatctacaatttctatataaactatgtaaaataaagtaggttaactaatatttctttaatattcaaatattggtatatagtttctacagatatatctatagattctacatggtctcaaagttaaagtttcgctcaacaaatcccaggcaaggacttaaattactttataatgacaaaatgtaggtaatggtgtggatacacatgtatcctaaaatggctacgcctataacaaggattccaaaattgccataaactagtcgtaagtatttttgctcattacaacggcataaaaagtcaaagattaggacttccattcatttttacatgctaattttattttttggattctgaggattttagctgattcattccatttgcagtaagacaaatgaggaggttcctggttagggctcaggttttagactctaataaatctgagttcaaatgtggatggtaacatttaacagctgtgtgatactgggcaattacttaatttctctaagcttcagtttcctaaagtataaaatggggttaaaaactatgtagaaattagaatgaagataaaaatcagataatctacaaaatgtgctttaaaaagtagtaagtcttgataattttaatactataatgcttgctgatccaagcaacatttaaaatataaatattgcaaaatattaacgagataaaaaggtgggaagaagcttcactctttaacaataagcaaagctttcaggagaatgaatgcaagcaattagtacacaataacgattcatcattcattcagttctgactaaattgtcctgaagtgacacatgaaaataaaccggcaggttttattcagtgactatggaaggtgattaagtgctatgctattgcacttaaaaaagagagaggaaaaaaaggagtaagtgacgaatgcaactgaagtatccttcatgcaacccttgacaagctgtgtttccctaggaaacaaagggtttacagctgcctatcttccacagcacttagtgacaatttgggacaatctcagcaaaaagaaatgagcagacaaagacgctagaagggctttgggatcccaaaagttaatgaaagaccaagtgtaagaagagaaataaagtaattccctccaagcctaaagtctctcccgctccaatgccccctgtaccctctcggaaaatggaaaatccctaaggagtctacatcattcctctgcccgttccccctactctcccccaacccttcacggattcccagtgaatacctggcctcgggcaagctccgttacctctgtgaaccagagaatcccagctgtaaaatgagatcttgatggtttcctgcggggttgccatgagaaagaatcaacatgtacgcaggtaaagcaggcaatacagttccagggagtcaaaaacgggagaaatcgtcccacgacctggggcttgggtctagatgaagagcacagcatcaggaggccaggcttctaatgcggcgcagtctacagcgctgtggactcggcaactcccatcacctgccgctgcacaaacaccctgcttgctgcccccatagaccgacccccgcctgacgcctcccagacccccccacctgacgcccctcaggccccccgcctgacgtcccagacacccccacgaccggatcccccagacccccaatctgacgccccacttcccctacttgactccccacacatcccccgcctgacgaccccccgacccccgcctgacgtcccagacaccacccatctgatcccccagacccccaatctgacgccccacaccccccacttgactctccacacaccccacacctgccaccccacgtaaaccccgcctgacacctcacagaccctaacctgacgccccacagacctcccccgcctcctgccgccacacacaccccaaaccccgccccgaacaccccccacctgccgccccacagattcccccctctgacgccccacagacccccaacgtgacgccctacagaccccaacctgacgtcccacagataccccgcctgacgccccacagaccttcccccggtctgttgccccacagacttctcgccgcctgctggaccacaccttccacttgactccccccacaccgtcaatctgccaccccccaccccccccaccccaaccccccccaacctcccaaccgcccccacctgccaccccacacccttcccacctgacgtcaagcctgaagctcagccgctaagccggaagctggcgccagaag

SEQ ID NO: 1849 - DNA, 750609 bp, Homo sapiens
ttcacaacatacaaagaatttatttatgcaatacaggccttttctcaaatatttttcacagaattccacacagtaatctactagaaaagtagaattatacaccaccaaataacattgtttcgtttcttagtacaaattgctaatcaaaaggaaggtggagatgatagtttaataacaaatagtaaaacaggtgttgctgaatacagcacccggtagcctctatttgcaaacccggggagggaagggggtgccccaacaaaacaacagtggctccgcctcattgtccaggcacaggcaaaccgcagtagtgagctttggtacttgcatttactttaaaagaaaaacaaatgttgtgagctcaagagcatttccatcatttcgttttgttgtgctatgaagatgacagatcaggaaaaaatggtaactatttcacacttgctataaattagattccttgtgctaaccacacaataaaatagcctcccccaaaccatacttttctaggtctaaaacatgcttgaagaacaatattgatagacagacttaattgagatgttttaaattacatttaccataatttaaacattactatttaaatcccagaaatattagtgctgaagaagcacagttgtttggaaaaatacaggacccaaattacagcatcaaattttcctattccaatattgtaacccacttccccactgtgaaaatcctatttctcaagcttgtagatgcatgggaaatgttcttcataatattatagctggaataagtggtttacttgctccactgtatgtttccataattggtgaaaatagacttctcattatgactaaaaatatagattttttaaaactacagaacccagcagccagttttctgctttgctaatcccccccaaaaaagtcaagcaaagactacaaaaatagcaattattaataactttaaaaaatattttgcttctttgagcaaatttaagttacattcagatgtggtagaagagaatgatgctccaggtacttctgctcatcctaggggcagagttgatgtacagctgtcaccatcagtagcgggtttggtattcatgatgccaccggttaaagtcgttgtaaaatagcacaatgcttcctgaagccatgccagaaatgatgcacctaggagaagcacagagagaaggacttttacaaacctgtgtgtcctagagatgttactaaaaactgctctccccaaatccacaaggtaaatatagaagctggcagtgaaggctccaatttgtgggaactaaggtatgtatttcatgactaaaatgtatccctgagtaagctcagagtactgcctctgacactccacaaggatccaagccacagcttgctttttcattgaaagggtacggacagctggtatgtgcaggatgagtaactaaaatctgaacagatttgtaactaaaatctgaacagatttggtaatttctaaagggggactgggctggcaagacccatccattatataagcaacagactcaaaagaaggaaccacaatctcaaagtaactgctggtggaaagaagcagcacacactcaagtgacaagagacaccacctctgacaggtacagaatcaatgaagagtgaaaaagaagagtgttgttgaccataatttaagctggtctcccctctgtggagaagtagtctatgtccatcatgctctgggtgaggacctagtcctcgtaacacagtaactcaccgaaatcactgaagataagaacttctgcaagcttcttggtctcctgtccccaaagaggtggtgcagggaaagagatggagaacataggtgaacctaaactgagcatagccagatttttctctgtgtagtttggttaggaccagcccttagaagccatattcagtatccttcctagtacctcgtatcaaaattaattaggaactaaaatgtgtcactacaaaaaaaatcaactaaaaacaaaggaagacagtaaggaggaaatgagagacaaaactctaaggcagagagaaaattaaatagaaaagtggcaaaagtcagtctttccttatcagtcattaaagagattaaattctccagccaaaaggaagagattggcagaatggataaaaaacatgatccaactatatgctgtctacaggagacccacttgagatctaaagacaaacatcttgaaagtgaaaggatggaaaagatattccgtgtaagtactagcaaagagagctgaggtggcttacactaatatcagacaaaatagtctttcagtcaaaaactgttacaagagacaaaggacactacactgagaaaagggtaaattcacagaaatataacaattatatatgcatttatcatcagacccccaagatacaaagagcaaatattaacagaattgaagggagaaatggttctacagtaatagttttagacgtcaataccccactttcaataatgggtggaacaaccaggtggaagataaggaaacaggacacttgaacaatacgataagccaactggacctgacacacgtatatagaacaccttcccaacaacaatagaatatacatttttttgcagtgcgcatggaatagtctccaagataaaccatatgttaggccacaagtgttaatgacttagtaaagattaaaatcacaaagtagcttttctgatcataatagaatgaaactaggtaccaataactgaaggtaaactagaaaattcacaaatatgtggaaagtaaataaatgatgagtcaaaaaaaacaaacaacaacataagagacatcagaaaatactgagacaaatgaaaaggaaatacaacaagccaaaacttatgaaatgcagcaaaagcaatgctaaaatggaaatttttagctgtaaacacatagatttaaaaatatctcaaatcaataacctaactttacctcttaaggaactagaaaacagacaaaaccccaggctaggcagaaggaagaaaataataaagaacagagtagagagaaataaagcagaaaatagtaaaatgattgataggaaaaaacccaaaaattggttctttgaaaaaataacaaaattgacaaacctctagctagactaagatgacttggctgggcatggtggatcatgcctgtaatcccagcactttgggaggccaaggtgggtggatcacctggggtcaggagttcgagaccagcctggccaacccggggaaacctcgtctctactaaaaatacaaaaattaactgggcgtggtagtgggcacctgtaatcccagctacttggaaggctgaggcaggagaatcacttgaacctgggaagcagaggttgcagtgagctgagattgcaccattgcactccagcctgggtgatagagtgagactccatctcaaaaaaaaaaaaaaaatgactcaaattactaaaatcagaaataaaagttgggacattactgatttggcagaaactgagttcagagagactattagaaacaactgtataccaacaaatagggcaacctagatgaaatagacaaattcctgaaaacagtataccaaaactgaatgaagaaatagaaatgattagacttatgacaagtgaagagattgaatcagtaatcaaaaacctcccaataagaaaagtcctagacaagatggcttcactgatgaattctaccaaacatttaaagaagtattaacaccaatccttctcaatttcttcttccaaaaaattaaagaatccagaacacttcctaagtgattcaataaggccagtattaccatgacaccaaagccagttgaagacattacaacaaaagaacacacagaccaggatacaaaatactagcaaactgaattcactagcatggtagtgggaatgtacaccatgacccagtgggattcattctgggaatgcaaggatgactcaccatgcaaaagtcaaccaacatataacatactacattaacagaacaaacaacaaaacaagcccacatgatcatctcaactgatgctggaaaatttgacatgtgacaaaattcatcatccttttattatgaaaacaataggagtagaaggaaactacctcaaatgataaacagcatgtatgaataactcacagctaacaccacactcgatgaaaaaaagtttttcccctatgattgggaacaaggcaaggatgcccactttaatcactcttatccaacagtactgaaagtcctagacagagcaattacacaagaaaaaagtatccaaattggaaaggaggagtgaaactgtctctgtttacagatgacatgatcttgtatgtaggaaatcctaaaaattccacaccaaaacaaaacaaaagagctaataaatgaattcagcaaatttgcaggatatacaacacgaaaatcagttgcatttttatacactaacaaacaatgagcagtccaaaaggaaaattaagaattgcagtgagccgagatcatgccattgcactccagcctgggtgacagagcgaaacagaaacccctaacagccaaaacaatcttgaaaaagaagaaatatgttagcagttgcacattttctgatttgaaaacttacttactgttgttacaatgcgacagtaatcaaaacattgtcacactgatataggcagaccaacagaagagaaagttgagaaataatccctcacatatgtgctcaaatagggtgccaagacctttcaacggagaaagcaccttcttttcaacaaattatgctgggaaaataggatgtccacatgcaaaacaatgaaggtggactcttacctaccattatattaaaaaactaaaaacagatcaaaaacctaaatacaaattaaaactataaaacttttagatgaaaacatatgggaaaaccttcatgaccttggattttgcagtggcttcttggatatgatatcaaaacaaaagagacaagataacaaaacaaactcataacaaaaaataggacttcataaaatgtaaaatcagggctaggtatagtggcttatggctataatcccatccctttgggtggctgagtcagcaggattgtttgtttgagcccaggagtttaagaccagcctgggcaacatagtgagaccctgtctctacagaaaataaaaaagctgggcatggtggcacatgcctggagtaccagctaccatgtagctgaggcgggagaatcatttgagcccaggaggttgaggcttcagtgagctgtgattgtgccactgcactccagtctgggcaaaagagtgagaccctgtctcaaaaaacaaacaaaaagtaaaatcttttgagcatctaaggatattaggaagagagtgaaaagacaacatcactgatcattagggaaatcaaaaccacaatgagagaccacgcctgttaggacaactgttaaaaaatagagcaaggtgttgataaggatgtggagaaattggaacccatgtaaaatggtacagccactgtggaaaacactttagggtttcctcaaaaagtcaaacggaattgccatataacccagcaattccactcctgggcatacacccaaaaggactgtaaaaagggacttgaatagatatttgtatgataatgttcatagcagcattactcaccatagccaaaaggtagaaacaacccaagtgtccatcatcaacaggtgaacgataaacagaacacagaatattcatataatattctgatacgtgctacgacatgcaagaaccttgaaagtgttatgccaagtgaaataagccaggcacaacacaacaaatattgtatgattccacttaacagaaggtgcttagaagaggcaaattcatagagacagaaagtagcatgcacatgagctggtgggagagagagtcattaacatgcagagcttctgtttatgatgaaaagggtctggaaatggatgatggtgatggtggcacaacactgtaaatgtacataatgccactaaattatatatcgaaaagagtttagatggaaaatattatatgttgccacaattttttttaaaaggaacaaaaatgagtgactatacgttaagaggaaataaggtgccagataaagatgatccccccaaaatctaccacttgagagcttttaggaaataagccctatctttcaggggactctccatatgcagagatatgcagagataaaggcattttacattaaacatctttacagctctttcaattttatttactgataaagatgatgatacttcttcaggctggcaatcgccgaataggagcagatctggtctgcagctcccagtgagattgacgctgggtggatgatttctgcatttccaactgaggtacctggttcatctcgttgggactggttggacagtgggtgcagcccacggagggcaagccgaagcagggtggggtgttgcctcacccatggaagcacaaggggtcggggaattccctcccccagccaatggaggctgtgagggactgtgccatgaggaatggtgcactctggcccagatactgcgcttttcccacagtcttcacaacctgcagaccaggagattcccttgggtgcctacaccaccagggccctgggttttaagcacaaaacagggcggccgtttgggtagacactgagctagctgcaggagtttttttttttttttcataccccagtggtgcctggaatgccagcgagacagaaccgtttactcccctggaaaggaggctgaagccagggagccaagtggtctggctcggtgggtcccactcccatggagcccagcaagctaagatccactggcttgaaattcttgctgccagcacagcagtctgaagttgacctgggacactcaagcttggtggggggaggagcagccagggagccaagtggtctggctcggtgggtcccactcccatggagcccagcaagctaagatccactggcttgaaattcttgctgccagcacagcagtctgaagttgacctgggacactcaagcttggtggggggaggagcgtccgccattggtgaggcttgagtaggtggttttaccctcacggtgtaaacaaagcctctggggagttcgaattgggtggagctcactgcagctcagcaaggccactgtggccagactgcctctctagattcctcctctctgggcagggcatctctgaaaaaaaaggcagcagccccagttaggggcttatagataaaacccccatctccctgggacagagcacctgggggaaggggcagctgtgggtgcagcttcagcagacttaaatgtccctgtctgacagctctgaagacagcagtggatctcccaggacagcatttgagctctgctaatggtcaaactgcctcctcaagtgggtcctcaacccctgtgtctcctgactgggagacacctcatacaggagagctctggcggaggcccctctggaatgaagcttccagaggaaggaactggcagcaatgtttgctgttctgtagcctccactggtgatacccaggtaaacagggtctggaatggacctctagcaaactccagcagagctgcagctgagaggcctgtgagaaggaaaactaacaaacaggaatagcgtcaacatcaacaaaaaggatgtctagacacagaaaacccatccaaaggtcaccaacatcaaagactaaagaaagatagataaatccacaaaaatggggagaaaccagtgcaaaaagctgaaaattgcaaaaaccagaatgcctcttctccaaaggattacaactccttgccagaaaaatggaacaaagctgaacagtttgagaaattaacagaagtaggcttcagaaggtgggtaataaactcctccgagctaaaggatcacgttctaatccaatgcaaggaagctaagaaccttgaaaaaaagttagacgaattgctaactagaataaccagtttagagaagaacataaatgacctgatggagctgaaaaacacagcacgagaacttcatgaagcatacacaagtatcaatagccaaatcgatcaagcagaagaaaggatatcagagattgaagatcaacttaatgaaataaagagagaagattagagaaaaaagaatgaaaaggaacaaacaaagccttcaagaaatataggactatgtgaaaagaccaaatctacatttgatttgtatacctgaaggtgacagggagaatggaaccaagttggaaaacactctgcaggatattatccaggagaacgtccccaacctagcaagacagaccaacattcaaattcaggaaatacagagaacaccacaaagatacttctcaagaagagcaactccaggacacataatcatcagattatgtgaaggtagaaatgaaggaaaaattgttaagggcagccagaaagaaaggtcaggttacccacaaagcaaagcccatcagactaacagcggatctctcagcagaaaccctacaagccagaagagagtgggggccaatattcaacattctctaagaaaataattctcaacccagaatttcatatccagccaaactaagcttcataagcaaaggagaaataaaatcctttacagacaagcaagtgttgagacatttagtcaccaccaggcctgccttacaagagctcctgaaggaagcactagacatggaaaggaacaaccggtaccagccactatgaaaacataccaaattgtaaacaccatcgacgctatgaaggaaactgcatcaactaatgagcaaaataaccagctagcatcataatgacaggatcaaattcacacataacaatattaactttaaatgtaaatggactaaatgctccaattaaaagacacagactggcaaattggataaagagtcaagacccatcagtgtgctatattcaggagacccatctcacatgcaaagacacacataggctcaaaataaagggatggaggaagattttccaagcaaatggaaagaaaaaaaaaaagcagggttgcaatcctagtctctgataaagcagactttaaatcaacaaagatcaaaagagacaaagaaggccatgacataatggtaaagggatcaatgcaacaacaagacctatcctaaatatatatgcacccaatacaggagcacccagattcataaagcaagttcttagagacctacaaagagacttagactcccacacaataatagtgggagattttaacaccccactgtcaatattagatcaatgagacagaaaagcaacaacaaggatattcagaacttgaactcagctctggaccaagcagacctaacagacatctacagaaatctccaccccaaatcatcagaatattcattcttctcagcaccacactgcacttattctaaaattgaccacataattgaaagtaaaacactcctcagcaaatgcaaaagaatggaaatcataaccaatagtctctcagacgcagtgcaatcaaattagaactcaggattaagacactcactcaaaaccgcacaactacatagaaactgaacaatttgctcctgaatgactactgggcaaatactgaaatgaaggcagaaataaagatgttacttgaaaccaatgagaacaaagacacaacataccagaatctctgggacacatttaaaatagtgttttgaaggaaatttatagtacgtaatgcccacaagagaaagcaggaaagatttaaaatcaacaccctaacatcacaattaaaagaactacagaaggaagagcaaacacattcaaaagctagcagaagacactaagatcagaggagaactgaaggagacagagacacaaaaaacccttcagatcaatgaatccaggagctggtttttttgaaatgatcaacaaaatagaccactagccagattaatacacaagaaaagagagaagaatcaaatatacacaataaaaaatgataaaggggttatcaccactgatcacacagaaatacaaactaccatcagagaatactataaacacctctacgcaaataaactagaaaatctagaagaaatggatacattcttgggcacatacaccctccaaagtctaaaccaggaagaagtcaaatccctgaatagaccaataacaagttctgaaatcaatagcctaccaaccaaaaaaagtccaggaccagacagattcacagccaatttctaccagaggtacaaaaaggagctggtaccattccttctgaaactattccaatcaatagaaaaagagggaatcctaactcattttatgaggccagcatcatcctgataccaaaacctggcagagacacaagaaagaaagaaaatttcaggccaatatgcctaatgaacatcaatgcgaaaatcctcaataaaatactggcaaaccaaatccaggagcacatcaaaaagcttatccaccatgatcaagtgggcttcatccctaggatgcaaggctggttcaacatacacaaatcaataaaagtaatccatcacataaacagaatcaatgacaaaaaccacatgattatctcaatagatgcagaaaaggccttcaacaaaattcaccaccccttcatcctaaaaactctcaataaactaggtactgatggaatgtatctcaaaataataagagctatttatgacaaacccacagccaatatcatactgaatgggcaaaaactgaagcattccctttgaaaactggcacaagacaaggatataccctctctcaccactcctattcaacatagtattggaagttctggccagggcaatcaggcaagagaaagaaagaaagggtattcagataggaaaagaggaagtcaaattatccctgtttgcagatgacatgattgtatatttagaaaaccccagcatctcagcccaaaatctccttaagctgataggcaacttcagcaaagtctcaggatacaaaatcaatgtgcaaaaatcacaagcattcctatacaccaataacagacaaacagccaaatcatgagtgaactcccattcacaattgctacaaagacaattaaatacctaggaatctaacttacaagggatgtgaaggacctcttcaaggagaactacaaaccactgctcaaggaaataagagaggacacaaataagtggaaaaacattccatgctcatggataggaagaatcaatattgtgaaaatggtcatactgcccaaagtaatttatagagtcaattcaatgctatccccatcaagctaccattgactttcttcacagaattagaaaaaactactttaaatttcatatggaaccaaaaaagagcctgtatagccaagacaatcctaagcaaaaagaacaaagctggaggcaccatactacctgacttcaaactatactacaaggctacagtaaccaaaacagcatggtactggtaccaaaacagatatatagaccaatggaacagaacagaggcctcagaaataacaccatgcatctacaaccatctgatctttgacaaacctgacacaaacaagcaatggggaaaggattccctaattagtaaatggtgttgggaaaactggctagccatatgcagaaaactgaaactggaccccttccttacaccttatacaaaaattaactcaagatggatgaaagacttaaacgtaaggcctaaaaccataaaaaccctagaaggaaacctaggcaataccattcaggacataggcatgggcaaagacttcatgactaaaacaccaaaagcaatggcaacaaaagccaaaattgacaaatgggatctaattaaagagcttctgcacagcaaaagaaactatcatcagagtgaacaggtaggctacagaattggagaaaatttttgcaatctatccaactgacaaagggctaatatccagaatctacaaagaacttaaacaaatttacaagaaaaaaacaaccccatcaaaaagtgggcaaaagatatgaacagacacttctcaaaagaagacatttacgcagccaacaaacatatgaataaaagctctttatcactggtcattagagaaatgcaaatcaaaaccacaatgagacaccatctcacacccttcagaatggcaatcattaaaaagttaggaaacaacagatgctggagaggatgtggagaaacagaaatgcttttacatcgttggtgggagtgtaaattagttcaaccattgtagaagacagtgtggcaattcctcaaggatatagaaccagaaataccatttgacccacaatctcattactgggtatatacccaaaggattataaatcattctagtataaagacacatgcacatctatgtttattgcggcactattcacaatagcaaagacttggaaccaacccaaatgcccatcaatgatagactggataaagaaaatgtggcacatatacgccatggaatactatgcagccatacaaaagaatgagttcatgtcctttgcagggacatggatgaagctggaaactgtcattctcagcaaactaacacaggaacagaaaagcaaatacctcatcttctcactcataagtgggagttgaacaaagagaacatatggacacagaggaacatcacatacgggggcctgttgtgggggtgggggcctaggggagggatagcattaggagaaatacctaatgtagatgatgggttgatgggtgcagcagaccaccatggcacatgtatacctatgtaacaaactgcgttctgcacatgtaccccagaacttaaggtataatttaaaaaaagatacttcaaagaaatataaaaagctttgcatcactgtaatcagagcctttgctacttaaattctgtctattccttgagaactcagcctttgtccaagagtggcaatgtcatcagaaagaaaatcacactttttaaaaaagtgttcttggtttgattgtacaggtgacccccacaactcaactccatcagcccatttaaataaattccctctgcaggttttactatacaattttgaaaaaaaaattttttttttctgtagagacagggtcttgcaatgttgcccaggctggcttcgaactcctgggctcaagtgattctcctgcctcagcctcccaaagtactgggattacaggtgtaagccaacacgaccagtcccctctgcagtttttgaaacccctatttgtagcccatgattccagtgttacctctggtcgtaagacagcgccatggcccggattccagcgtcacatcctggataggcaaagagctgcttgaggtccgacacctgccggaccacgaccactcctctgtctcctcctgtgagcaggtactgcccatctcggctcagctggatggcctgtgagacacagcaacattcagtagaaatgtggttctaggaaactttcggcccccaccctgtttttgagtcattcttacaccagctactacggtgcagagagaagagagagagatcctcaggagtttttagaaaatcgtgagttgtagaagatctgccatttttcaaaaaccaaatggacaaagttcatcaatgcttgagattgttttggctttgcttttttaaatactaggtagcaaactcttccagttctacaaatgctactggaatggtgtgtgttgtggactgggaccagtgctctaatgagaagccctggcatctcttcatttgcactgcagacatgctaataagcctgttttgtcccaagacttggcagatggtgccacctgaccttacatcccctctaatcccctgcaactccagctggagggaggcggccagcagcctcggcaccttccctgagcctgctggattttgacagcagttgggaagaagactttgtagagagctacaacaacttccagggtgattaaatctcagttcagcattttcttgctccagggctgacagtgctccagcctgtggtttagtcagctctaggctgtgcccctctgtcctttcctactagcgctgaacagacagtacaggctcagaatttgctctttgatcctgtaaaatgggcatccatgaatgaaagcctgcgggccaagtgcagcccactgcctgtttcatataattgtttaacattttttaatgcttgaatttttcatgacacatgaatatttatatgaattccaaatttgaatccccataaacaggtttttttttttcccccctcgagacagggtcttgctctgtcacccaggctggagtgcagtggcgcagtctcagctcactacaatctccacctctcaggttcaagtgattctcatacctcaacctcctgagcagttgggattacaggtgcccaccacaacacccgtctaacttttgtatttttagtagagacggggtttcaccatgttggtcaggctggtcttgaactcctgacctcaagtgatccacccgctcggactcccaaagtgctgggattacaggcgagaaccactgcgcctggccttccataaataaggttttaccagaacatcgccacacctattatttgtttatgactgctttcacaggtagttgcagcagagaatgcagaaccctcaaagctgaaaatatttactttctgtccatttatagaaaaagtgtgattactcctaattgtccctccctcctccaaaagccaatcctattaccccttcctctcctcctgcctggtacctccaagccttgctttcttagcttattaagatacaaatttcctttctttagtggatggcatcagagttttaaagccactacaaacacctgtaatcgcatgtccacctggacacaggggaatacagattgtgctggcaagccagaaagaaaaaaacctaatttctgatacattgacactgttctacattcagttctagcatagctgccttaagtcttcactgtttgacatatcttttaaaaaatcatagaaaggcaaagactttcttagccatttatttcacattcacccaaatgccaacttttagtagtcccttaaatacagcttattctcaagaacacaaaaacacatctaggaaataaaaacccatgtgtggaagacagttagttacatattctctaagttttgttaacacagatattaagatattttcaagatgagcaaaaatcagtatccttttcccccactcatttcacaaatggcaatctctaggggtgtctgggaactgcagtggagactaggacaaacaattatttgctacacttataaaattcagctgatgaaaatccattaaccttatggttgtagttcatttgaatttgatacttgaagctttttactggataagtgttatactaaaacaaaaccactgatctttaattctttgttctagtaaagaatctctaatcctgcttccatctgaaattaagtaaaacctgggctttagggactatacagtcatcagcattcaaaacattttaatgaatcagatgcctcccaaggtgaaaaaagatttcgctggcctctttcaggagaggccaaattcctctggcggcaagagccagggtaacatttagcaagcagcacctgatctcccactcaaattctgacaggccgcctccgcatccaggttgggttgtgactagaggttttcagagggccccagacacatgttaatctcatcccctgaaatcctgagtgctctggacaatgccgtggctgcacgggttttaaggaggtagtagcaggccacagcaatctgctggggatgaccacattctaaaacagcctcaggaagggaaaacaaatgcattcccctgggtgaatggtggttctcccttgtttaggacaaaataactttgctgctctgtacaggctgcctccttaaatatcagctattcataaagacatctcaacactgtctagttgatggactgtgatatgctgctaaccaaaatgccacagagcaatctggcatctaaaataaaaataggtgggaagtgcagagcttccccaggctgcctgcctgcagggttcttggtatttcacagaaacttaatttctggtctgagctgatgactaatttgtttccatggtgtccattccttatatgggctcagattgaggaaggagctggagattctgccctgtggtgtcttggattcccagcctgtggcttccttcctcgcctcccgaggtagtgagctgtgaaagtatcagtctctggagctgtgggcaggtattgctcattttaggcaagctcgctttaatcacacagttgccacttgcaagttagcatgataaagtgcaggagtgctgggaaaaaggcaatggattgtttaagcctaaaatccagtgggaaatattaaagagggaaaaagcaatggctacagggcagagaggagaagcatgtgtgtatgaatggtctgcagaaagcctcccactgctgcctcaaggaacttcccagagcccctggtactaactgaaatgccacagaaattgcttcagtcagccagggatctcaaattattttacagatttattagcgtagctgacaatataatcgcaactcaaagtgacagattatccacattattattgtaaagaaaagaggaaaagaaaatcctctgatgtgtacttggtttaaatgcagcattatgggaaggtagggaaaaataaaagcgagtacgagtgtgtctctgtgcgtgcctcgtggaggccggcagaatgtgatggagagaccgcagagaacagtggagacaagaaggaagccgtccactgaatcaagaaatgaatcccaggagacagagcagcaagggtccttcatttcctcaatgtaacctatatgtaggagctttgttccctgagaccagtatttacttaggagaagggggtgatcagactagatctgggaaagtgggagaatttatgacatctaagctgcataggtcagaatagcaatgagtgaaatatccagagctagcccaacgccagggtagaagcccctgtgaccctactcctgcccccaacatgtcctgggtcccctcattgtatacagctcacatgccccgccctccagcctgattctggaaaatgaggaccaccccagctttattttactttaaccttcaccaaggagtttggaggtaagaaacaaaggaccttgagaaactagcctctgaaaagaatagttcttactctttttctcaatgtctaatacttgtggagtcctgtcctggagatgaagcaagagcccagaaggtccactggcggtgccatttcgggtagacccagtgggagaaaatgcctgcctaattcatatcataatttgaagcccagcttctttaacatgtttttggtcttgttgtccataaagaagtcatagctgaaattaataaacctaaatagtcataatccctactgctcccaccaccaagctattcagatgtaaagagaatccagttttaagtgtcatctaatgtactatttcagctttcatactcagaaaacaatgtgcagtgcattttcttagaaaaaaagaaatgagcagtgccactaaaagccacccaggatggcttcagaagcccctaagaaaacctcttctattgaaggaccgtcctcagctgcgctgagtgacgtggtcagcacagctggcactgctgtggtgtgtgaagtgtgtgagccttgtctgagtgctacctaaagattttttgttggtatggaaaagaggccctcggcaatccaaaaatagaggtttctttcgcgaaccctctccctccccacttgacacacgttgaggtaaaagtcgtgaatgctgaagagtccccagggcactcactcttatgttatcatctgtttccatcgtggcctggagttttccattcacactgaatgtacagaagaggccgttttcatagaatatgacacaatgaccctctcttgaagcctgaatgagttttggtttcaggcagttttcaggaccctccaaggtcctcaacaagtctccattcatggaatgtatgagacatggtccttctgagaagagaggagaaataaaaggcaaaattattgaatgaaaacagacaatatgatctgaatcttgagcacagatcaaacaggattatagaaccacactatagatgtagaaagcctttaaaaaacttccatcttacgtgtaagttattttgcaaaatctcctcttcatgtttgccagatctcaccttccactcaggagaggagagaagccaaaccatgtaagtccaagttcactttcctcaagagacaggaagttactctatgaaattcattatgctaacaggcaatacaaactggaggaactgagaaacaggataagcttcaaattctagcacagcttcaaggaggctgggatgcaaacaaacaagggctgcgggcaggtacactaagacctctccctgcaccttgcaggagccccaacggccacggcactgtgggcctatgcagggacagccagctcaatcagcctctgagtgccttagccctcttcccccgcaactgctcactactttttttacactgaaagggggtccctggtagttcctctcaacctccaaaaaattcacacaggaacccttcggccacttctccttggcaactgagtgaagccacctccctgctgccttcacagcaaggagcagcatctaccactcccaacgcctgggtggaccaccaggccaaggtgccagagaaggacaggcagctactgggagcccacacacagccaagctttttgtttctgttgagtacctgctgcatgcaaggcaaagaaggaataaggaacaaaaattgcttgtgtgatgagcaagttccaagagatagtcagataacgggggtcactggggtatgcgccctgctactctactggctaaattactcatggccacatggaatcgttgccttttccccacaatgactattgaaagcttgcccttttaaaaataaggcttttagctctttcttgaccactcaggtagttgataaattttttaaatatccacaggcagtgtttgctttacacagttccagcatgcatgaatttcagttatcactccttaaataacaccagccctccaataacatagttcaaatttaggttgtcatagtaattgcataaagtatgcacttttgtggctagctcttcagtccacaaatcactatataaataacagatgtgcatcatcatcatcagtgaccaatcacatcactcctttcaaaatatgtcgatgactgctcactgcattatctgttattcagttcccacacagacagcaaactgtgcagctgtgttgcttttttgtctcccagtgataaagccatgtaacatttcacaaaaatggataatcaaaaaggggtattggccaacaaagatgaaactgcagtaaagaaatggaaaatgataaaactgaaagtacaatttgaattgaatataaatggaattatagaagagcgagctgcctgtgggatgctgaccctgctgagacactgtagatatgcagccaggaagggaatgaaggaacttatcagtgtaagttagggaagaaggtgtaacaaaaatgtcccagaatttaaaccagcaaaagcctcacattaaaggaattctagggaatatttcatgacattgaaagcacaaaagataaaatgttagatgctggttccaacttagaaaagagtatgacagctccccaaggcatagaaaagatgctagctccttacatgtatataacaagaaggcagtaagcactgttcaaactactcttgatatgtttttcacaaataaaataattatcaatgtatcaaatgttttaaattacagtgtattaagtacatgtgagttttactacttttttcatgttatatgtataactgagtatgagtttttaatgttttgacaaaattattcttagagacagggttttgctgtgtcacccaggctggagtgcagtggcatgatcatggcttactacagccttcacctcctgcaatcctcccatctcaccttcccaagcagctgggactacaggtgtgcaccccatgcccagctaattcttaatttttttgtagagatgggggtctcactatgttgccagactggtcttgaactcctggcctcaaatgatcttcccaccttagcctcccaaaatgttgggattacaggcatgagccaccatgcccagcctgacaaaaatttttaaagaccatggaacaattgtaaaatttaccaatgattattcagatcactttgtatggtttcagttggcgtgctcacttttacagttccatactactgtgcaaagaaaagatgacctgtaatatataataggttcattttacgactcctgttggctcaggacgtatgaaattattgagtataagggaaaaatccagtggttatagaattattgctatcattattactatttcaatgttttgaccaaatttataaacataatcctttaaatatttaaaacaccttattaactagactaataagtattacattttaggacacagaggagctgatccaaatactctgtttccccaccagataaacccaaaagatgtgagatataatactttgttgtgtgttcagacttcagctcagagcagagacagagagatggatagactattatgatgggataagtaagcaacgaattggaaacagctccattcctagtcagatcctgatttgttgcatgtgctctaagctcgcttaatatcttgggcctaaatatataatgctgtttccagcacaaacctccaggcaaaccagcttaagtatctttctactccactctcaatgccactgtggcccctgcctcattaaaacagacagggtcaggggcttccattcagatataagacggaacctggcccagtaatagctcagaagaataaacaaatatacaaagacgttccttgttcctgcttcaggggaatatgaatattaacaggatatgtttgtaaaaacatcttaaactccttagagcagtgctgtgaaacagaactttctacaatgatggaaatgatctgtatctgtgctgtccaatgtagtggccactagccatatgtgagtactgaggacctgcaatgtggctagtgccacgaagaaacttacattttaattttatttaattttaaataatttaaatagttccatatgactaatggctatcataacagacagaagctttagaaaaaaggtaccaaattaatctttggtaatttgtttctagaagacagcaagaaatgcatccattttgtgaaggtaccacaggtttaccttgtgaaccactcaacaccaggcctagctccgcacacaccgcagcacatgtgacctcatagtcatggccggtcaaaatggcccgaggagcagcagtctcacctttaggaaaaaacagataaaaagaacaaatcaattcaatttcatgcatattaaataatcaacaacttgctcctaatttccatcatgcctatttaatttatagtttgggaatttgtccagcaatcctactttaggactagatccaagttacatactatagtttgattatgagggccacatcctgctaaaatgtcaagtaacctttatgtgattatcaagcaacaatggttgaaaactcagggttaaatacaacaaaatctgcattccaaaatgcctcataaaaaatcagcccctcaattagatgttttatggtcagatgattataaaattaggaactttggctcaatttacatttcaaagaaaggcctcgcccctccttcctccttcctcatcctttgtgggccgctgaaacccatcataatgaagacagtctgaactagacttctgctacccccacagtaattctgcagcccctctcttaaatatgtattctctctactaagcttatgtatttttctgatatataaatttcatggatatatttctctgtggttcattcaaataaccgaaaaaaaacccaatataagaaacacctaaaaaaaaaccaaacccttacagataagtctacagatagtgattgaaaatgaggggcggtgggtagagaaggggggacagaggaggagtatccaaaaactggcagatattgccgaatactttcacaacttgaaagaacaagtcatcctgtatgtctgtcccaaactaaaaagaaaacgtatggttggttggttggttggttaataaggaacccatcatgactaagtaaaatggtaatggtcttgatttgtggatgggttcgtgccaagccacaaggataaactggattccatgtctagcctgaagaatatgatttgaagactaaacggatcctttacttttatagtctctaaaggtaaagatacaaaaagtctttccaagtggagagcaggattctattagcattcccgatttcttgatttggattggttttatagtatgcttgataactaacactgtgtaatccagaagagacaaatgtgcccacagagtaagtggctaccaccagctatggaactctgtggaagagaatcgcttgtatcttaaccccagacacctgactatccttggagcagtcacccactcagaggaaggaagtccagcagctcaggggaaacccactggaaacctactgtacttggaaaggcaaatgctgctgtcagaaaactaacccggcttccaaagcaagggttcttccagtaggtcactgggttatttgaaattttatgcaaaatgtatctacatgcctgtttttctaggtagcaggggaggaaaataagttttactgaatggacagaggtccatgaacaagaaaaggtgagaggcttctaccctgaagggaggtctggtctctgtgcttgtagccccacttcacctggagccagcagtcacttcaggtctagcttttcacaggacagttccaatgcatgtaccagagtacataatgcacggccatgtccctacaatgtccttcaaggctttggtgactgtaggtaatcctgagtgagacttaagttgaaggaatgccacacggaactttgcaccacactggcgtgctatgtgcagccagctgctggacctagcctacaggcttagtgataaagggagaccaaaaataacatacaaagaggcaagggggtaggcagaacaaggggcttcgtttcatttgattccaagttttaacacttctttgggaggcaaacttaccttaattagaaagttgacatttcccaagccacaaagaatttgtcacaagagcaattttgtttcttacaaagtccagaaatttgggaaaattttaaagaaataaagcaaataatgtaagccaatctgaactacttaagcttctgttaggatccacaaattttttttttttttttctgagacggagtctcactctgtcgcccaggctggaatgcggtggtgcgatctcgactcactgccagctccgccttccaggttcacaccattctcctgccttggcctcctgagtagctgggactacaggcgcccgccactgcgcccagctaattttttgtatttttagtagagacggggtttcaccgtggtctcgatctcctgacctcgtgatccgcctgcctcggcctcccaaagtgctgggattacaggcgtgagccaccgcgcccagccaggatccacaaattttaggaagaagtatactgttttaaaaagttattggccgggcgcaatggctcacgcctgtaatcccagtactttgggaggccaaggtgggcagatcacctgaggttacgagttagagaccagcctggccaacatggtgaaaccctgcctctactaaaaatacaaaaaattagtttggcgtggtggtgtgcacctctaacaggtaggagaattgcttgaacctgggaggtggaggttgcagtgagccgagatcacgccactgcactctagcctgggcaacagagcgagactccgtctcaaaaaaataataaaataagaagttatcaatactttagccctgattcttggttttccttttccccagaaggctgtacattccacaaaaataccatacaatgttgtttctgaaattactgtctaattagatccattggcaactttttttttttaccagcaattaaaatcactaagatctaaggaatatatttttggtgtgattgttcttttttttttttttttttcttaagttaccatttcatggatggtgaaatttgtgttttaacttgaattgtcttggaattcctcagtggaaagtgaaggtttgaaggaaagctgatggcaaatgaaggcattctaagtataagacaaagtaaacaaaggacagatagataatggtggtcccagaggatgatgtcacttaagaacatcaatgctaactttttgttttcttgggagcatggtggaagaagggagaggattgctgtcaattttctttctttctttaatgtaaaagagttgaaatactgagcattttctatgactacaaagttaagagtttaggaagcctcgtgattaactccagaaggtgggttaagatataagcattattttttttgtaaactcgtaagatttttatcattatgctttgtttacaaaatactagtttccaataatccaaactttattaaatcatttttcactccacagatcagaacacacacacatgcagagtaatttcaaaactggaaaaggatttcttcttttcctagggcctgatctctaaataaggaactattcaatgctaggactttggcttcaaagtttggcaaaatgtttgctaatcccggaagcaggttagacagttcaggaaatacaaaagagagagagagaaaaaaagaaaaagaaattaaaagcataagggtagacttatgatcattaggttctcaggtaaccagttttacagtcactggatttccagtaaaaagacagcgctacttaactttcctcacctataggaaatgtacattactggcctctataaacccacatacatcaatataaggagagatatgtcatttcctctaagaaaagctgtttccaatcttctttaaagattgtattccctttattatctgctgtacagattgagcattctttacattttctcctcatcaaaaagtacattcaaaataaatacctactacttgatttttataagttttataataaagagcttgaaatagttacacttcaatatagcagatatatgatatgggatttaaatctaacaggtcaaaactgtttaagttcaatggacattttgggaaccacttgcaatgaaattactgagggtagcggggataatcggaggcagagcagaggctttacatgtggctcacagaatcgatctttttatgtctctgtagttacactgtatacatcatcctggatcacagcagagccaaagtgacaacatcccacagaaaggaaaggcaaaatccctccatatctgtgtacatttctgtttggaaagcctagaaacaaaatcttggaaccatataactcattctcactgcagtgttctcagaaatctgcccctcccaactacttgtcagcccacatagttaatacccagggagaaataatcagctcaaacaagatgattctggccatatgttacttttcaaagatgccaaaactatcaataatctctcattgaagtctctaaaccaaacgaagaacaagaaaaaaaaatcttctgaaaaatatcaagttaattcttctgataaaaatttgcaatagttaagggatacaaaaagtctttacctttgctttctgagatagtaggatctcccaaaggctagaccataaagcagaacagattcccttaagaaccttttaaagtcttactgcttgaaaaattgtcatggccttcaataatgctgagagaaaaatttatcttgctgctagtttaagggactacatttcaaactcttcttaaagaaaaataaaaagagaaagaggacagacttctaggactgctttgaaaagcttgagcaattacttcaaaggaaagggtgtctttgtccagagagcacgtttatgactactgatgcaaatcctaaccaaaggctgaaaaggatacccagtgcatctttatggatggccttaaaggaagatgaacaagtcaaatgagattaaagacagcccaaattctgctgcaaataccagggcacatcaggttttacagaggcacttctctcagtacgtaatactagatatcaataccaacttacagagacaactataacaacctaacttgcatttaagcaacacaagatctctatactaaccacttagcatttatattggacttatgttttatttatttattttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattaaacaccaaaagcagtggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaacgatagactggattaagaaaatgtggcaaatatacaccatggaatactatgcagccataaaaaatgatgagttcatgtcctttgtagggacatggataaaattggaagtcatcattctcagtaaactatcgcaagaacaaaaaaccaaacaccgcatattctcactcataggtgggaattgaacaatggacttatgttttaaaacattaggtgaaatattttaacaccacttggcagaatagcaaacgttttcattagttgtgtttctttggtgccctcgcaacattaagtatatttatcaaacagactccgaaccacttaaaattacacctgaaagaagagaaaagaggaatttctctagtatcttgctcataaatatccagtgagaagaatatttcataaggcctatatccatttaggaaaacaggtgacaatccaggtacaaatagatctgacatgtattttctggcaaacttgtagttactttataaaaagtgaatgaagttcttggtgttttggcgtcatctccttactcttatgaaaatcagatcactttgaaatgcagtataacgttttcacttgtaggttaaatatgttgttattagcagagtgaatcctcttcattccattttctcaataccatctattaggaaatgaagcgggattaaacattttcctattcctagttttgtacaactaaaattatttcttccaattgatacttagtttagatgactcctggctgggccagaaaatcacatatcccacttgttcacccattcattccttcactccttcattcacttaataatatttattgagtttgtattcttaagatatgtgaggtactatggaaataaggaaaggagtaaaacacagccttttatttaaaaataacttgattttaaaggatcattggatctggttttgtcaactgtactataaacctgcaaattataattataaatatctatgcttgtaaaggtcaacataatagtactgaagtccataccacttgtaacaactaattttgtatgcaaaatcaatatttaacaataattaacatgcttaaagaccaccaatataattttcttcattagtaaaaatgtatcatctgaacttttatagaggaaaatcaaaatataaaacctggctttataaaaaaagtaataatttcaatagaaaacaaattaagaaataaaatatatttgtttaaaaagcccaaatacataatgaacttattaggcatatagattatagataaaaaacaaaaatatattatacaatatatgccagtcatttcctaaagacggatacctctattttacatgtgccttttgtaccatttagttacaattgattactacaaaacattcatgtgaaaactgaatactaagctttctcatgcggctcaccataatggtaaatcaagaaaggaaatggctttgctaaagcggaaatgagcttagatattaaatgtttcttaaaccttttccattaacttcctagttttacaatggaaattatactgcattttaattatgcttagaaaaactacttgaaatttgtcctatacatttcatcttcaccaaatcttttcccttcccctattcatcatggtctctttggtgaaaaatcacaatttgattagacatatagactatagatgataagccatagctgcatttagagtacaacaaccatcagacaggaaattttagtagcaacttcttgtaaataatattagaagtattaatgcaagacaagataatgttggtacaaagaacaactgtaagtccttggtatataacatttctcctcttctctctatgatacatataaatgttggtaacacgggaatcaccctctaagactaaggttgacccttgaacaacataggtttgaactgtatgggtctactcatttgtggattttcttctgcctctgccattgagacagcaagaccagccctctgcttcctcagtctactcggtgtgaagacaacgaggatgaagatctttatgatgatctacttccacttaatgcatagtaaatatattttctccttacgattttcttaataacattttcttttctctagcttactttattataagaacacagtatatgatacatataacatacaaaatatgtgttaaccaactttatgttatcagtaaggcttccaagtcaacagtaagctatcagtagttaagtttctggggagtcaaaagttatatgcatgtttctgacggtgtggggggttggcaccccgactcctgtgttgttcaaaagtcaactgtacattagaaaatgggtttatatgagtgtgtacctgcaagtgtatacttaaaagtataccccttaaatgtatatttgaaaaatacaaaatcttaccatgacatgtactgtcataagaactcagtataatacagttgtctttttgtgtctctcgcaaatactaagaatgctttagtgataggattgcatcaacttctctatagctgatattctaattaaatgtatagtttagataactctgacctagactgcctgagtttaaatctaggctccagcacttgctagctatgtgagctcccttgggcaagtttccataattctagtaaggagatcctaaaagtgtcaaggcccagggcagaaagtaaaggcatatttataatttctccatgcctcatctataagtcaaggatactaacagtagataccacacagggctactgtgaagattaatgagttaatatgtaaagcactcaggatggtgcctggcatgtagtgagcacccattagtatcatataagtagtagtagcagcaggccaggcgcagtggctcacgcctgtaatcccagcactttgggaggccaaggtgggcggatcacaaggtcaggagattgagaccatcatggccaacatggtgaaaccctgtctctactaaaaatacaaaaaaattatctgggcgcgctggcgcccacatgtagtcccagctactcgggagctaagtcaggagaattgcttgaacctgggaggtggaggttgcagtgagccaagatcccaccactgcactccagcctggtgacagagagatactctgtctcttaaaaaaaaaaaatagtagtagtagtagcaacagaatgatcccttttttcactctgttataaacactcctttcattgaaagtatatttcatcctatgctgcataaaagctaattagagatggttctctccttgataattcatataaattctgatacaactactaatatttggcagcctagaggctaacagtggggagtgaaggtacagtacagtaatttggtgcattccccaaattaaaatagctttttttttttttttttttttttttaagacagggtctcactctgttgcccaggctggagtgcaatggtgcaaccacagatcactgcagccttgacctccctgggctaaggtggtcctcccacttcagcctcctgagtagctgggactacaggcaccacacccagctaattttttttacttcttgtagagacagcgtctccctatgttgcccatgctggttttgaactcctgggctcaaacaatacccttgtcttggcctcccaaaatgctaggattataggcatgagccactgtgcccggcctaaagtatctttattgtctctgattatcaaggtagtacatgctcattataaaacattcagatacttcagtaaagtatgatgaagaaaatgaaaaattgcttccaaatcccactacctataaataaatgttgctaatatatgtcttgtgatcatttcatactttttctatgcataaatgtacatagaatacaagtgtatacacatataggcataggtacttacatatgtagcttcgtgatcttttacacttagcaatacaaagagtgtatccctccatgtcaatattacaaatttatagtatctttgttaatgcctgtacaggacttcattacatggacatatcattactatacttaactaatgtgcttcttttttcctacttgcttgagacttcatttgttgttttcccatggaggggcttggtctttggttctaggtaagctatggctcctgtagctgcatatgagtgtctggtaacataaacatggtaaaattctaccccccaaaaagaaaacaggtagaaaatttgctgaagtgaaatcttattcagatttgttgcaatgcaacattgtctgatttttatgaatataaattaaaactgaaaattggttttatctatttatcctaaatacccaaattatttaaaattctttataatacatcctccttaacatttttaatgttcttttgttaaaaatacgtaagtaagggactctgaaaactatagaggagtttcatatctttagctattaaacactcctgaccccactcacccaaaggaaataaggcagtctctcagttgtgcaaagttacaagctacaagaatgaaagcttaaaaagctcaacagtcatgcagccttaagccacaaaaggcagaaacaattcagagaatttttttcctatataaaaacacttcaaatccaaaatctgaagtcttatcaaacacattcattttctcacttgaatgtgaaaaaaattactgttaaaaaattaccagataaatgaaatgtaatgatatacttagataatggccctgttaaaagaccaagaaaatcaatttttaaaaatttgttaacacttataaacttctgctctgtaaagcgatataaatgagcatagcacataaaaattgaggtaactagaaaaaatagggtttaactgttgcttcgtaaaaaaaaaatcagagatttaaatattgaatttcatataaaaatggttatcttttcataaattatcagtaatatctagagtaaaatgtgagttacataggcacaaagctgtcgtagaatttctcttacgaaatgagcgtttttggaaggtagtaaagtcagtctactatgttgttccaggaagctttaattaagtgtatccttggtagttctaccaataatgttatggaccacccccccgcgcccacccccaccgccggcacagagttctgcaatattttaaaagcagaagaatcctacgtttagttgactagaaggaatttttactttcttagactaatgccaactattgtttgaaattaaatttcccatatgagcataaagtgtcaagacaactttctttggcatggcactattaaaaaggtctacatatgaagatactcaatctgagggtataaatcatcaattcttctgttctcatatttatatggctataacctatgggctgaatggtacagtcatttttctctgcaaccaaacaaggtaaataaatgtgatatattggcatatcaccccaccactctgcatatggtgcacattaaggttgtattcatttgccatatgaatataattcctttttaccacatctactattagttacaagcagtaaatacagagttgttttgctggaacttgagggcctgcattgcatcatggagcactaaacatcctggaccttctggagaatttcatagacatacttttaatgtcacctgaacttgaacactgccaacataccatttgaaaacgcttcttgataaatgcttcaaggaaaaaataaaaatacagggtagctgtagtgtgacagtacattccaaatgcaggcccagaagggaaggtcttgatgagacacacacaagaactcttgttcctgacaaaggatcagatcaagagtcatatccaggtataaaatggtttcttgtttcaagcattactttcttattcagaatctagtgaacataaggaacctaaacataaaataccatccaaataacttcctcaacggtaacttattgaagagctgtgatcaagaagctaacaagtttatttcatcaccaactgtggtgctttgtttcattaggcaaatattgtgcttgctttttccttacacaaaatatttatcgtacagttgcaaatccaggttagggtagggtaaaaggaggagtaaagtgatttctttttaagaactcatatggttcaacacaaatgtacataccttgacatttgtgacccttaaataatatatcacaggcaattaaaaacaaagtacacctgtcttaaccaagtaccaattttcatgtttcccaacattaagtccccaaatgcatccagcagatggtgctctaggacacctacttacagagagtaatattgtttatattacatccacctaaattttggcaagacaaagaataagaatttatcagtagcttcagtaaaacatactaggcttcacaataaaaaggacataattcctaaatatgtgtacaaaaatatgcatacacataagcacatgtgcacagaggcagccagtaaataattcacacctggacatgttatgatactacttttcttacagacttgatgagtagtctatgtgtatcagtagtatttatagtcacatggcaagatcattctaaattcattaaaaaaaatttagaatgccttaaagttagaattcatttttaattatagcaggaatgtctcattagggtgatactagtaaaattaacaacagtaggatttacggtaatgacttaagtgattgatgagcgtataacaaaatgaagttttagacagagaaaaagcagggcagctatggcatacagtactttaaaaaacagctctgtggtctgttagtgctagccttatggttaataaaaccttctttctaattaacggtgctgaaatattcttaaagaacagaatcttgttgttatgaagaaaagttaggtttttttctcagtagacgccaatcccataaaggagaaagctgacatagattagcatgtctgattgcaatgaggaaaagaaaaaaaatgccacctttcaatcaaatcaaaaccagaatgcgagaatggaaaatgtattactgaaatactacacacacaaatctgtgcaacaccctcacagttagcaaccatttgcttctgaagctgatcgaatgtggctttaaaagatattattcagatatctaaaaatacctaataaacatttaattttttaaatccatgtttatgaatataaaagtgaataaataataactgttttgtatatattcatcttgcttatctaaataagatcatgtcaaagtttaaagtatttatttatcaatggaatgcactggggaacattttctccaaaatttaaaaatgtacagtctggagagcattattctgaaggtgaaataactatctcaggaaaagcactttggtgacaaggctcagtcctaaaacacagagtactaggacaaggagagagagatgccatgctttcatgtacaaaacatctctcagtgaaatattcttggttaatttcattttttaaatccctaattaaatggaatcctatattcatttttcttctcattgaaaaaactgcattccacaggagataattattacaaaacaatagagtcaaagatgaaaaactatctggtatacaggaaaataagccttttgctatgtagtctaggcaggcttcataaaacatttacactttttaaagccccaaattacagtatttataggttttacacttgatcttagccaaaaggctgagaagcgatgtatttataggttttatccagtttgaattagcctgagattgccaaagcagtatgtatattaatattagataatatgatatttttaaaactttgtcatacagctatcaactttacatataacatcaatattagatatggaaaaaacagtgtatgtaggcttatgaccctagaaagtaaaatgactacctattcccatgattttttaaataaaaaaaccctgagatagacctataaaatgcagaaaaagcaataacctggttttcttttatctattttcccttcaagaaagaaaaagtctacaataaaaaatttaaagttgaggtattaatgtgcatttatagaacatattgcaattatatgtatatacacgcttcaccacttcttaaaggtcatttacattgtatctaagaggtacaatataggaatacacataacctaaaacccttcatctgaaaagctctgacttcagcagctgcattgtggaaccatcaatgagccagaggcttataaaatccgaaccagcttgcatgaatgtttgaaacagtttacacacggtaacaatgtctttgtttttgtttgtcattttcttttgaaaagcgtagattgcattttccatttttctattctaatatgtgtaaattctcattataagaaaaagtgcctatttgtctttctcctggattcatctttcaaagctgaagcaaaattaaatcggggcatcagacattatacaggggcttgaaaggataaggttcactttgagaaaggtaatttaattcagtcaagatacattacaattttctaaaatttttattagatgtgctgttatattattcttttattgtttttcttttcattgctagcattactaggaggtaatgtccaccatactgcagacaatgagagggtatagatgaagtacgctatgaaaaatataacattataatatttactctaatgccaacaagatggtgttttgtggtgatttatttgctctaatcatcctgtgcttctgataacaccttaactcagttctgttgttgctttcattttacagacaagacagaaggaccacagcaaagcttggaacttagattttttttttactacaaaccccaggatttgttcagtcctacttaattcgttttttaaaggccatgcatgtaaaaacaatctctaggttgagttacaaagtatttaaacatatgaaaatatatttaaatgtatacatatatcatgatatatatcatactttcttcctttgcgaagagctgaaaattcctaactttaaggcatacttaactttctgaaatgcaatagtaattacatacaagtgtagctaataggtctttagctgctttttagaatacacattggtaatgacggtgtataacatagagaacatgattaagtaaaataaaacaagaaaccaagaacccaaatatctatgtgtgttcagatttctttatgtgcatgaaataccttacatttttaaggcaagaaaaagttcttaaatattttgagataaatagcaaaatggtagatttattatcaattttaaatataggtttgcctgagataattgagtgaatctcggtaactggatttacagaaaccagaaaaaagaaattgaaaggagtcacttattctaagaggacagacaggaagaaggaccagaatattgtgttcatgatgaaaagaacatggtacttttcaaaagaatatgaaaaacaaaatccctgaaatttgcatctttgtaatttctattgtaattacagagatgtctgtataaatgtgaaatacatgtacacctactccccgacatatacacacactacaatttgatcacaaagtctgtattatcaatagcatcacaggcttaacattatttttcatatcctatttgcataggaaattatcccttttttgattaaaacaggaaatatctattagacgttcattgaataaaaactgtatttacctatcacatcaaagtctataatgtacataataagaaacagctttgaaaaatacttcacacacacttcttttaacattatactagcatttgactaaatgttttgaaaaaaaggttcattttcatacaaatattatacatttaagaacagctttgagaagtcaatccaagatatgatggacttaaacatatttagaccatttcacaatctggggtggagtgacagagcaaggaccgggtattcaggtaaagtcatcaggaagaatgtgatccttccttaaccaaatacattgcaacttgccttaaattaagaaactgtaaatatttaagagcagttaaaatgctctaccttctgaagtaaaaatctaaagctattcttgcaggaattctacagtgttgtcataatcattttaattaaattctcatttttcaggtggtccctttaattgttttttcctacttcttaatgtgtttttctaaagccatttcttttctgcagctgtgtgcgattggttttaatggtagctgcttccttttttgccttctgtgaattacaattttaaatggttacacattttttgttttactgccttcagcatagtttcataaagatgtttaaggctgttggtgaacattttcatttcccatctgaaaaaccaagagccaatttgagtattccacattggccttttatgacctgttttatctttttaatacataaatgaaagcataattttatcaagactagtttgtttctatgaaattattatttttattttgttcttttaaaatatgaattcaataaacaaggtaatatgtgattgctcttttatgctgtatcttcatgaataaaaactactttatttggtgacagctatttccaatgaagaactagaatttttggatcataagaatagcctataatatgaaacataagatttcatgcttagattttaattatcaatggtcacaaaattgataatgaggctatttggatcattcttaaattataataaataaaaaatacttgataatcctgtctcacttttaccataacaaaaaggtaactttactgcaaaatgttattctctacatccttgtaaaagtttacttaaaaaatgagtcatacttactgcctgggttatctccaatcccactgcattttccattccaataccacagcaaaagagttgcatcacgtgaccctgagagaatgtagcaatttcccccaatatatgactcagaacgagcaaggcaagtgacgacatcccaatggccaaacaccacttggatcaatcttcctgtaatgcaaaacaattttctttaaaaatgctattaaaaaaataaaaattctagtgaacagataacttgtaaaacaacgaagctatatgaactctgatggtcataattcagattttataataatttgacatggtccaacctaacagttttctttgcatgctaacaagaacaacaaaaaaacaattgaaaattgttaacatttttgaaaggcatgtgttaaaactatttcaacaaataatacttgaggaccatggcactgtatcattacaaatggcttctataaattacaaatgaatcatgtttactgattaaagcaggcccaggagaacccttttggaaccattttaacactttcttgagttactctatatgattcaaaattaaacttagttgcttttctgtaaaagtactcataatttagatgtcactaataaaaacctatttctgatttactgaagatttaatgtatttcttgttttaagtgatctatacaaagacaatataagacactttggagagcttctaccttttcaaatcaggattatatggaaattatgatgaaagaactaatatattgtgattgcaatttgagccaggtgattctttgtcttaattttctgatgaaaattccttgagggtgaaatcaagatggtaatgactggggacaaaggagaggaacccagtaaacttactatatatctagggcttcaaacacagaacagttgttcatgtaaaggtgtcagaaaaaaagtaaagccctcacccttttttgttatttttatttatttatttttttgaggcggagtctcgttctgtcgcccaggctggagtgtagtggcgcgatcttggctcactgcaagctctgcttcccaggttcacgccattctcctgctcagcctcccaggtagctgggactacaggcacccaccaccaccacgcccggctaattttttgtatttttagtagagacggggtttcactgtgttagccaggatggtctcgatctcctgaccttgtaatccacccgcctgggcctcccaaagtgctgggattacaggcgtgagccaccgtgcccagcagccctcaccctttaagaatctttgtttaaccagatatggtggtagtaattcacacaaacttgtctaaacaattaaatagctgtgacagacccccattccatctttagaatttctagcttacatatttcctttgaaatgtctacagagtctacagatgaatgccatacaatgtctacccttaatattcagcatggctttctttttctttaaataagtttttatatttcgattataaaatataattccgatgttcaagaaaaaaaggctactaagctgaaaattaaattaatatgcctaaataggttatgtgtttaacccgtaatacattgtaaacttcttaaaaggttaaggtcccaagtactggcatatcaagtgtatttaacttttcaagataataaatataagataatatttacattaaatttttaaaattcttgattttaataaatctaaggcttattatgaaggctgaaaatttagaaataaaattctgaaatattatctaaatcagatggaaaagtcaaatacatgttttcattcatgagtggcagtcttgcatatagcctacttctaataaatttaaaatcagattcacttcaatctcaagttgcaaaactaatatagtactttttttctcctgtgattaagggagagcagacttcaaagcaagtgtctctagctgctaaatgttcaagatgttcacttttgaatttcttcagccttttaagttgacaccaaaacatttcattaaaaaataagcttatatcaataaagaataaaaaagaatccaagaccttcaagaactaaaaaaaattgagcaaattaaatgtgaaatatataataatttttacttcatttccaatttacatgacaaacagaatgtggaggttcagtggtaaactggcggggatcagattacacgcaggccttacataggataagacaaaagttaggtagctgaaagcagtcttattaataactagaaaatcaaaggttaaatccatgtattttaactactgaaagaaatacatcatatatacatcatacatcatgaatacatcatatagtgatgtgatcatagagtatatatatgacttctgctttagcctatgcctaaatgctgagagcacataaaatataggtgtgatttaaatagattatgtatgggcaggcttatttcagatttgaaacccaacaatcagtgggttgtaggagtgaggaggagtgaaataactaaccaggtacttgaggtagacgacatagaggaaacccaggtgttcttagtgcagtaggaggcttgcaaagaacagctattcacttggtaacttaatttccaactcatgtgaggacaaagggaaaaaatgtagctgtaaaggtgggatggattaaatataggggcagagttttacaagagtcacatggtaattctcatgagttgaagtcactgctctgtttctccaatgtcagtgtaaggaaacatacattcagtcatggtggttccttttcaaaatttttagtgttttgattgttttccaaaaagttatcacaattagttttcattcaacaaatacttagcacctattaagtgccaagcattaggccttcttacctgtatacagtggtgaacaaatagacatggtccctgccctcatagcctttacagtcttgtggggcagacagtcattaaacaaacccagactggtatataattatgaatagggatgagtattataaaagaacaaggttggattaatgacaataacaagatagaacaaatttacactgggtgtcagggaagatctaaatgagagagtgacatttaagcagttacatctaaagggttttatatgttaacacaaattaactttattctttacaatttatactttgggctcaactctggaaaacattatttttttaagtttactttttcctgttctggcagccttcctcagcaatatttgttattgctataaggttgaggttcactcctcctaaataaatcacagcatataaatacctgctgctctttttggtaaattattttctgataatcttataagtgttcctcaacctttattttttgtttcctttaataccagtccacctctccacacactaatatcaaatattaccacaagcactagaatatcccttttttgacagaacaaattttctagttaatgttttatttgacagctgtgctacaaataaaaaaattcaagctcaggactctgcaccactgaatctaaaatgtggcctgaaaataattccgactgccaggggaaggttttattgttgcctctgctgttctggttgtggcccgaaaacatgatttatgtttaaagaatttcctgttacaatccatgtttctcctccctcctccccaatctaataagagaaggatttttttttttggcttgtgtgctaaaatataattgaatttaacacttgtgttagctttgccattatatattactgatcatatgattttcccttgattctgtgctaaacttaagaaaaaatatttaatattcctattgttgtaaaatcacagacacatatttaccttaactgaaattattttaaataaaactagcatcagagtttttatacaagatattaagaaagacaccaggactatcgtttgagattttttttatacaacttttctggtaagtataaatatttttatttcacaagctaagtcagtcccactgaaatgaagtttaaggctattccttatttgtacgttttatacacacaaacacacacatttttaaagacattagaaggtattttgaaagagggaaaagaatgacatcaggtttattaagtctaatgtaacatggcaaacatactaggaacttagtgttacaaattacagcattttcccaaaaaaatcagtgactgactggtaacacctagatgagacaacatgctatgatcacaaagtgtgctacatttaaaatttaaaaagctaggtccaaggcctacttctgtcactattagctacatacatttcaacgaattacataatctctctaaacctcagttttattatctgaaaaatggggataagacacctgtctacttcacaggattattgtgagactgaaacaatatctagtatgtgagagaattttataaattctataaaattgtgtgaatataggattttaattattagtgttatatgaaagtgaagttagctttactttacaaatgttaatactgagtgtctttaaaaaacaataatatagaatgtcaacaaactaaaaacactcaaatgtcaaaaccaaagattgacatggtttgtgattccatttatatgacattctgaaaaaggcacaactaaagatgaggaacagattagttgttgccaggaggttgagggtggggtaaaaagttgacttctagtaggtggcacagggtatttgggggcgctctgcaccttgattgtggtggtggtgaattactctatggtttgcactgtaaaccaaaaagagtggtttacagttctattagttctatattacagtgtaaaattcattttcatgtttaaaaatgttttaatcacttaaaaaatatatggaaaaacaatatgaagtccaaaagaatatttgagaaaaactccaggagtttaagaccaccctggacaacagagtgagaaccctgtctctataaaaatttaaaaaaaaaaaaagcaaaaaaaacaagaaatagctgggtgtagtggcatgtgcctgtggtcccagctacttggcaggccgacgcaggaggagatcacctgaggccaggagtttgaggttgcagtgaactgtaactgtgccactgtactccaactgtctcttatactgtctccaactgtcttctttaaaataggcagaaaaaaaagacatgtccaagactcaaagaggagtgtttaggttcaatagtaatccaccccatagacttaaacatctagtaaaagcccaaataatcaaaaaggcttgaatggtgatgttttctttcctacacctacagaataaagatgcaaactataagaaaaccatgtcatcaattccatataacaaacaataaagattaaaaagatgttcaagaacaaactccttgaataaccaaaaattaattgttctataaactatattaaggcaggagtatggactcaaacattttataaagattattaataagactgaaagatgatttaccataaagcattcaaataactagaaattttaatttaaaagatttttcaattcctacaacattaaataaagatatatgtaggcctttgttccagctgaaatatctactgtcataatatacagtcatgagctttataacacaactttttggtcaacgatggaccacatatatgatggtggtcccatgatattataatgaagctgaaaaattcctgtcacctattgacatcatagctgtggtaacgttgtagtgcaatgcatcactcacgtttgtggtggtgctggtttaaatggacttactacactgccagatgtataaagatacagcacatacaattatgtatagtgcataatacttgataataaataactctgttactggtttatgtacttattatcccatactttttattgttaaagtgtagtctttctacctataaaaagaaaaagttgattctaaaataggcacaggcaaacccttcaggaggtattccaaaaggcagtgttatcacaggagatgaaagctccatgcgtgttcttgcccctgaagaccttccagtgggacaagaatgtggaggtggaagacagtgatattgatgatcctgaccctatggaggcttagcctaacttatatgtttttgtcttcgttttctaaaaattttttaaaatagaaaaaaacctatacaataaggatatatagaaaatatttttgtacagttgtacaatgtgtttgtgttttaagctatgtgttattacaagaattgaaaagcttaaaatcattaaaaagtttataaagtaaaaaagcttcagtaagccaattattagtaaagaaaaaattttaaaaacaaatttagtgtagtctaagtgtacagagttttataaagtctacagtagtgtacagtcatatcctaggccttcacattcactcactgctcactcactgactcacccagcgcaacttccagtcctgcaagcttcattcatgggaagtgccctatacaggtatgccagtttttatcttttattattattattttttacttgcagaagacaatggaatggtttttatctcttataccatacttttactgtaacttttctatttttagatgtgtttagacacacagatacttaccgttgtgttataattgcctacagtatcccatatactagtatgctgtacagatttgtagcctaggagcaataggtgaccccatatagcctaggtgtatactggaatatcccatctagtttgtgtaagtatactctataatgctgcacaacgataaaatcccctaacaatgcatttatcagaatgtatgcctgttgttaagcaacacacgactgtagatcaattagctctaaagaattaagagctcattttaattattttaaatatcaaactatatatttactataactttatttcatcctgtaacaatttctaaaatattttaagggacaccattaaatttctcaacgtttctcaatttcttacatgcaaaaatttgtaaacatttactcagccggatctcctacagtaatactgagctcagcttggtttgtcccttagggagatgcatgtaaatgaatatatagactgaaaatttttatattttaacaagagctcctgtcacacataaaagcaatagtcagctacttttcttcatgatggtgtagatttcagcaagattctaggcagaattgggtggaggcaagatatctactgccaagagttagacttaatgagtctttcaagtaggaaaaagaaaatcctttaaataatacaaaagtgagaaaatacacttctgtgtgtgtgcacttgccgtaagattatgcatatactcatgcatggtatttacataccaggatttgccttcaaaatgaatcatttattctgtaagcatgagcttgggtcacaaacctataaaaaactgtctcttacaaacatgctgtagcaaatttaatagtggactatatatagtagattattatttgaagagggaaaacaatgccctcttctccctattttgtaaattttaggattttgtaatttttggaaggaagcagataagaatgcatcctaagcctctcaatactacttatagtaaactttagttcactgataaagaaaatgaaaattacctgtgtctgtagaatagactctgaaacttttatcccagaagccacagacgagaatatagcggttgtctgaagtgatgacaaagcactgggaatgcacttgaatactttggtctaaaaggtcagtgatttgcctcctgtgcattcctgtattgctggctgtaagaatagggaggaaaaacaactattaaatccacatgggcaaagaaattctatagtgagggagaagaggagacacattcccagataagagtacttgatccttaattctaagtataataattgaaaaaccgagtaggaaaacatatccaattgctggaaaaatgtgggtagctaaattcaatatctcagttaaaaattttgcttagaggaaagaaagaataacacactactatttaaaaatagaacacaattcacagaacatgctttctagctcttgggcagaaccaaactagattacaatctccagattgcatcacagttaggtttgtgtttctgacaatctcattacatttattgtcatgagaatggttcatgttgtgacaatctattacctttaacattttgtcacaaggaagagatattaggatttaaatgtcatatatttgaaatattgtagcatcttgtactactttggctttaacgggtctttaatttgactagatgggaactcccatttcccctgtttacaactgcacttgcatgtaaggaaagggtagaatgactgtttattaaagattcctgtaattgaaaaagtcaaagcacagcagactgccactttcttactccttatttaagcaataaaacaagacagccttggcagtgtgtttcaaagtgctacggtgcacctgagacggggtttgtcaccaagaaaaaggtcagacatagagcaacaccgagcacatgggaagagtaataatcgtccagaaatacaccatcgactgtgccattatcagaaacggaatcttcactgagatgacttttttggcattgaggccaaccaaatagaaagctttgtttctagtgatctaagggttatttcaccatcatctctccagtacaagtaaggattctgatgctgctaaagaaatttgattgtaccagaaatcagaacaaacaaacttctgcatccgattattaagcttttcaccataattttcaattttttgaaaaatcaaacatagaaaaatatttatatgctattcattgtatgtaataactatattaatgtgggtagtttaatagaaagctcaggaagtaaaacagaagaaaaaaaagtattcaaaatactctccagtgctgtgctgggagccactggggacacagaggactgatggatctgttgccctcatggcacacacaacacggcacacacgtacacatacatgtgcaacactgcagaaattctgctaatgtctgtggacacaaccatttaagattattggataactgtttgataatggaggcttcatatgcttttggaggattaatgggctagaaagtgacagcagtagtgaaaagggcagaatcctagttgggaatcattttttccctctccttctaacaaagggaagttgctggcagataataaaagcttttgtggatatcatagtgttactacagagagacagtgtccaccaacagcaatcaagtatcccattgcaatgaagttgtatgatacaatttttttttaaattccaagaaatctagcaattaaaacaaggtatgtggtactttctgcactggttactgcagtactttgttccacatgagagctgtaaacatgtttattcttgtcagtgtttatgtgacttttgctcctatgatataaactttcgctgaactttcttgggggattgggatgatctcttgggaggacctcagcagatttgggcatgtacataattttgaattgagtgaccacaaagtacccattggcaaaggcttgatgccccctcagcacacacatgaactattttctaagcaagtgcttacttgtaatttaacattgccaagtcccccatccagctaaggtatatttatctagataagcagtcttcaaactagggtatgcatacccctggaggtgtaagacttcctaagagatacacaggttcagaagttaataccagtaattttctaattcctcaactttaatatattctactgcttgaaattgatttgcctgagaactctcctgtgagttttcctttcttacctcttctttctcacgcccttcttctactagataaaataaagacatatttcccttccacacagaatcttactatgtgctttagctgagtgtaatttcttgcccccaataaagggacaattcaaaatactgaggtaatactgaaaagtgaatgtataagtatcaaatcattctgcaagtcaggtggtttccaatttactgctttcaataaaatggaataaggatccaatcatgctgtcaattggtagataattaaaaataagttttaatgatagactgttaaaattatagattacttaataataaaccataaaaataactcttaataatagatcactatatgaattgccactaatgcagagagttcaaagatttgagtggtacagttgaaacaaagctctttcccatctattttcctaagtgagtaacactgctcagaggttccatctataaaaacaagtaagatagacctgctgatgatgtatttttaataaatgttcattttatgtaaataaacatttattaaactttataatataattaaataaatacattaatatttgtaataatcactcaatacagataaacttattttaaaggctgagccttatggtcataggaaattttaaaatttaaattgaacacatatgcttaattttgcaaacacatttttatggctgaaaagcataatagggtaatcaattttttaaagttaacataaaattatctgggggaagtagaatgaaaatataaattcaagataaaaaagtaataatgtgaaatttccatatgttaaggggttttcaatgtattttttagaaacagaaaatattgaatatcaattcactctgatatttagattctactggatatattaaaattttgtttactgagtatcaattcactctgatacttagattctattggatatattaaacaatttttacactatgccagaatgtataacctttgcaactatttgaacttgtgatgaaaacttttagatgtcaacttaaaaattgtctgagaggatacatggttttaaataattcttttaggaggtagaagtgtaaagtctgttgaccagtgatctagggcagggacagcaaaactagggccaaaggctgaatcctgcccatgcctgattttgtatatgtagttttattagaaaagagttatgttcattcatttcttttttatttatggtggcttttgtgctatactggtagagttaagaacagcttgagtttcccttatctgaaacacttgggaccagaagtgttttagatttcagatttttttttcagattttggaatattttcatagattgagatatcttggggatgatagccaagtctaaacacaaaattaatttgtttcatatagaatatatataatgtatatatatatatatatatatagcctgaaggtaattttatataatattttaaataattttgtgcctgacataaagtttggactgtgtttgaatgtgacctgtcacatgaggtcaggtgtggaattttccacttgtcttgtcacgttggtctttaaaaagtttcagagtttggagtatttggggcttgggatttgcagattagaggtgctcaacctaaaatatttactatctggccctttaccaaaaaagtttacccatgcttaccctaaagggttacaacaattgatgaattcatttaattagacttgatagcataggatattcattgtcaaggtgcaaagaaaatgatgggtctaaaattcagaaataatgctttaaatgactcagcaaatgggctttattattttcctgacttttaaactacccaagtgagcattttagtttttttaatatatggcaaatcatatctactcaaaacaaaacaagatttaagaaccagagtggtatttatccttcatgtagataattacgtattagatttctgattatacttggggaaatgataaatgaattggtttagagcttaaggttatttctgttcatcctgatagtctacctgctaatggtagccatttagctctccattgaaacaatgccttttaaagacaaaaatggtaactatataaagggaacatcttggattttaaaataataaatctgcttcattcatatgctttctttaaaaacattaaaattctaacaaatttatttgtgccaggaaaatctgacaaaattacaagccaaatatctatgccgatagcattacaccacaggtaggcaagtaagtttttattctaaaagttattaaataacatcttcaaaatcgaggcttaacattcttagtgatgccacatttgaaatccccacacgtaaggatgaaaaatgctaaactagagatttcgactaatctactcaaaaagcctaacagcaattaaatattctaagtcatctgctgcagatgctcatttcatcccaatggctctttctggtcgcctccctatttttttctcccctgaacaaatttaacctccaatggcaatttattgggctgtaggaccctaggaaaatgaatacaaatatcttaacactaccattggctgggcaatatatttcaactttgaaactgctctgcaattgcacattaatcccctcagactgaacagaaggtctaggaagaaaggattgatctcctttaatgatgaaaccctggcactacagttttatttttcataacgcagtgctgctaagaaccccactgttattatgaaaattttcctagcaaaggagctccatcacattaccggtgcaccaattcatcataacgtgccttgctcctgctcatcaacaagtctgagtgatgaaaagatccaatattatcctgacagtacttcatgcgcattctcaatcacacattattacagcatccatattaattttcagtgacacgcgtcctaggcctgttcaaattaggcaaaccaacgagggggagttgatgaaataccagcatagccacagctcattgcattccaatttgcatgcaaatggtttatcaggaaaattccattcccagcaaccagcaagtgaaaaacaactgtaatctacacttcagggccaccatacagagcttaatgaatcgcaaagagagaaggaagtgacagacctatgagaggatcgatttccactggcagctggtatggctggtcttgtacagcaccttgatgagctggaattcacaaaagataaagaaaaaaggcattattttttatatactaaactacataaaaatgcataagtcaaaccttatgtagaattgtttccaatctctaaatctttcatgcagttttgtgaaatttaaagaacaaaaatccaggtgcttttatggctagcttattaaacatttattttagattagtgccgctctgaactgtgccatcagcagtggctccagtcctaggccataagctatagcagatgcttgactggcaacctctgatgctgcaacaaaacaaaattaagtggtaaagcgcactgaaaacaaaatgtgacaaccatctgctgactgtagcaaatactatttttttgttacttcttaaaaaggcagttttgaatgctacagcacaaaggatctacaaaaatgtcaacttatgatggagaaagggaaagctctaagtcagggaacatttagtgtttcatccatcacttaaaatcaatcaattgaaagtttgaataaaaataaagaaagctatccgcagataaatgttttagttaaatgcatttggctgaaatattttcttaaagattggattgagggtttaaaaagaagttttattaatatttaatatttccatggtttcaatttaaaaatactctgagaaggagatgaataacaaaaatcaatctatcctaagaatactttgttcaattctcaaaatggttttaaagattcaggcatacttattttataattgaagagaggttttgcaggctgtttccctctgaaagggagaaggactttcggtagagaggaagtatatcaggaatcaggaactacctgatgcaaccttgtgcaaatcataaaccctaaaacagggttcagaatagattatcttttcagcttcatagttctgacagttaaattctgggcccttttccaaactattttccccaaacgactcagccattcaccctgctcagtatctactttttatagactcacaagcattcacattattgcttggttggtattagagctctgcttaatgccattgataccggtgggctaggggaggtccccaaacaccagtgggacctcaaccctggctcttgacactgtggtgagaagaaactcaaggacaagtcagaaaatagtgaaagtatggagatttattgcaaagcaaaaagtacacactcaaaaggggagtgtgggtgtactcaagagagagtcgtggacaaggggcgttggggttcctatctttatgggtttctgttaaccaaggggtggaatgttcatgaagattcctggaaaaaggtggcaatttctcagaactgtggtgccatccatttttacaccaaatatgagtgctcctggaacggtcatggccctggtgggtgtgtgatttgtatgttaatgagcatataatgaggtcctatgtgaaacctagatcaaactcagcaccatgttgggtccagacagtctcagccagcttggcctgcaccctggttttttcagggtcttatcagatcttagcttctgcagctatttcaacagtttccttttgatagtcaagaaactgctgcctggaattttctattctcctgtgattaccatatattattcctgtcttaccataagattttaggaaatctatctgtctttgaggggctgaaaataaatatggggtacatttcaataagttcattagattattttatacttactctgtcatagtttctccagttagtaaataccaactttttaaagatgtttggaaggtcattaatactgataaaacacctaagtacagtattggcactagaaattacagtatgtataagaaactaaagtagctgaagaaaagaaaccacaacggctcttttaaaaaaaacccaaaaggtatttgtctttgctgattactgtctctgctggcaaagaaatcacaggatactcacaagggaggaccaggaaaaatgcactacagcctctggtctacccaatagtgccacttacttccagcaataccagtgtcaatcaacattaatacctttagaatttccctctacttctctgataatctgagatcttagaaacatttaaaccaaactgtcagtgaaatgggtttaaggaggtttgctgatgcttcaaatcctacttctgccactgactggctgtatgaacttggtcaagttatgtaatctctatgtttcaatttcctgatctataaaataggttagattgaaccatatgaaattgccaataactgactgttttgacctataaaaaaacgcgatttcatatggtttcaacctaagtacagaacctacatcctcaggttgttaagaagattgagttaatacacataaaatgattaaaacactacttgaagaggcatgaaagtttatctactccagccatgttttgccagtgaggacactgagcccagggagctcgccttattctgcatcaaatatgcccagtcagtggcagagtttgagcccaggttttctcactcggattttatgaccacctctcccctctttcattagagcaggaaagttgggacctggattcagcactgttctttttggccaccagttagaattttttttaagaagaaggaaaatcttagaaactagaaaaatgctctataaacatttgctggtgttattctaatttttggaggttttcaagatcctttgaatgagaagggaggttaaagattatttattttctaaatcagacactactcaaagaactgaggggaaccagctgtctaatgaatgagctatggaaatcatagatcctcagaaaagaaacagaacctaaaattaaaaaaataaatattgtaatatggatttgatatttaccaaagaaaaactgtcagggatttttgatgtttgttttaaatcaaggcatagtgacaggtaaaggtagcaagagatagaatgaaaggttagatttatgtaaacatacctaaaatgaagcatagacttaatataataaacgcttaatattcttagttgcaggtgcagctcaaattggagatcacattctagaaagataactgcctgtggtgtattcccatatgttatcgctttttgtatttttctggtgaaaagttgctgtgtcatactgtaaaggcagtatgtatggaaagggtgaagacaaacatctctaatgacatggttatagacacaatgaaagctcactgaacagaaatataggcaagattctgcagaaccttgcagttcccctagctatcttacagaaaggtgagccaggactgggaacagttggatgcatcctaagtggtactccagcagtgagactctacccctaaatcactttacatatttatttatagaaaaattggaagtggagaagataatacctgaccactaggtattaagggaagcaagctttgtagtgagggacaccagcttgctggaaaggtgaaagccagaagcttagtcatcaacgcgtagggtcttaaatgcttagggttatcagtgctaaaacttgaaatcagctggagaccgaggagccctgtggttgagccagctcagttcccgttgagccagctcttcctaggctaaagtaaagatgggggcagagtacagtcagggctttccagcagttgcaaggtttgcccctcctcacatctgatgtcactctgtttaaactgaagaagctctcagggctgccacaaacagccacccaggataagcatcatcattggtggtcctgaagtcacacatgctggtgcaaagctctaagggtaaccgcacatagagtaggtaaatcctctagtgtatttgatagaacatatcaccagcatgtttttcttctaaaaagtgtttagagaaacaaaaaaatcacgtttcttaaataaattgtaatatttagtcccaaaatataagtatgttattttcataaatatttacttctgtaagagaagtttacttaaagaaaaaagaataaaaggacataataatagagatattaaatatctgcctccatttttactgtctctaccttttctgaaatctattttgtagtcaaatattggcatttatttgcatcgtttcatttccaatatacccaggaaaatggctatatttaatcaattctaataccaactacagattctttgtggtaggtataccttattgagcttagtcaatgtaccaagtttttgtttgaatgtcaattctgttcccttgtgaaagctgttgcatttaatttggcatgaggtccttgttcaagaacttgtatttttgcaaccatttcaggtattctaacgagcagtgctttatgcacacttcagagatttaatgacaatttcatgaactattaaaatgtatcttttaaatttgcctacctaaaacaacggcttgggaaaaaagtctataatctccagaagtttaaaagattttccttcttcttaaaaaaaattctaactggccaaagagaacagtgctaaatccaggtcccaactttcctgctctaatgagagagaatacattacagaggggtggtcataaaatctgagtgagaaaacctgggctcaaactccgccactgactgggcatatttgatgcagaataaggcgagctccctgggctcagtgtcctcactggcaaaacatggctggagtagataaactttcaatgcctctttaaatctgcactgtttatgattctaatggttatttcagttgagcatgactgtgttgagcatttaatggaagaacagaaggtacttacagatattcaatattttggctatgtaatttaagtgttcttttttttttctattatcctcaacaaatactaccaatactaccatgccaagcacaaaaaggtacagtttctggcacataatagacaatcagaattgtttactgtggctggacatagtggctcatgcctgtaatcccaacactttaagaggctgaggcaggaggactgcttgaggccaggagttcaagaccagcctgggcaacatagcgagcccatctctacgaaaagttaaaaaaaattagccaggcatggtgctgcgtgcctgtagtcctagctaatcaggaggctgaggcaggaggattgcttgtgcccaggagttcaaggctacagcgagctatgatcacaccactgcactccagcctgagtgacagagcaaggccttgtctctaaaaacaaacaaaaatttgtaaaaacccaagtgtttattaagtaaaatgaaagtaaaaaagagaaacatttgataaataaataaatatatactgtttatggacataatatagaatatcattatattaaaatactatattagaaacaatatttatctccaagaataaagataaaccaccagaagctaaaaagtagtttatgtttttaacatttgtactatatgcctcacgtgggccttttttaagcctttcaaactattaaacaatttgattcagactaatgcttgaaaattaaaagcttaaatgttgagatatgctatatttaagtgggtattacacagtgttcagcagttaccatgccttataatggtatttctttacttaccaggaaggttgtgccatttgttcaccgcaaataacctgttagcagtgactgtgatcacagcgggagttgccaaaccaggctgggtgttggctgccacgtgagtaacaggggagttggagggaaacttgaggaccatgataacatcctgctgggctttgtctgtgaacatcaatggactctgcaggaggagatactgttgagtgggcatgacaagacccaaatagacaagaaggaaaagatgaagaaagacaagaaagagagggggtgcaggaaaagaagaggaagaccatattaacatgagttgtaagtggaagcacagtgagcagaaaggcttgtagaaacagcagtcatgatctgttattcatgtatgtcgttagttggaattttgggggactgaagtagaatacattaacagaaacactttaaaatttataaattttatgagctccctttccctccccactgccacgaaaaactaaaagaatgatttgatttagattctacacaggcaaagtgctggggattgcattaaaccattctggttgctatcgtgtcacataatgatcttttagcactaaaaaaacagtaagaatggacaacaggcataaaagcaagacaaggtaatttccaaagatcatcaaaagttgtgttgagttagcaggaagattttgacaactacaaagaggtaatgaaaacaaatacatttataaacaatagttagactgcatgcatatattattacagtagagaaataacttatgaacgtaatatacaaacttaattataaaggtgtttgaaagcaatgcataaatgtacttgtaaaaacaatatatttatatagtgtaccaaatcataaacactgcctattgtaatgcaaatgctactgctttctgctgtagctaggaataaagagaaatacctaggtgttcctcttccctgttggttaaaaaacaaacaaaactagagctcaagacttttttgatttctccttcaaaaaacagagtaattgaaaatgttaaatgaaacactgtctgttctaataaccagcaaccaaataaatcttgaagactactaaggatttggaacattcttacaacccatatgtcataatccaagacatatataacactgctctgatttattggctttatttatactttgtggtggtgtgctatcatacagtaattgcactgtacattttcagcaattctctcctaccatgtctgttttctaatagctgattagtatcattcagaattgaaacactttgatgaaatgcttctggctgctttccttctgccatatttcaaaacaccaggtaatatgtaaatgtggaggcacatatatttaacacatatttattcagaactggtaataaaaaattaaatacatttgcatttttattatcagtccttttaaaaaagttattaagagtacttagaaaaacatattgcactaagaattcctatttgcactctttgcataaaggtgtaaataaaggcaactaataagctacccggacacccttctgagcaagtggctaaaagccaatcaatattatgagttaatcctccctggatgctcattcaattaaaggtgtcagtaatgcctcatctgatgtggcctcaattaagtccaactatctgatggtgtgaaaacacagggggatacagcaacagcagcaaaaccagacaaataggcagccttcgtgtgcctgctaattactacacctggtgtatattatggttcatgcacttaacgcagcacgaggtggctttaatttctgctatatttgtgtgtgtctctgtgtgtgtgtgtgtgtgtgtgtgtgtgtggggatgcattgatggttgatgggggagctcatctgaatgttactaaaaacaataaatatgtggcctttgatttttaaaaccctagtatcactagtttttgtcacacaaagaacgttttatatagtttttaaggaattctgtgaaattaggtaaaaatgagaaacagggagcaacatgaaggaaaatatcccataagctaattttaaagaagtcctgggaaaaggaaatgaacatcatttccaagtaccaagtcttatttttcaattatgtagtttttaaataatatttacgaaagtcaatttataaactcagagaaaatcagagtacaacataatcataaaatctcactgaaaggaagtacatacatatttctgagcttaacagctcatactataaatataattaggctcaaattgaatagttccaatgtttatgcccttaaaaaacacaaaaaaaatctctcatgtgtaggaagaatgtcttgtttacatagtgactctggtgggccaactctaagccacacggcaaggaccagccaccttccacagcaagctgcagacaccatgtccagaaatgtccactgccttcgtacaaatatctgtccctctagtctgctcctccataccccatcctgactagagctcctgatgcaggcaagtagcaggaaactctcttgggcgtttcatcatatatccttggctaaaaagcatgaatgagaaacaccagaaataagaaaaccataccccacactactaggctactctgcagtgacagcagcagctgcagatgagcagagcaactggtaaaacagggataagagaaacaaagcctcttttaatactgggtacctctgtgagccaaggctggggtacaagtaggaaattgctagccaggtttcatcagttttcccagattaagtatacatttgttgacaactctggtttctttttaaactgccttttccccatgcacatatggacaaagcgaaaaacacaatttgtgcaagtctgaagaggagttcaggtattcaattcagaggataaaggtaatggaaaagacggcctcccatccttatatgagcatgagccttccccgccttctcaccctcgggatagcaaagctgctctgcctgtatgagccaataagcctctgccatggaagaaggctgggcagtgaccccagcagaaagtcaatggagcagaggaggtgcttccatttgccagcaccaatgcagcctgagtctcaatggcaagctattactaaagctaattccaaatgcaaacataaatcattcttactatttttatggcactatcttccattgttcttgctaaatgtttgctatctatgtagtcttctgcccactaaagtcactcttcacgttcatctaaatctgattttactgatttaaaaacatgtaggggaaagagtgatgcaaacaatttttaaaatgtgtatagcttatgatggccaattcatactgctagataaagaaggagaaaaaatcttggaagaagaaagaaaatgacaaagagcacagagggaaaaaaagacacagaaggtgatgtgggaagagaaaggaaaaaaaaaaaggaaaaaagagccagaggtagcagggcctcctctctatttcttactttcttcactgctactctttccttcccagtatttatcaaaattctgctatctctacaccacaacatggaatttgactttatataattgttaattatatttacgggaacagactttgtagtttctattcttaatttaaaacagcaatgagcaacttctttttatgagggacaattgaaaaacaatatgtatagtctattccttaaaaattattttaatcacgcacttcaatttgttactctgccaatttttttttcctcattgaagaattttccccctgaaatttcaggaactataaaggtaaaatggccaccttattttgtagctcaagtctatttccgtacccatgattctgggctgacttttgacttgctttgaccaatgaaatgtggcataaatgatgtgtaggttcaaaagcaagcctcaagaagtctggctgcttctgtctgtcttcattctcatgggactgctcctaccatgggagcggcctggtctagcttccttaaggatgaaaggccacatggaaagagaagcctggctacatcagcccacccccaagcagtgtgtgagtgaggcgaggtgaaaagagcagaaaagattttcatctaaccctcagaatcatgagaaatacaatacatgattgttttaagccactaagttttgggtggtttgttataccaaaccatcatttttctcctcactgtggtccctgaccttcagtaacaatatcttatgtattagaatttgttttaaaattcccaaactgaaaaatatattgggatgtaaagaataaacacaacagcaaaactaatctagaaactcagagaatcaaaccagaaaagtcatcaaccctatgtctggagtcctttatcctacagtgaggattcatgacaattatggacctttcaattctgtaacacaagacaccaactgatgaaatacaagagcactggagcaacatttaccttctcaaagattccaggagacaatgcaataacatctgctggttgttagcaggttaacaaatattgcataaaaaaacaaacccacatatggtggagaaactcaagcacaatgaaagactgttatgaatatcaagcggatctgaaggagaggcaagaaatgaggagagtaaaaatagcacttaccacttgcatggcagaacctctgggaggatggggctctatgagtagttgagaaggagtctgtccaaaacttcggatttgagcttcaacagcctgaaaagggcaggggcaagtctgaaggttaagaggtgctaattacaggaaatagaaccccaactgtcacctgaaaatatcattccatactctggcttgtttcatgctgaaaatcaacctgtgttttcacagtggggctaaccacctggcaagggcattgagggtgaggtcatcatttagaaccgcagaagctgttcctctaaaactctgcaaaactttctcatcttgctcagtgatatgaaacagaaaccagctattacaatcagaaattgtcctttttggcttcatctctgttttcttgcacttggttttcctgcttgcatcatccccaatgatgaaaagctaatcttttacaggtatagagaaaaactattgcttctttgattctaggtcccatttcatcctggggagtaaaaaggaggaaaaaagaaacatagcacctgtgaaagtggcttgatgctatattaattttgccataggaagagcattattgttgactgtctctttgaagttagacaactaaataacaaagtaaaagccatatgttgcatctaagcatgagatggttaaaccagggagtcactaaacatgaggaacgtgtgtatgtgtgctctttttgaaagacgtgtgcttttgcaaggcactctcctactatggctcttggtgcacacatagcacacaaatgcccatttccatcaccaaccacccatcatgggaaactgctaaatgccaggtgctatcacatctgtaagcattgtgtttacttgtttatatctgtttcttcccagtaaaatacaaaagccatgaaagcaggaccttatgtatcttcttcactgttagatccctaaattggctgaatgaataaatgctacatgctgggtgaggggagagaaggaagcaaacacatataaaggctacttcgacactcccgtaacagtcagtatgcttaactcccaggctaaaaggatgaggaaaaccctcaaattaataagaataaaaattggagccaaaaggaagtgaggtagggactaggatcattttcagaacatcatctcaaatattttctgatagagtgaaattaatttatgattaaacatcaagaacaagcttgagaaaaaaatcataaaatgggaacctgaaggctaaaggtagtcacaaagaaggaggtagcaacactgctaatttatgatatatgaacttatggacttagtttatgaatgagaactttatatctttttgaagaacagctggtaaggatgggcatgatggctcacacctgtaatcccaaaccaagacaggaggatcgcttgaggccaggagttcaagaacggcctacatagtaagaccctgtctctacaaaaaataaagaaaattggctgggtgtgctggtgtgtgcctcaagtcccagatacttaggaggctgaagtaggagaacagcttgaggccaggagttcgaggcagcagtgagctatcattgcaccactgcactccagcctggacaagagtgcagcctggacaagagtacagcctgaacaagagtgcactgtacaagccagacctgtctccttgacagttgccttctgtggttcctgcccggcagcccacatgcctccctgattaaaaggggagggaggtggcaaagaacttattgcttcagcacttggcctatcatgtcagatggctcagagtgctaatcctgactgtgacacttatctgctgtttgactttaggcaattagcttatctccgtttcccatctacaaagagatagtaacaatacctagttcacataattgtttggaaaatgaaataagataatgcatataaagtgcttagcacagtacctagcacatacaaagcactaaataaaatgctgtactgtattattatttcatgtgggagttggtgtattccccacttaacacagctaaaataaagaaggaagaaatgcctcaggagtttatgtaggaagagaatgagaaatacattatttaagaaaactgaaatctggcttgggatttcaaaatataccacagggctaagagcctagagacagagagatttctttggaggttctgagagcagtccaaaacatgaggaattatacacctgggtccttatggaagctatggtaatagtaacaaagagatgaatatgtgaaccagctaaggaaaaatcaacaggtcttagggactgatgactttgagcaataaagaaaatacaaaactaattccttttcttaaaaaaaaacttgcatgtttcagagaatagtaaagcaatgagcagaaataggaatacaggagtttctgttagggaaaacaagtttggcaggagaaagacagtaaattttacgtcagacacatggaatccaacgtgatagtgataaccatttatctaggtcagtatgtccaatgtgtaaaagcctaagaatggctctgaggtgagagaagagaggtattgattttggtgtcattcatataaaagagaaatttaagttacttttttttttatctttctctcttgttgtatatgtgtgcatgtttttaagcagcagaaatgacctcctttttgaaatgaaatatcacatgaaacctcaatacatggagatagggttattcaactttacaggggtgaaaccatccctaacaagcctcctcatcagcctctgagacaattctgagaattctttagggctctggagcacagtttgaaactatactcgttaagccctaggatgaaaatacatgagacccagacacaaaagcacctagagcagaacctcaagaagtatttatatttagggtacaaatgaggaagtaatgaagaagacagagagagggcagtcagagggtgggtgggaggaaaagcagcatagagtgatatggaagccataggatgagggttttgaagagagaatgggcagtaacgccaactatgatagagaagctatgaatgatgacattgtagcatatacatctttattatagatacaaatttaatataactggccttaatattacatatagtgttttgcacttaacaatgttttgagatgaaaggttatggatgagacaacttctgaaaataccaatctcctctttttaactaacttaactttaatcttaacattttaatacaagtggcacattactgaaaactctgaggaaaaggcttttttaaatcacgtaatatagtggtctgattattctatctcaatgacagaataaaagctatagtctctcacacaggttaaataataatcaattttctttccaagtcttgaaggcatctgaaaaggctgtggaattctcagacacaaatgctttacttcttaacgaacctttcagttcttgatattaaaaatgcaacagaaaggactttttcaagtgtgaaaattatagaataagattgtaaggtaatgactatgatctcaaaactttatagtcacactgtatatcatcaactgataattccagttctcctccttgtttttaaaattcatttgccatttttcattcatcttaatctctgaagcaatttacagagattctcccttctgtggcttcaatggcttaatgcttagactggctctgtagtctactcctttaatctctgtcttttgctgacttgtcatccataaataaatttattactgtgagttctcttttagcactatgattcactcaacttaagcttgctttcttggaaattttttctactgggcctcaaactctgcccctatctgaaaggtttccagtcctatgaccagaggattgcccactcccatgaagtttgccctggccatcttgtgtgtaagcacatgtatgtcttagcacatctaaaatcttaaaatactattttttattttagcatttctcagtcaagaattagattcttctgattttttaaagctcagaatcttgtctacattttaaaaattttacctgtttcacatataaagtcactaagcccaatcacttcgaagtttatcacattcatcactcctttctgaatctaggccccttataatttcaagtatcgattattataacagtctctttgctggttttccccctctattcagtttctgcctccagcatatcctgcagaactaagttttcccaaactcgcctttatgcaatatttctctgatcaaatgtcttcaagtgattccagtaattaaaagataaaagctaatgccaggcattgcaggttttcctatctctctaacttttattctctcattctatctattaccttataccagtgttccttttcagtcaagctggttttcttctacaaatataagccatctctgccttacattttctaccatgccactgaccctcctagaatggtcactcttatcttcagttttctaagttctactcctctctagaaaaccctgtttgagttctaccaagtttccctaatcttgttaaataatattacacctgttcatactgctcattacagtatatacttgattcagaatttcctgtaatgttatttatgtctgtcactacaactacactataaggcactggtccccaaactttttggcaccagggactggtttcatggaagacagtttttccatggacctgcttggaggggtggatatggttttgggatgaaaccgttttacctgagatgaccaggcattagattctcatagggagcgtgcaaccgagatccctcgcatgtgcagttcacaatagggtttgcattccgatgacaatctaatgctgtggctgatgtgacaggggtagagctcaggcagtaatgcttgcccaccactcacctcctgctatgcagcctggttcctaacaggctgtggctcggcggtcagggacccctgctagaagggtctgaataccatatatgtgcaacaggtggaacagtaccttgcacatagtatttagacaacaaaaaatttactgagtgcctgttatatagcaagctagccaggaacccttatggctcatctatggttggactggggacaaaaccaagcttgagagatgagcacacttcttgatgagggctgactgaggttgcaggggaggataaggagtgttaagtaaaggctggtatttgctattagaaagaaaccaaatgagtctctcagggaagctctgaaagatgtcactaaaggcagtaattctcatttcttcagatccagcatactggaggataggacaacactccattgtctcactatagtagtaattcttaaggtcaagtgagaaatcctggggtaatatgtatgatttgaaaaagtccctcaagtgattatgtttcttgccttatcttcacttgcctattcagccctctatatagagcaataaaaaatttaaaggcataaatgaggtgtgaaataacaggaaacatacaagcatccttaaaccctgtacggttcagcaaggtgggttggtaatagggtagcttaacagacattaccaaatgcctcaactgctcttaatgaactctccttcacctagagagttttggtgctaggtgatcactttttagacattcagttatgtaacattttttgttatggaataggataatgaatccccacatatccattagccaccttcaataattattaagacattttggctttaggttatcttaaagtcgggtcaatctagacaatgtcctagatagattcattgaaaattaacagagtgcttctgcctttaaacaatttattttttttaacttctaatgcaagactatactgagaataaaagtatcttacaatgaccaaaaatataagcattagctggcagccttcatatttcttctaaggggctgaatatactcagacttgcaaggagatgttcaatccttaagttgcaaatttgattatgtgactcaaagccttccgttccaaatccttaccctgggtagcaccacagcataggattaagtatgcagacactggaatcagacagcctcagttcaaatcttaccactatcacatattagctcagtgattctgggcaaggtacttaaccttctgtgccttaatttcctcttctaaaaattgtgataataactgtcaatattttattgagttgtgaggattaaatgagataatataaagcacttagaacagttcatggcacatactaagctatcagtaagtgtgtgatattattacagcatatatattaaagacttaacacagtgcctggctagggttaagcaagcactcaataaatgttaccaactactcatctttaagatgaatagttatctagccccaaccactgtccatttcaccactctataatgtgacatataatcaacatcatattgcctttaaacccttgtatatattttctattccttttctctgtgtggtttctttcctcctcattcttgaagacttagctcaggcatctctggcctctgggagatctttcttgacctcacccagactgttgctgtccctccctttttgctcttgtagcaacatgcataaacttttactgcctatttatctaatattctaattactggtttaattttccaacttattgatcagactataagtctcctttagatcagagactgcctaatatttctgtgcttctacagcttggcacatagtaggtgctcagtaaatatttacccagtgaatgtccatgcaaatcaacttaatttaggagggatgcagctaagaaatgcactactaccacaatcacagagcagtctagtgttgaataaaatattatattaaaacatttcaaaaaaagcttgctttattaaatattcttattcatcaattcccaattatttctgtaaatagcctgttactactttctataataaaacctgaagtcagcaggcagcattccagatgttgagatatatagtaataaaaaagactatgcaaatacttcaagacattgcagtaaaaccacatatttatattttataaacagcatctcaaatattacctagagaatgtattaatggatcttcaaatggaaatattatgaagagattttcaacaagctgtgtattctatagtttttgtgtgtgccaactatttcatacttgcatgattttatagctatatatagaaaaagagacaatatatatagagagaatatacatacacatactagacagaatgaaaggaagaaagaaataagagataaaagtaaaggaaagtaaacttggcttagtgacagtgtagtatttggcttcaacttaacaaagactattttagtctctctgacctaggctttttaatctaactgaggaaacaagttaactcagtacagcacttagtaaccaacaataaatattgtaaaattttatttaagatgtagggtaggggagaaataacttaaacatatggacacaattaatatatatgcccttttttttaagcacacaactctgatattgtattttatcacctacatatttacatctgaacgcactataaaattggaatagggaaatagagacaaaataatttattaagaaaagatatgtcatttattaatatattaaaactttctcacattaccaaaattaagttcaagaaagctgctgtaagattctaatccacctctttaccaagaaatgtttaagcattccaacaagacttcatagattaaattcttttcaatatttaaaaagtcacactaagaccatccagtgatgtctactgtggtatcataccattacttgtgccagttttcttctttcccttcagatgtttgaacttaaattgtagaacacttgctggatatttgacaggtttctactcaaagtttactgtctagctgactagcctcagtgtcctttggaggtatggttcaactttagcttcgatatcagttaagtttaaaaacatattaatcaaatgactacttaatcatgatatggttacgtttgtatttaattcctaaaggaaaaaaatcctgataatattgtaactgctaaggccaaaaaaggacccatagcaagtaaatatatttggtaaaaatgggatgaaaatcccaaaagagaaaatcagagatgtttggatgacatctctatctggcttaaaagaaagaaaggcaaagcatcattagaaacatttggaaaccagactcccacttaaccttaggaaagaaatacaaagttattaatagtttttagttgtcagagcaataaattcacaaaattaaaaagtagtataatgaacctaactcaaattatttaaaaagagtcttctaagattaaaatgtaaatattttaaatgcctgagaaataaaatacagaattcaaactttataaagcataaacataagagataaatagtttttcaagaaaatggatacaccaggatatggaatatttaaaactcaagcagataaatgttcaaaatatacagcagaggatattttcaatgaaatttgcaaaataatctattaatacatagaagagtaaatgaaattcaacagaagtgattctatgtaaatttggacttgaaagacttaatgtttttagttttgagaatgcagacataaagacagatatctaagaatttagataaaagtcaagtttgtatgttatatatatgtatgtgtatatatatataacacacatatacttacatgtgttatgtgcatacatacatacatatgcatgaacacttgcatgcaaaatctggggggtatattccaaactattatttgctattttctctgatggaggaaggatgaaaagattggcagaataaaaatttatactttcctcatttttataccaattgatatcttacacaaagcatgtattatttttgaaataagcataacaaaacaattttcattttgaaaaaatctaaaagacaatttaaaaaaaaaggtctgcaaatatttggtatatcattattaagttttttttgttttgtcttggttttttttttttttttttgacagagtttcgctctgtcacccaggctggagtgtggtggtgcaaccttgtctcactgcaacctccgtctccgaggttcaagtgattctcctgcctcagcctccctggtagctggaattacaggtatgcaccaccacacctggctaaattttgtatttttagtagagatggggtttcgccatgttgtccaggctggtctcaaactcctgacttcaggtgatccgcctgcctcggcctcccaaagtgctgggattacaggcataagccaacacacccagccccacttctatgaattttcataaggaaagaatcagatgaagacaaaaagatttagatataaagaaagttattatagcactctataacagtaaaaattggaagaaaaaaactacttaaactctgataatggaatactatgcagccattaaaatgagttgaatacacctgacatagaaactagttcataatataccaaagaaagaaaaatttctaactaccaaagtatatagagtatgaccttatttcagcaaaaaatatatgtgtatgtgtggctgtgtatatatatatacacacatatatacatatatatatacacgtatatatgtgtatatatgtgtatatatatacgtatatatgtgtgtgtatatatatatacacacacatatacgtattatatatgtgtgtatatatatatatacacacacacatatatgtatatataaagcacttagaacagttcatggcacatactaagctatcagtaagtgtgtgatattattacagcatatatattaaagacttaacacagggcctggctagggttaagtaagcactcaataaatgtttttgtttttgtttcttttttgagataggatttcactttgtcacccaggctggagtgcagtgatatgatctcagctcactgcaacctctgtttcctgggtgcaagcgatcctcccacctcagcctctgagtagcagggagccacaggtgtgtgccaccatgcctggctgatttttgtatttttgtagagatggtgttttgccatgttgcccaggttggtcttgaactcctgagctcaaatgatctgcccgccttggcctcccaaagttctgggattacaagcctaagccaccacgcctggcgaagccactgtgcttggcctttatgaagtttaatttatccattaacataatagcaagaaatacatatatttttaacttttattttaggttcagaggtacatgtgaaggtgtgttacataggtaaacttgtgtcctgggggtttgtggtatagattatttcaccacccaggtattaagccccgtacccaatagttatcttttctgctcctctcccaaggaatattctgtaaccatctaagaacaacttcagttgataaactggtcaaaaacttaaatctatagaccttgctataaaattaattttgttaatattgagtttacttttttaacttatctgtatctgattccaaggatcccttagttttagcaatttttgccatcatttagtattaattaaatacaaacttgtttaagtaaataatgtgttttcctccaagaagcactcagaatgcatcaggtaactggaaacaaatacatatcatgatggaatggagtacataaaaaataaagagaaagagcagcttgttaaataaagtaaaacatattttaaaataataatgcaaagaaaagggggagaaggaaaattagggagggaaaggagtatttatactagcatatctactcaaataatattattatggaagttactaatgtaaaatatgatgtaattataatttgtgaaaatgcacacagatttttccattagtgcctgtaacggagcccgtacttttcaggcacattaaactgagtcccaacccagcctcactacaatctccagttcttgtagctgtccatctactacagcataatcccagctgccaatctgaaagaaaccagctagtcagagcagacacaaccaacagaaacaaacgtcactcaataatgttcagcggcactgtgttcatggataatttcaaacagtatctctgtctagaacattgatgtgctcattcaaaacacctccatctctggctactggaaatgagtagataaagcagcctgcctagaaaaataagtggaatgtcttcaaagaggttgccaatgctaagaagcaaatgttgagaaaacacagtaaaggtcttaaaggaaaaaaactcaacaatatccagagagttaattttcacattaagaaggttaaattatttctcaaaaccaaacaaatatgtttaaactatgtcatgaaaagcagcagtcattggttattcatttgctaagagtgacctagatgaagtaaagatggtgcctgaaaggaaacaggggttcatgacaaaagtcatcagtataatagaacggctcagaattctgtaggtagttaataggaaaaaaaatcataaaaatattaatattttgcttcatgtccttgagtgtataatttagttacacctaacttaactagtaagtctgcaaaagacataataatgagcaaaatacaaagagtagctttactgacaactttgatgctcatttaattgaataagggaatttttgtctgattattgtggttttgaagtaaaagaaagtctggcataattttatggtattttaaatgtaggttttcaattaaaacctgactaatccttaccgtttatttggcttctcattgtacagttcctgccctgcactgtgtcaaatatgccatctgtgtaacacacttttggccagaggtacttcatgattatttctataacactttgaattgtggctgcatgaaatcttaacttcggtattcaatactcctaatttactatattgctacaaccactgtaatcgtgtcctactcttaaatctcaccacagtcacaacaaagattcttgcgccacctgcttgaaacaggcttacagaccactcccccaactatttaacaaatgttaacaatgctataaatactaattgtgtttatgctttctgaaagattcactgcagccagtgttctgcagcagtgttggagctgctgactcccaccaacagactgatggaattctaagccaaaaatgcttttccttggataagatatctgatttgctactgctgtcatgaaactggggtcatgtaaacttaaacactgctgctgcttcttttggaaaacagacctcagagtgattacgcatagctaagacagcatttggaaggataaatttggaagagggaaaaccaaccactgacactaaacacaacttagggaaaattttcaggttttactttcatgttgaggtcacttgtatacagtaattctttaaactgggcaatatcacggctctcccctctcccctatttatcaatgcaaatagagctgagttccattttcaaaaggaaatttaaaactttaattaatttctgaactcacataaacataaaacaatgtatttacgtgaaaagtaaagaagaaaatgacacttttagaggaaatgtaccaagtacttataacaaagtacaagatgaaaaagcacagataatattgttcatattaaggttgtctgacagcaacatctacctgcaagtatctttcagcctttgaagccccaccccttcttccaacctccagtgtaccccaagatctgccctggtgtcccttatacaacaactgctccagcctctgctgtgtttgtacttttcctttgatcaaaacctactgtccagtcttactcacagacagccacatgattggaaaggatttttttttaaaggatttgtaaccaaataagtgatctctaatggtagaatttcaggcattaggaaaggacaatgagttctgtagcagaggctttttttctttacatacacatcaaagtgcatcaaagaggaacttatagctagacattaacatgtgactctggcattagttaccaatttgaggatgagagctttctagtctctcactttatactttttgtattatttgactcttgaaatagttaacatgtattgctttgataaatacatttttaaagcactttgtataactatttaattatacacacacacacacacacacacacacacaagtagtgaacccagagttctagaattcaggaatcttaagccaaaagccttcttgcttttagataatgacaaaaactacaattaacagcgatacacctaagatattttccctgaaagtagaagtgttctttgtgctctccctcaaatatgatgggaaaaatgaagaaataaactcaaatgttaaaaagtatgaaaactcccatagctcagtggattaaataacatatatagaaaattaagagattggaggtactctgatttctgagtgagataaaagttaagaaattgtaaattccttcattcctgtcaaagttacacgaagatcattatagacggtcagtaccctaacaacattgaatgttgagaaagaacatggccaaaacccagaacgcaattacaaaagacctctgaacagccaaaaacgaagtcagtattcatatcctcatgttaacatacattgcttgttcaaattttcaagaagcagattctttccccctgaaaagggagaaagagttgtgtttggctttttttctctctctgattttcaagagacataattttttagaatatagaaagaggcaaattaaagaattccatgatctcattaaccaaagataatgaccatgaacattttggggtccataattccagacttttcctcatgcatttgtattttatatgttccataacattgtctattattcactgtaatatggcaaaatattcttccatggtaatacatatagatttacacagcaacatttttgatgatacacagtattctactgtgtaaatttaccaatatttaattaactacttctctactggaaatttacgttgctccttttcctttttttttttttttgctattatgataatacggtttggctgcgtccctacccaaatctcatcttgaattgtagttcccacaatccccacatcgtgagaaggaccccgtcggaggtaactgaatcatggtggtggtttcccccatactattcttgtgatggtaagttctcacgagatctgatggttttataacgggcatcctccttcgctcagctctcattcttctctctcctgccgccttgcaaagaaggatatgtttgcttcccctttcaccatggctgtaagttccctgaggcctccctagccatgtggaactgagtcaattaaacctctttcctttagaattacccagtctcgggtatgtcctcatagcagcatgagaacagactaatacatatgaactatataactgaatatttttttcacacttggtcaattattacttttggttagagttctaagtaaatagtacatgaacattttaataattgatacagattgctataaagattcaacctattttcatcctcaccaaatatatgacagtatctgttttctcatactgcaccaacattaaaatttttattatttttaatcttagataatctagtggacacaaatgttattgtgtgttcaatttaatgtcattgattaatagtgaggatgaactacttctcttactgggtcctgctctttgcccaggctggtctcaaactcctgggcctaagcgatcctcccaccttggcctcccaaagcattggaattacaggtgtgaaccactgtgcccagcttaaagtgcttttcatatgtgacttgcatttcatctttcatgagttttctattcctgtactttgttatttgttgttgctttagatgtacagaaacatccttttcatgtagtgtttatacgtgaatatattaatttccttaaggatttttagctttgatattagacttacaaaggccttccccttcatgtaatcaggaacagaaatgtcagtgtgacaggacacatcgatgaggaagagaacagacgacatgagatcagggaggtatgcagggccagatcatgtgagtcaagcagattttattctatgtttgatgtgaaataggaaagtttaagaaggaagtgaaatgatctgacttacagtttcaaataccactttggcagctcggtggaaagtggactgtaggtaggcagggacagaaaaaggtgacctggtctactagcgttagtccagtggggagagtatggtggcggcttgaactaatgatgaacagatatgaatggtttccaaatatgttttagagatctcaccagcctagctgctcttttgagacagagtcttgctttgtcacccaggctagagtgcagtggtgtgatctgaactcactgcaacctctgcctccccagttcaaacaattctcattcctcagcctcctgagaagctggaactacaggcgcataccaccacgcctggctaattatttgtattttaatttttttaggaacagggtctcactatgttgcccaggctggtcttgaactcctgccctcaagcagtcctcctgcctcagcctcccaaagtgctgggattacaggtgtgagccaccttgcctggcctatcaccaacttcttatgctctcccttcctaccacacgattttttcaagtcatagagccatactgtgctcttttccacatgccatactctccgctttgaatgtcccttccatttcttttgcttcactgacttaactcaaatttcttaaggattatgttcagacagttgatactttcttaacctgggttagaaatgtctcctttgtgctcccgtattcagtgactgtcacattgccatatatataatatatatatatttatttacatacacacagacatatgcatatatgtgtattttttaaaaaaatatatttcttacctactaaacttcatcaatgaactatttcatactaagatactaatgtctagatagctttcaacctttgtatattgcaaatagcatttatatgaaaattaatgggtgaattctggataaggatatagaattgttctagaaaccatgcctatagatatgattatactttaaatatattaatttaaggaaaatacttatgttaaatcttttagaagagggaaaattattttataaaatattcatcatgtatttaatttgtggatttcgattttaagagaatttttttaattcgtaaaaatagttattcttactcatatctgaccctgagttcaaatattctaatttttatcttttttgaaaatttcttctttccttgggttttacgtttttcaaaaatggggttagaaaggcttaataagattgtgtttgaaagaaaagacatgaatgagccaaatcaaaatcagcagaataatcagaaaatgaccaacttttatttatttgtcccttatctataaaagaatatatgtaatattgaggaactagaatagattaaaaaaatgttaaaggcagtgaaaaaaagaatagtgccaaaatacagagaaataaagaagagtaaacagataaagataagactatattcttaagttggggtcacaagatattttttgaaagattagcatatttgtccgaaaaagaattctttctggtgtgtgatatatgtaaatgcagacatagttgtatattgataacccagctgttttctaaaaattaaaaacaacataaaagtttaatgtgctgcaggctgtttctctgattactcttcctcctcttatggttattatttctatcgtttagtgctctttttatagagagattatttttatgatcacttactatgccatgtgtattaaccattcattataaaatggaaactttctcaagaagaatggcgcttttcccaaaatagtaggtgattacatgacttgtatgtacacaacttgcctctgtatgactgggaacgtatttccagactgaattaagtgtatagaagtgaacagaaataagtaaaagtatagctactgaacagaaattagtctaatttgcttttgatactggaaaggtacaaatctatccttgtaccatgattgtggttttgcagaaataatgctttaatataaatcaagcagatatacaaatgtgctaatattaatgatattaaagcaccttagagaaacaagattctgaagaaaagagaggcgtggcctggaggtgggggtggggagtaaattagtagaaggcaatagtgaaagtttcacaactgacatgaagcctgtgacaagacttgacttggaggctgtcccaggctgggcactgcagggacatgcttggctgtgggagagcagtaggagctaactccctggtgcccttgtttagctgtactccgatcctaaagttttaaaggaaacactgtttatgaagacagagaggcagtcattaaccatcccttctaacagttctccaccctcacagcactttgtatcaccttacccacttctattttctttatagcacttgttataattgaaattacagtctttaaattttattttctgtgtgccccattagaatgtgagctccaggagggaacagactttgcctgtcttgctcatctccacatttttagcatcctgaacaaaacgaatatttgttgaataaatgaattagtaatgaataaaaggataaactttcccagtttatcactcccttccttcctttcttatctactcaatccagcccaggttcacgtttcatcttttctacaacatccctttaacagtttcatcagccacccttgcaccttcaatcctttttcatacatttcaccatacttccatggcaaaccccacctgtgtctatctttctgtctctctctccacaaacacacaggcgtgcacacacacacatccctctctgttcaacttttttctacacctattctcctgatgttgaaaacacagaaaaacaatattgaaaggaaattataattattgagcagcacccattaagtataaatattatctcatccttagcacaaaccctcataaacagaatcttgttgcctttccacctcattcatacacatttacttacacaagtccccatgctatccgtctactctccaatctgagatgaggccctattgttccctcctgttcagtgcttatctctatctatgctctgggttttgttcttctccactttcacacagagcttgatagtgtattacacactttctctcctgcatgtctgacatgcttccctccttttggatctttcccattaatatagaaacatagtccaatatttactcattaaaaaaaaattatcctttagagcaactgctggcgcatataaagatttctttttgtggtgacaaaaatgctcttaaattgtggtgatgcttgtacaactctgtgaatatactaaaaactatcataaactttaaatgggtgaattgtaacatatgtgaactatatctcaataaagcttaaattattttctttatttactgtgtttacttcaacatctcccattcataacacaatcctctactttctaagctatttctctaagatcaccaatgacctcttagaaaaatccagtcagtactttttagttcttatttgttcaatcttctttcagattctaaacaaacatattagtaacatggggctatgtcaccaaccttcagtggttccctactgccttatgatgcagttaaaagtattattttttaaagatagggtcttactctgtcgcccaggctggagtgcaatggcaggatcatagctcaatgcagcctccaactcctgggctcaagcaatcctctcatctcagctagggctatatgtatgtgccaccatgcccagataagtttttcatctttttgtagagatgaagtcttgctatgttgcccaggctggtcttgaactcccagcctgaagccattctcttgccttggcctccaaaagtgctggaattataggtgtgagccaccatgccctgctgaaaattatgttttatggtattgaagactgtttaagatctggctcctgtgtctctctctctctcatctgctaacctttacttcattccacatataccatattctctagccatctcttttatctatgtgcaggaagggtatgcagttgcctctgtgtaggtaacttctgctcatgactctacccaatgatcttattcatccttcaatatgcaactccagcctctcattctctggaaaacatgcctggattctgtcagtttgggcttagtacctatcctatgcttgtgcatacatacttacatatatttatctctgtactgaatttatcagattatattataattgtttagttacacttattttcccattagataatgaactctagctgagggagggcagggactttgcctttcaaccctttaaccttattacatgattcgggtttagtaaaaggttgttgaaaaaatgaataaattaatgacctattcatgttttctgctttcttgcctcacttaacaatgaactcagcatgcatccactaggaaatggtctctgataacttctctagtgttaatgttttatgattctttctatgatctaatcagtagttcatattccttttatagctgtgttttctaacccagggatttaactgtgagcaacataagggaaagaactaacacttgctgagtacttatgaggggataggcaccatgccaggcggtttacatgcattatatgtcatctcatcctctgtagagtgggcattatcgtatgacttctatatataggaaacagagtctgaggaacacaactagtaggcatcagggccatgactcaaattcaaatttatttatttgtttgtttctttgttcattctattatatcaaactgcattatactataggatttagcactggtaaatggtatgaaaaggctataataaaagactattcccctcaacctttttttttgagacagggtctcactctgttgctcaggctggattgccatggtacaatcatggctcactgcagccttgacctcctgggctcaagcaatcctcccacctcccacagcacccaatagctggaattataggtgtacaccaccacacccaaacaatttttaaatttgttgtggagatggggcctcactttgttgcccaggctgctcttgaacccctggactcaagtgatcctcctgccgtggccttccaaaatgctgggattacacgtgtaagccactgcgcctggccccatttattttaatgatattcagaaagttttataaattaaatgtgtgtatttattttaatagtgctaagtaacaaagcgatatattctcatttcaagaatatcaaatacctaccatacttagaatatcacaggccatgtttaataaatgccaaatctaatacagaatatatattatatataagtctatataatgtataatataaaaacaaattaaggtgtgatgtgtggaagactatcagttaaggcttaattttctcataattaactacttaggattgtggtaaagaaaaggaagtcaaacttaaagcaaaagttttaacggtctttagcaaaagttgatcataaaaaataaatattaaaaacttatctgtggccgggtgcggtggctcatgcctgtaatcccagcactgtggggggccaaggctggcagatcatgaggtcaggagttcgagaccagcctggctaatatggtaaaacccgtctctactaaaaatacaaaaattagccgggcatggtggtgcatgcctgtaatcccagctatccaggagactgaggcaggaaaatcacttgaacctgggaggcggaggttgcagtgagccaagattacaccattgcactccagcctggcaacaatgtgagactctgtctcaaaaaaaaaaaaaaaaaaaaaaaaaaaaaacacttatttgttatgatgcttcttcaaaaagttaaacttggaattatcacataatccagaaattccatttctgggtgtatatccaaaagaattgaaagcaggcatttgaacagatggtgtacatccatactcttggccacattgttcataatagccaaaagatggaaacaacccaaaatgcccattgatatataaatggataaacaaaatgtggtatatatatatacacaatggaatattactcagcctaaagagaaaggaaattgtgatacattctatagcatggacaaatcttgaagatattacgctaagtaaaataagctagacataaaaagacaaatgttgcagcattccacttctatgaggtattcagggtagtcaaatttatagagataaaaagtagcattgtaattgtacagggactggggaggaaggaatgaggagttattgtttaatgcttagagagtttcagtttgggaagatgaaacatttctagagatggatggtggtgatggctgtacaagaatgtcaatgttcttgatgccactgaactgtaaactcaaaaatggtaaaaatggccaggggcagtggctcaggtctgtaatcccagcactttgggaggccaagggaggcggatcacttgagttcaggagtttgagaccagcctgggcaacatggtgagaccccatctctactaaaaatacaaaaattagccaggcgtggtggcaggcacctgtaattccagctactcaggaggctgaggcaggagaatcacttgaacccaggaggcggaggttgtaatgagctgagcttgcgcaactgcactccagcctgggtgaaagagcgagactctgtctcaaaaaaaaaaaaaaaacaaaggtaaaaatgttcaattttatgttatatatatttatcacaataaacaattttatttgaaattataatgtgttagtttaggtgaaagaaaaaatataattgagcttacacctatattcaaatatatatctaatgtctacatggagtattcccactttgaaatatcctaccaagtcaatttaacatttatttttccattgtctgatcacatatgctgaactcagagtaagaaaagatggtcaaagacaaacataagtcttctaactctctgctgtacaatgctgtagcctctagtcatctgtgcctatttaaatttatattaattaaaattaagcatttagttccttagtcacactagccacatttcaatgtacaataactacatatggttcatggtttattagacagtgcagatagagaacatttccagcactgcagaaaattctagacagtgttcttctagattaacgcacagtaaacttccttaaacaatcattggtgtgtaagtggggacagtggtcaatccagaataaaaataaaaagccaagcacatagagtgactcatagaggaaataactagctgattgagtgtactacttgttaactagccatgacaaacagatataggccaagtgacatttttaatcatgaaaacattgcgtaacctttaatgaaaagtagagctacttatgtcatcttggacataccaagagacaagtcttttaagtaataggatcttgcattgagagaaacagtgttaagcatattttcacagcaactctatagaacattacagaatttcaaaattagaaatacggagattgcatatagtgacacaaaaaatatatactggcatagtaagtacaaccaatttatgctggtacaaaaaacaatatgctggtatattaaatacaaccaatctctttttaagaaattataaaatcagttctacagtgagaattcagttatatatcagctatgtagagatatggataattactacaggataacaggagaaaacaaaaatagctggtatatttgttgaagaattatgggcatttaacagaataaagtattacgttcaaatattgccaaaatgaacaaaaaaaagaaagtaaataggcctatgctattttatcccaacaataaaactatgcagtgttttgtaacactacctgtatgttgctctcacctcaatacctttatggaatcctatgtatattctgtgtcatacagtcaattgatgttctgatcaaataaaatacccccagaaggagtattttcaaaaaactgaacaactggaagagtctttaagagtttatgtgacccaattctctgctaccacagtttttaaaactgaaacatagcaatttaaaacttgggcaatttaatgcaagtgtacatctagtacacagtgcttttgtgtgcatgctaacttatctagcacataagccaggtgataatatgccaatttatttaaatatgtacttacataccttccgcatgatcagatcttagtagaactataaaagaatgcatcaagtgctagggaaaaatggcaaatctcacacattacaaataatgttcccttcaaagtgatatataacttgccccatgaatcaaagctcctggtttcctaaacgcagttgtgttctaaaattgtacagattaaggttgtatcattcaattctataatttttcatatgaagtatattggaattagaaggatgcataattagattagaaatactaaaaaaagtaaggtcttctacagactttttggtgagtgctgcatttgccaaaatcatgttttaagtgttttacttgagaaaataaatgacaagaataaaacaagttcaataacatctaacaacaatttgatcacataggaaagatttggacttcaacccccccattaacttctatgtggttatatatgttcttaggtattacatataaatatgtgttttatcacatttcaataaatttatgctcataatcatatctctttaatgaattattactattttcctacaaaaatcatgagtaacccccaaagttatataaaattataaataagattatttataccttaacaggttcaaatagaaaaagccgtcatcttatattgggtcaaacattttgttggaaggaacctctgggttcaagttcttgctaggtcactgataaattattctgcttaaggcactttacatctagtttcactttcttcatcactaaaatcaaaggatgggggaggtgttctctagctccttctagtttaaatatacctgactataagttgctttctcaattcagataacttacctctctcaacacaggatcagttattgaattcagattgacagctccttcataggtcaagtaatagaacacattgagggctcggacagcttctggtccttgctgtttatagccaaaaatgagatcaatccattggtgaagctggcaggaaacaaattcactctccagggcctgaaaaaaggtatacattgtattactatgctgaattcctttttaaaaatatagagagacatttagagcaatcagtaaagtttaacactaactttactgtgaacaaagatttttaaaaaacaaaacttgtggccgggcgcagtggctcacgcctataatcccagcactctgggaggccgaggtgggcagaccatgaggtcaggagtttgagaccagcttggccaacatggcgaaacccggtctctactaaaaatacaaaaattagctgggtgtggtggcctgcgcctgtaatcccagctattcaggaggctgaggcaggagaatcgcttgaacctgggaggcagaggttgcagtgaaccgagatcacgccacttcactccagcctggaaaagagcgaaactccatctcaaaaaaaaaaaaaagaaagaaacttatctgatgtcctagtttctaccagaatctgtcctccttggtttataattagaggctttccggcacttggcataattaattacaataaatgtgtaagtttcagtatttttctaccgtactgacagcactgaggaccaggactgggcctatcttggtcacatttgtaactcagggcctgacaggtactcgatttatgcttcaaagaaaggaagccatacaaggcaaagactattttgggaaactaaatgtgaaaatgttaaaaatttaccatccacttgaaatatttattatttttctagaattaaaatattttgtagtctatttcaacatgtttaaccaaattatttagttatgttgattgagttcttatgctaacaaattagattttgtgggggatacctataattactgaatttttattctaggtattaatatcaaacctgaccaaatatttgatgctattaacataatagtgtccaataaataacgaatgaacacaatcaagtatttggttgagatgctaggcacaagatccatttcctatccatcattatattcccagctacaagcgttgtgcctaaaacataatagatgccaataatgtttggtgaatttaataacgttataaatactaaagacttttaaaaactaaagatattttttaggaaactatccatctttatattatttaatattgttcaaaatcattccaacatcaaagtttagcattatggattagtttaacgataaataattatattaaaatcaaagagttttcaaacataaactctaaagcttaattaaaagtatacagtaggccgggcacggtggttcatgcctgtaatcccagcactttgggaggctgaggtgggcggatcacgaggtcaggagatcgagaccatcctggctaacacagtgaaaccctgtctctactaaaaatacaaaaaattagccgggcgtggtggcgggcgcctgtagtcccagctacccgggaggctgaggcaggagaatggcatgaacccaggaggtggagcttgcagtgagccgagatcgcgccactgcactccagcctgggtgacagagtgagactccgtctcaaaaaacaaaacaaaacaaaaaaactatacagtaatcccccctcatccacaggggtatgttcttcgaagacccccagtagatgcctgaatctgtgaatagtaccaaaccctatacctatatgtactatgttttttcctatacataaatacctatgataaagtttaatttataaattaggcacagtaagagataaacaacaataacaacaaaattgaacaatgatatactgtaaagaaaaaccataataaatgttatgtaaatatggtctctgtctctatctcaaagtatctgattgtactgtactcacacattttcagaccttggttaaacacaggtaactggaattctggaaagcaaaactgtggataaggaggagactgctgtaccaacttatatctggtaatgtatctcattgaaattgatttttatttttagagtagtaagtctatgattgtgatgtattttcagtatggcttgctgctatgttataagagatctgttggttttaaaacaaaactgaccaacttgtatagcaagtaaccaatgagacataaaccatcttgtgacaaaagacgttcctattcctttacatgtggacacttgtgtaaagatacgctttattaaaataagtgcctatgaaaaagaaatgtttatagctaaatacaaaaaaaatttcctttaatatttaacatagctttatgatatatcacaaatataaaattgaaaatataattttgtaaacaaaactctatgcaattctcacatcccaaagtatactttaaatgaaatatgccttaaaaatacttagctaggttcaattgagaaagttattgttttagacatctcttctaaaatgctttacatttacaaatttattaaacagatatgacagcacaaaactgcttcatattttacttgaaataagaagagaggagcttgtgataactttaagtaaatgcctattttaagtacataaatttgaaaaaaatctaggaactactaatgcaagttacacacagaaatgatacgttggtttcattaacttagaccttgggtagggatgggggtatggggtaggcacatttacaatgacacataaaaacagcaattgtcttaatttgtgtgcagtgcactctacacaaaagccctaaatatgttcaaattagagcaagctgcttgattgtcactgcagtctcatgtcacattaatgcatgacaaacattaaaccatacacttaaatggcaatttatatcatttaaatgtttactgccagactagctcatcactcatttaaatgtgactttctgacagctaatttcagttaattttctccaattcacttaattagaactttcaatcagggaaggacctatgcatatcttcaggcttacatcctttttggtggctgttcgaaatctgagttcataaactgccgaaaagctctactataatagattagcatataatatctctgagtttacaaaaaatatgactctatgaagagtatatactcacagtatatactcttagaaagaacttatacttatttatgtaaatagtactcttgccagtagtttaaataaaaaacgtgtagttcatatacacacactattgaaacaataaacaaaccctgcatccaagctaattaaaaattaatgatttcaaaattgtttaataagataaaacagtcaggagtctcctgagtgtccatggtgttgtgatttgagaccataaaattctagaaggctcagcaaatgacaaagtacaaatgaattttctcaatattaaagctctaaaaactagggcaattttattttatgtgtcaccaaacaaagaactgttgaattttccttacggttgactacttctttatgcacactcaaaatggtaaagttggttagatttcgatgcttaaagctttacatcttgatactgcatcagaattttaagcaaaaatgctgaaaggaaagctaccgtgtgctcatatcatgctgcaaacacacatgcagagatcaccacaatgccatggttcagacctcaccttacattgtcataggtcagtccttaaggagttgaccagtaattcgcggaactattggcaaaatcacttccagaagttgataaacacgttaccttcatgaatatactttaaataatttctcaaacactcaactaaaaattccattagtcagcttcaagcatgtcttgcaatataccaaagctttaaaaagggacctaaaagaacaaagtggtaagtataagagaattccaagaagtttcaaagtcatttcagtacaaagtcagctccgaactttaacatccttttgctatcagtgaatgacaactgcctaaccaaaagtaggtaatgcacttaagacttgaggggagagagaaggacaggcaggaagaaattaagggaaaaaatacaaacagaatgtaattcaaaatggaataccctgaggttgccttttataactcccatttttaagatttaaaaacataaatcataaaacctatattaaaatagcttttttatatattaagattttttaaaaaaattcttcatatatagaaaattctcatttagatctacatttttagttacaaaaaaatgaaaaatgccagtggaatgctgagcatttgagatttttcaaagccttcaaaaccgacagtcctcattaagcctggagttaaatacggtttgcagctaggggatagtaacattcttcccatgctgctctcaaacctaaccaatcaattgttagtactcccctagcaggctgcatacatcacttacatccaatgtgtgctctgagtaatatttgtaaaaaagaaaatccactaaaatgtccaacacaatataataatattcaactcatctgagttattataaaataaatcagtgactaatgtccaattgttaaggatcagataagactatgaaaagactatcatatgaagcctcacacgaatgttcaatccaatccagggggactcatattagtgttgacaaactgtcttggcgctgatatctgttttttttaatgagatctattaggcagagtaaaatacttcagatatgctaaaaagtacagtatacagatgtcaaatacacttattactaactttcatttgtttgttctgcatacagaatatcaacaaagttttaatattataaagataatagtaaattattcataaataggaggtttgtataaccctgtgtcagaaataattacaatatgtgtgtgtgtgtgtatatatatatgtgtgtgtctgtgtgcatgtttagcaaatctcactgaaagaacacaatctatgctttcctgaaactaactcacttaagaaatagattatttctttataaaaagtgttatataaaattattattttctatagtggagtcaaaaaatgtgataacatatagaaacagctttttccaagaaactctaagctatttgagaataaaaattctaaactaaaaggcattaactatgtatttaatctacacatgcattagtgatacactagcaatttccttttattttcaaaaaaccaaatttttgccaatgtaaaaatcaagaaaaccaatttcaatcaacaaaggaaattattagataattgtttacctcaagaccaagaaaccttatttgtttattatttatgtttctcatacttgtcattcccagcttaatgctaatatttacttattctttggctaaacattctcataccactccattaaaaaaagaaactaaataaaaactagcaatatctatgggataaatgatttttataaaaagttaaataaaaagatcaaatattctttatacactttttataaccagagagaataggcctaggcagcccagaaatacatttctgcacacctgtaccactacttccactcccaggcttctagaaggcccaaggtacaaaggttctgagatacaaaataccatagctgtaagtttcaaatgagaaaatgaaaatcactgattaaccctcctgacttgaaatacatttacttataagatgtatttaatcgtatttataatgaatgaaacatccattttgtaaaattttaattgtacttataattaagagtcttaattcatttgaacatagataacagtatgttttaaaggaactgacattgagattggcaaggcggtaatatacaaagttataaacttggaattttaagtatttttcattttaaatccatgtaatacggccttcttcctatacaaacacatatacacacagagatttaaaatgaactggtctgttatgtttgcatgtgttggatttcaaacactagtggtaatgtttccttaacattgatatatgacctttgtaatttacattgaagaaagctgtttttttcagcctaattagaactgtttcaaattttcctgctaaatatatgatataaagtcctttcaacttttttattctagagtttctttccatgtcaactttgttccaatcaaaatatgctttgaattaaatgattttgattgaatatgtggatcacatttcacttctaagatgtaaagtccaaaaaggaaaagtttagcctgttcaaacaaagcaagagcagccactttgcggaaagctattcacatttaagaagactgacaaattgtttgtgtgcaccattaggtctagtttctgcaatagttgccagatttcctgtccccctaataagatgcattaactccttaaatgctggctctgaatttgcagtgaatctgagttactttagcaaatttcaattttatctataggtaaatttccttatttgaaataaatctaaagaaaataaaagaaaatttgatgttaactatgttgtatcaaaattttctaacaaaggtcacagaaaattaacattttttcatattggttggatataaattcagaatacaaatatgttttctatatgtgacttgccagaagtgacaaattcacatcaatcctcatttaaaaaaaatgcatcaatttcactaatttaaagattacatcttcaggtaaaacacaatggaaatatttaataaactaaaatccatgaatatgagcatcaatttcctccacattgattatatataaaacacaatgcttcagagttcagctatttaccttaatatacatatatatataatgtgaaacaagctttatcctatttacaaagaaaagtttaattttgagagcttaaaaatatgtgtgaaattgtgacattaagatcaataagtcatgaagcccaagaaagtaaaaatggaggatcaaagatttagggaaaaaactgtgggatgctaagaataaaaattgtatcagacagttttaaaaaatgaaatttagtcaacaacatactgaagttcagcctgaaaagcagatagagaaatcactaaaaggggttctatacttctaaactgcccttgaactgttgggcagaagagatattttgagccagcagtacacagttcatttctacatttatatcattactaaagaaaagtgtgagttagtatcgtatcttgatataactatcaagcactcgtgcatcttttggcaggagaatcattctgtctacgattgttattgtgtagttttaaatggactagtcaaccagctgttatatattttatacactgaaggccatgtttcctttgaaattcatagttttaatctcaactgaagtctgtattgctgtgtgccaagatcaaaaggattagacaaacttgtacaattaccttcctttacagagagatgatttttaaaaaatgtttaaaatactcctatatactgacattttatccaactattttctttagaactacagaacattaaaacatttaattaacatttcaaccttaggtcacttttcatctaaaatctaggaattcacaacatacagatatgctaaactaattatagtatcacacacatagggatattgagcttttttttttttttaaaaaaaacctttagtttattaaaaatggatggggaaaaattatacctatttcttttatgtgtttgcattttgcaagcctttgctcagaaaataattcatagagcttacagtgatatatatgcagcaagatacaaaagagaagtgaggcaatgcaaaatttaaagggagatatcacataaaaactatgccatgaaatttcaaatacttgttttaacaaatctatatatgctgagccatgtatttgctgctaagctttctagcaggcaacataaagaaagaaacacgaacaattacaggagacaaaaatgaccataatgtaaaaacaaaccagatggcctggaaaaacacattatttctattcctgagataagaaattcctcccttggcaatatgatggaatccaggtatgtaactctcagagggactgagttaatcctgagatagatttaaagtatagacaaatggggagaccacatattcttcagataatcttgcacaaacattatttctcttagaaaggctttgaatggtaggttctagattgtgcttcatgacaagtacctggaattaagctattttattttgttagttaaatgcagagctaatatgctttgataacaggtaaactgagtcccaggactaataacctcctaagaatgtgaagagtataaggagaaggacacagcctgtatgaaaggcaggctcaccattacttggaaggtagactagcctgccttaaaacaggctcaaaggtaaactttctcacatagataaatatgcatcaaaaacttccaaattccaaacatgatgctgtaatatttatagacattaaaatgtttaaaacaggtatactagatgttcaactctttaaaaaattagtaaagtatccctagaaacttaatgttgaggactttatattgctgttatattttctaagataaactagttataaacatagacataagtaattaaaatattaatttaaagtggtcaattatccacctaggtatagaaaaatgaatgtttcctcttcagcagccatcacaaaatgtattaatttactgtatgaactcctgtaggttttatattatatagtcagttacaaaaggaaggaaaacaaaataaaaaaaatttaatcccttcccatttgcttatccatatagatctgataaatactagcagtctcttgcctttgaagatggccagaccagaatctctacttattgccagatgtagtttaatcccatgaggactccagacaaaaacaaggagctgtctgcatggcaccaatgattccctggactgactgccataaacttatactggcaaatcaaaatccttggcaaagtagaacatttattatgtcattactcctaagaatatccaataaagaaaaacttgaattaaaaaaaagcaaaagttgctgaatataaagcattaagttctgccagagaatcaaattacatctgcatttactttgtgtatgcgattgcatacttgtatattatataggactaaaagtattatacattctgcaactttctattaatgttagcatctctctcatctattcattcagtaaatatttattgagtggttactattggtcttgtgctagactctggggatactgaaatgagacatccctttggaagaaggaaaggggagcaaaaggtcagctctaagactactttcatagtctaagtgagaggtagtgagagccttaatcaagaaagtagcatccggagtgaagaggggacagagttcagaaagatttaagatacaagttattacttacagcaactgattaccagtgtgaggggtgaagaaaaaggaattttgggtgatcagtttgaaccttaaccatactagaggagaaattgtttacatggtagaagattagttgagttttgaacttagtattaatattttggacttccttttatagacttgaaattaaccctttgttttggatctaaggctgagaattttagtggaagtttgtacactattaaagtattaaaatatgtttgaccaggcgcagtgggttacacctgtaatcccagcactttgggaggccgaagcgggtggatcacgaggttaggagttcaagaccagcctggccaacacagtgaaaccccgtctctactaaaaatacaaaaaattagctgggcgtggtggcgcgcatctgtaatcccagctactcaggaggctgaggcaggagaatctcttgaatccgggaggtggaggttgcagtgagccaagatcacaccactgtactccagcctgggtgacagagcaagactccgtctcaaaaaaaaaagaaaaaaagaaaatatgctcatgttcaatagtggaatgcacaagccaaaaaaattctgtgtaacaaaatcaccccaaggattttataccagttttgtccaacagatatatatccatgccagatatgcaatttaaaattttctagtagccacatttttttaatttataaaaaattttttttaaaaaatgacacagggtctcgctgtgttgcccaggccagtcttgaactcctgagctcaagcaatcctcctgccttggccttccaaattgctgggattacaggcttaagtcaccatgcccagcctatagtagccacattttaaaaagtaaaaaaaaaaaaaaagtaaaactgttttaatgacatggtaatattttatcaagaatatacaaaatatcatttcaacatgtaatcaacatagaaattattttgtattaaatctcagaaatctggtatacattttacacttacaatggacagcacatgttgatcacactagccacatttcaagtgatcaacaaccacatgtgactagtggttatcaactggacggtgaggctttattcagttccaaatactgaatctgcatccagattttgatacaagacagaatgcaggagttaacaatacttaacacttttaaaatacaccttatcttactgaaaataaagataaaccttacaaagtacgaagtaactgccagactaaaatgaccttcaatgcagttttgaagaggccattacaattctcagtgccgtgaagaatggctacaccttaggaaatgacagcagaaatgtaacatcttcaagtgtgaaacagacataatgtcctacagtgtatattcttcagccatttatagatctctgaggaaatgtggcagcatctgaaagacggcattatgactatcctctaaataataaaggtaaaagggctaattctaccaactatgctgtaatctataaactttccatccttaaaggtccttagttagagttcttaaattttggctactcagctctatcagttatgtactttaagaattaccatatagccatagaccacaacttagtataggggacataatctttgctgaaagtcagatatatgacatctgtaatgtgtatgtattcacaaaactcataaaagacacttcattttagtagcagataacgagtctctgtctactcctagagattttttaacatctacaataacattctgattcccaaaattttgggtctgactctttctgcattttcgattaaataatgattagttaatagggtcagtcttttaaaattatttttaagtagccatgaatacatatgcaatatgaggtcaacaatagagacttcttgcaagagttaaatacatttcttatttatgtttccttacctccctttcacttcttaactagtttctcctctttctgttacaggcacaccactgaaaatgtttttgcaaagattactaactgtctgaatccagtgtatgctcatcttttctcatttcacctctgcattatggtgtttgtttctctttcttcttctcgcttgacactctctctccagattctctttctacatttctgattttcctattcattttcttaatatagggtctttttcctctaacatttcagcatttattctcctcaagattcagtcccaggccctctgcctctggtataacccaggctagatgagccacacttcaattacttcaaccaacaattactacctctctggagcttcaaatacaaaatgccaactgcccatcatactacttttttttttttttttgagacggagtctcactctgtcgcccaggctggagtgcagtggcgtgatctcagctcactgcaagctccgcctcccgggttcatgcccattctcctgcctcagtttcctgagtagctgggactataggcacccgccaccacgcctggctaatcttttgtattttttagtagagacggggtttcaccatgttagccaggatggtctcgatctcctgacctcatgatctgcccgcctcggcctcccaaagtgctgggattacaggcatgagccaccgcgcctcgcccatcacactactttttttggtgtgcttcacataactcaaaattaatatatcaaaaaccaaatgaatagtatttcctctgacacttgctccttttcttgtctttctggtgagggactaggtccttcatctagtcagccaattcagaaatgtggcagtcatcttgacttctcctttcccctctccctacaaaattttatcagacaataagcctcctaaatatcttcccaagtcattctttcttttcctttcactgggactacctttggtttcatgcttcatgatttctttgttcagttattctatcggtatccaaactgtttctttatctctaaaatttcccttttcaatccctcctccatatgaactgctatctaaaacctagccaagtcactgctctccttaaaacttttctcctttccctaaagcagtggatctccaactttaacacacaccaaaattagctggagaacttgttaaaacaggctccaatccacagtctctgtttcagtagatcaggggcagagtccaagaatttgcccttataacaagatctcaggtgatactgatgctgctggtccaggaactccttttggccaccacctccccaaagaaaaaagtccatactatttacgaggcattaaagatttatcgtacaatctgcctccagccatatatttccatacacaccacccacagttctctcaaacacatacttcagtctaccatctgaattaagtttagctcatgtggctgcatgcagtggctcatgcctgtattcccagcacactgggaggctgaggtaggtggatcacttgaacccagcagcttgagatcagcctggcagcctggcagcctgggcaacatgatgaatccccatctctactgaaaatacaaaaaaataaaaaataaaaaatagcaaggcatggtagagtgcttgtagtcccagctacttgggaggctcatgtgggaggatcacttgagcctgagcagttgaggctgcagtgaggtgtgattgtgccactgtatgccggcctgggtgacagagagagaccttgtctcaaaaaacaaagcaaaacaaaacaaaaaacagtttagctcatgtacagtactataaccttgatatctttgttcacagcgcttcttatatctgtaatgtccattccatcatcttactccctgcctggcaaacccctattcattctcaaagactaaggttacatatgggttccttggctaagccttcctcaaccttccccagaaacagaacaaggcatttcctcttttggtcccagaatatatatttattctctctctttctctctttgtgtctctctctacacataatgttaaatgctttcatggtaatcttgctactccttcatggtatatatacaagtatatttattatattacatgttatcacaagttatatatttgtttacttttttatttattatctatttcccttacaaaacaataaattccaaaagggcaggtactatataccatctttctcactgctgtataaccagtatgtagtaggtactcacaaaatatttgtagaatgaatgactatatcgcttaatctatttctctaattagttactgtcatgtctgtctgcttctcataatggcagccccaaagggcaggtgtcacagtcttccaattttgtgatcacagatctaattatccagtaggcccctaatacatgtctgttgaatgaatgaatggcatttaagaaattcttctgatttaccgcaattcaatgtctatgctgagggactagatcttaaagcactgtttaagaagcgtgaaattgaccatagccactttacttggttgatacagtgctggtttggcagagttatagaaaatttgaaaaatttctgtgattactagccactgcaaaatgagctgtctgcagtttgttaaccatacaatcaaatttgaggtagaatgattacatgggaaggaaaaaaaagtgaagtggatattaaagtatcatctttcaaggttttattttctcttcaatagtgtccagaagacagatgcaaatgatatccctaatacacttgacaaaagctcaagaaagtcagtatgttatgcaaagaaaatgcatctagaggtcaacttgggggaaatgcactgtccaactaaacaaccaccaccacactataacaataccagcagcatttaacatttagtgagtatttatgctgtgcccagctttatgctaaatgttttacatggactattttatttaatccttacaataatcctataagcaccacatttttaaaaactgttttacaaatgaagctaagaatgcttaagcaaattgtctgatgtcacagctagtaaatgtcagagttgtgacctgaacccagatttctctgactcctaaagccatattaaccacaacacatccttttgaaccaaagctgcaatatgaaaactctaaaaatatgaaaccactacataacatggattacttttcattggtttcacatatatcatttagaaatactagtaacaagtattgctgagtatatactaaatctggtgtgccatgttgatctggaggctttatttacaggttttactgttctttcaactggttttttgctttgacacatgcatttttaaaaccaatactttcaacttgtattacagcttatttttctcttttattaactggaatgtaagctcctagaaggtatagattatacctgtattcttggaactgagcatatagtagatgcccaataaatatttattgagctggataagaaatttatattctaggcctctttttcattaatgtaaccatatattcactataatattttatatcataataaaatatcataaaaatgtatatcataaatatatatcataatatatatacacacacagagagaaagtgtgtgtgtgtgtgagagagagagaaagagagagacagggtgtcactttgttactctggctggagtgcagtggtgtgaacacagctcactgcagcctcgacctcctgagctcaagtgatcatctggcttcagcctcccaagtagctggactacaagcatgccaccacacccggcgaatttttttatgttttgtagagacagagtttcaccatgttgcccaggctggtctcgaactcctggactcaagcaatctgcctgccttggcctcccaaagagatgggattacaggagtgagcaactgcacccggcctcattatgatattttaaaaataaacagcctttagagcaagacagagaatgataccaatatattagttgctaagtccaaagactcttaataaataaccaatccattaaacaaaaaaactattttaggaatagttaataataggagttcattctgcaaatttctaaacgtccatgacattagcaacttatgaaaatgtgattttaggctgggcacggtggctcacgcctgtaatctcaacattttgggaggtcaagatggacagatcacctgaggtcaagagttcgagaccagcctgaccaacatggagaaaccccatctctactaaaaatacaaaattagctgggcatggtggtgcatgactgtaatcccagctactcaggaggctgaggcaagagaatctcttgaaccagggagacagaggttgtggtgagctgagatcccaccattgcactccagcctgggtaacaagagtgaaactctgtctcaaaaaaaaaaaaaaaaaaaaagtgatttcatgtattttaatttctatattttgacacatgaactatttgatttccttaaatcaaactactatgcagaaataacagagaaaatttctgttatttcctacttaaacattttcatgtaactacccgattggttctacgtttctgttaatatttggaaaataccttaaatacttccacgtaataacactgctcaaactattcaaaatattgattagatttttttattttaaaaaatgtatagcacaaacattatttgtttttgtgattttaatatctcttaaatgtaccatttgacaaatgcttttaaattaaaatactataactgataagaaaaaacagtctcaaagaataaggctgttttgagattttttttaagcctttcagacaacccctatgatagctggtaagacatattagaatactataaaatatgagttagaatcactatctttattagattaggagaactgaataaaggacataactgtattcactctgaggctactattttcctcctttgttcttcaaaaatataactctttttgtagaatgtctaccactgtagttaaattcaactcataggatgcagttataggtcagaatctagcaaaatatattagaagcaatctaagcatttaaatttttcttaaatatgaggtgaaaagacaaacagcatggcaagagttaattgaaacattcctgtttgagagactgcatggaggagtgggggctggtggacagtgagaggagggagctaggccgagagatgcagagttaatcagggagcaaatccaaagccaggcatggataggcctcactaatgagcctcaagtaccctgcagtggttttcaaacttaactggcttcaaacgatgccaccccatgacagaatgcagctagccataagaggagggtgattagaataaatgactggagtaattaactctgatgtgaaaccacctgattggaaaagagaagccaagagctatttagctgatggtcctccagtagaaaaaggaagctttccctttctcttgtgtgggtgttcagttagaactcaactctttcaagtaggtatttggtagcactaatgaaaagcagctttcattcaagggcctctcaagggccttcccattcattttgaaaggggaagaaaataaaagcttcaaagtagaactaatttactttactcccctacctcttagtgaattttgcattagtgaagtctgcattagtatttatgctaacaaatttacctccaaataacgtcatcaaatactaaaaattttatttatagaataactagatattaaggctaattaaaattttttaaattttcctttctttaaaagtgttttagaaaactaaacttataatttataattaattgttgattagttacagcacttcctttactctagaatgagggagaagtaaaacataaatggggtacatctgtttttgaagagaaaccagagaataaggtggaggtaaggaaagaaagaacacatatttttgcaaaaagacagttttcttacagtgcaaattgagccaaagaatccaccacactctctggcctgctttattttataaaaagaggaattacaaagacttggggcattactgcctgctgttttacaagtaatcatcaattcattgggccaatgttgttctgtacctgctgagttaatgttcctcggcacacccctcccccaaaaacaggttcacaagctgcccagtaacaactacagcgtaagtagcacatgtaacttagcaaatgtttatgccgaaactcggatttatttgacagctttacacctttgggcatgatataattaaatgttttgacagctaaacaaaaactgtataaatttaaaagctattaggagctcagcatctagaatcaaaatgaagtaatttgcttataccctaagctacttttagtaatgcattccaataaaaagcatgaagaaagggataaatgtctatccgaatgttttagctaattcgttcatattcttctatgaagaatattctccttatactgataataaatggcatcttaaaaaggcaacataaacgcatttaagattgtcaatataatccctaaactctatctctggatattttctgtaactttagaaatggtaatattaaaaagacatagactaagaaatagtatattactgtatttttaaaaggccaccatgtgctataaaaaaggattgaaagcaacacagggacagtgaggtatccttcaaactcagccattaataactcaagggggttaatcctcattctctcaaggtgccggttccagattttcacaatatgctatgctgctgtagtcctccgagatttcagtgctcacttcataatacccccaattcacagtttaccttcggagaaaactactgttcattatctgagctccagaaaatgttcccatcagtggtactactttaacacaagatttaaaaactcagatacttccttaaaaaggaaaaaaaaatactataaagcaaaattgtccattaaactacaattttttagaaaatgaaaggttgttttatacccaccatatggcatcacattatcactctggacagcacatacagagtactggctaacagtctaacaaaagttaaatttaaacagcatctaagttagaacattactgaagcattttcaggctatgtatatacaaaaacatttaaaatttacttttcattatgtaacaatctaaggaatactgtatcttcactaaaggtaacaacgatcagttgtttatttaaaaaaacaaatcactaaaatgtttgaaaaccagtccacttttcatgtggatgtttatatttcacttaatcatccttcttggaaagacagctctaaaggaagaaaatactgagaaccaaatcctgtttaacttacacaaggtgatgtcaagtaatttaaaaaacatattctaaaaagagcttcttctgtacacatctaaagacattactgcattatctaattgttctcttcctctcactcatgttaacaggatagatgtctttttgtgtaccatatttggtttcactggcacatagcctgaaaacagattaaactgtttggagtgttcaaatatctgatggtgtatggactgtgggaataagagactggagactcagaagctgatagttcccaaacagctattttccttctttcttttttaaaaataaatgaaccttgagtcagattaattaaacactggttataagactcaatattcctagtagataaatagatgtttgaagacttagtcaatttcaggcccaaaagtaagtattactaggtgtaaaatttgtttaaaagatgtcattaaaatattacatattaaggtggtcctcttaatataatcttgatgtcttttaactatctcattctttctcttctccatggacatcatgttttgcaaaatgttatcaaataatcaaatgttataaaataatctcacaaagatgcatatatctgccagaccttctgattaggagataaccagtggtgctaacctgatataatttagctgaaagcacaagaaggttgaatttaacccaggttgcctttttataggtaaatgtactatgttcagaatgcttagaaattgctgtggtggctctaatggttcaacaacctttggctgagacccactgaacacatacaaacatatgatgcctaaaaaaatatactttttttttttagaccaaacacctttgtttcaggtactgctaagaaatataagagctgcaaaataattataacaaaatgcttacttatgcagaattttaactttagattcattgaaagaactatcaaactttttgacagattttgctaagtattgtacgtatataaaaaagaaaatataaatgaaatatttgtaaaatgtttgagagtctacctcttctgaaatgcttcctgattcaaaggtgttgatttctgtgtttctccatatagtactgtcctccatgcctttataagagcattagtgaggcagcattttttaaagagtcctccattattacatttgaacttttcttccaagtatcatactacaaattatgatgctgacatgttcttgatctttttgacagccttgtacacgtgccttagggctcccagtgctttcttcatgactgctcaatttctagcctcttctagtttaactatgatacttctatctcaacgcctccactgtgataactctatcttaaaacttaccaaaatacattaagaaataatgttttgtggagtggaagacagtttggcagtttcttacaaaactaaacattctcttaccatatgatctagcagttgcactctttggtacttacccaaatgagaggaaaatttatgctcacacaaaatccttaacataaatgcttacagaagttttattcacaattgccaaaagttggaaacaaccaagatatattttagtaggtgaatggataaacaaactatggtccatccatacaatggaatattattccaaaataaaaagaaatgagctatcaagtcacacaaagacatagaggaatcttaaatgcatgctactaaatgaaagaagccaatctgaaaaggttacatactatatgattccaactatatgatacattggaaaaggcaaaactatggggactataaaaagatcagtggttgccaggagtggaggaggaagggggaatgaataggtggagcataaggaatttttaggacagtaaaactattctgtatggtactatacatttgtcaaaacctacaggaagtctaacataaaagtgaaccctaatataaaccaaagactttagttaataataatgtattgatattggctcatcagttataacacagtaagtgtaccacactaatgcaagatgttaataatatggtgtactgagatgaggaatagtaagaggtatatatgagaactctctaaaggttctgctcaaattttctgtaagactaaaactgctccaaaaaataaaactgataattttttaaaacatgatgtttatatttttctcctcttctttgtcttccaaagaatatctcatgcctaagaaagttgctggcacatattatgggtttcaattgctactttctaaagcgaaaggagtatggaacccaaaagaaggatctcaaacccttcattcccaccaaatgtgccacggcctacagagaaagaagcattaattaacacatttaattaattaaactcacacttttcatatcacgtatatgaacatgttctagtatcaatattaatatataatctatctccttttcatagtaggttgaaaagcatgagctgcaagctactaaatttttttttttttttttttttttttttggagacagagtctcactctgtcacccagcctgcagtgcagtggcgtgatcccggctcactccaacccctgtctcctgggttcaagcgattctcctgactcagcctcctgagtagctgggattacagtcgcccgccaccacacctggctaatttttgtatttttagtaaagatggggtttcaccatgttggccaggctggtctcaaactcctgacctcaggtgatctgcctgcctcggtctccaaagtgtcagattacaggcacaagccaccgcgcctggccgcaagctactatttatctaatatttatatctcttattatgttcagggtactctggctgtgtcctgtgggataaagacaaatgaggcattctatacttgccctggaggaactccagtctaatggagacacaggaaaacaagtatgtccaaaggtacatggaaagcagagagctgagaacataaaacaagcttaagcaatattatataacttattttataaatatataatattaaataatgctattttctatatttgttaggtaaaaatgtgactcacatgaattaacactcaagataccataaagcttaaagttttaaatgctgtctatattcctatcctaaaaatatttcctcaaattatccttaaacaaattatgaactgcctttatgaagcatatttcattttcttcaattatttcagcctttggttcatagtcctattccttgtcatcattcttgatagcttcagcatttcatctaatggttcttctctggaagccttccttttctactcattttagccacttttaagcattaatgtacctttgatttaataagccatgtgattcaagtctgcatgaaccattatctcttattctatcagttaatttttctgtcagatgctcgttatgctaacttcttgtgactccttttagttcttaaattacaaagataatacaataaaaacaaccagtaagtgtttgcttactatttatttgagtactgtgataatttctataaataatatcaattaattctcaattttatgtctccaaagtaggtgcaccaaaccactacaccgtattttatttctgtataaaatattattgaaaatgttggctgggcatggtgacgcatgcctgtaatcccagcaatttgagaggctgaggtgggaggatcacttaagcccaggagttcaagaccagcctgagcaacatggcgaaacaccctctctacaaaaattagctgtatgtagtggcacacgcttgtggttccagctagtagggaggctgtgagcccagaccatgccactgcactccagcctgggtgacagagcaagatcccatctccaaaaaaaaaaaaaaaaaggaaaggaaaagaaaaaaaatccaaaagatctggagtcatagcctgggtaaaatggttttgaaatcttgggcaatacttaacttcttaaagcttcaatttattcctcatttaaatgtaaaaacaatatgttccttataaaatatccttattattaaattatatgcctggtacgcagtaagttcttactagatattagttctcctcctgtgatggccagcctccaagatggcccttgatgattttcatctcctatactaagtacagctgacctgtgtaagcaataagatagtgcagaggtgacagtgggagttcgaagactagtcataaaagatattgtggcttccctcctcctctcttttgaatcatttgatctgagaaatgctccatatggtgaggatactcaagcaatcctatggagagtgtcatgtggaactgaggcctcctgccaacatgtcaacaatgcgagacattttggaagcagatattccaccctcggtcatacattcagatgactgcagcctcagcaaacagcttgactacaatctcgtgtgtgtgtgtgtgtgtgtgtgtgtgtgtgtgtgtgtgtgtgtgtgtgagagagagagagagagagagagagagagactatgacccagagccacctagctaagccactctcaaatttcttactcaaagagactatgagaaaaaaaaaagaaatgtttattgttgttctagctgttgtatttttgagtaatttattacatagcaacaaacaaccaatacaactcctggtccatatttttctcagacctgctttacctgtttgaacccacactgaaccacatggtggttattttcaactaggtttttaagatgtaacctagactctcatcaacttgactgctctccatacctactttgttaatccctaatcttggtgaatcccatgatctaattttctggcttctacatatgggctgccataatttgttagagaaaaatcaaaacatatactaataattttactataaatccaagctatcttcagctgaccctcaaaatactcactatttttgtgtttctagttcactaacatcatatttccttcagtagctgccctcaattacacagctgccacactttccttctcagaagagtatctggctggcctttgacttcaaaatgaggacatcattaaatttttcttgatttttttcttctccattgcataatgtttatatttcaaccttacctctcctcttttccctgtgtttggagtagaaagtgttatccactttctatattaattcagtgccctcataccatctaaaaatatgctatgtactggttttcagtttctccccttctaagatattccttttctgagactattatctgctccagattctgctacctaaaaagaatttattctttaactccactaacatcccagaatcacctcttctttcatggacaccatacttctcaaaagccacgttcacccactctgtaatcttcactccttcactcaattccttgaaatctagattttaccacaaacactccatgaaaacttccaatactctcccttttatgtacggatgaaacgtttctccctctatgagagtgaactattgtggcagagactgctgttttttatctgctaaccactccttattttctttaataataaaaatttcacttagccagagacacatttccttgtctcccttataacctgataaggccatgtgctcaagttatggctaatgagatataaacagaagtaatgtgttccacttccagttgctcatctcaaaaggaatgggcatagttcctttccttcttcttactggctatgaagtagacccaccttgaacccagagatgggagtcacatgttatagctggaagattcattctcagcttcagactcctgctctctgtactattacatgagagaaaaacgagaagatataaatgatactgcaggttgggcatacctaatccaaaaattcaaaatacgaaatgctccaaagtctgaaatttttttgatcaccaacatgatgctaaaaggaaatgcttattgaagaatttcagatttcagatttttgaattagggatgctcaaccgtaagtatagtgcaaatattccaaaatgtaaaggaaatccaaaacctgaaatacttctggtcccaagcatttcaggtaagggatactcaactggtacatataacatatcaaaagtgtataattcttaagtatgtgaatgagaaatagtaagactccaaaatacagttgcttaaacatccgaaagaatagcttagcctgaaccataactaatatactcagtgtacggtcagggtcctagcaggaaacagaagacataatcagatgaaaatctgaagataatttaataaaggttctattcacaaaaagcatcaagggaaccaacaaactattttgagaaacctgcaggcttgtaacaacaagagggcatataacccataagcctgtaagagtaagggggggaattagtattactgaagctcgttgagtgctaaagctatagaagggaggctgtctggctgtagctgtagctttaactattgctgtagagggcctacagccctgaagcaggcaggaagcgggagcaagaaaaaatgtgaccccgttctcctcctgcagtcctgtctcctgtttttcatagtgatcagccctacaaggcataagggggacagaagggagttgtgggtaatgacctggggggtaatgctggaggataatcagaacacctattaataaattaaaagtgtattattacatcaggattggctacttttgaccacgctgaagcatatttttaaccatccaattcctcttgaaacagtctctctacttactttttttttgttttgagatggagtctcactatgtcacctaggctggaatgcagtggcatgatgtcggctcactgcaaactccgcctcccgagttcaagtggattctcctgcctcagcctcccgagtagctgggattacaggtgcgcaccaccacacctgtattttttttttttttgaatttttagtagagacgggatttcaccatgttggcctcaatctcctgacctcgtgatccgctttggcctcacaaagtgctgggattacaggtgtgagccaccaagcccagcctctacttactacttaacactaatgcactcttctatcactgctcctgataccattttataggttcctctttctcttcttgttttctgaaagaaaactatttcccagggctctgtttttggatttttgggctctatgtggtattgcagggtgaagtcataaaccctctatcttcgaccatcactcactatagataagcaccaaatctccatctctaacactgatctctcccctggagctagatcaaaggttgcatatttaagtatctatggaatccagataggtaaaaataattaattaggcaaacaatataacacattagagagagagaagggctgcagaaatctagaaagatatgcctacctatatctacaggggtggctattgctgagttccagttgattttactatgaagtaatgcaacccccacactgtgtctaacttttaaagaaaggctagaaatacagatttggaagaaggaaaggtgtccttattttactttttttttatggcaactccttttattaaaatattaggtagtttatctcagaaataaaattgaaatccctataactaaaaacactcagcagtgatgaataaaacaaaaatgtttttaggtcggcacaaaattgtggttttcgcctaaataaaataaaaccttttgattttgaaataagtttagacttccagaagaaatacaaaaatagtaaaagagttcaagtatatacccttcactcagcttcccctaatgttagcaacttatataatcaaagaaatattagcaaaaccagaaaatatgtactaaaccatggttgtaatgtgtaaccagcttttctccaatatcctttttctatcggaggacccaacccagaatcccacactgcatttagttgttgtgtctatcaattacaaaggaaaaaaaataacaaataagtttttaaatgaacactgtgttagaaagaaaacagcaaaagaaatccccaggagctataaacaaacaaacaattgtactacagagtggtaaagataaccccgggtgtttttgttttgttttgttttttcttttcttagtcaaagtcagctaggagtttgtttttaatgcccatatggaaaaagtagatgagaccttggctcctcttttaggttggtggaagtgaaatttccctatatataaacctgggaccctcaaagaaaccatgcccacagggaaaaggtcggggtgggagtgaggggaatctacctaccagtcaggacttaagaaaaagaggctgggtgtggtgactcatgcctgtaatcctactactttggaggccaaggtcggggataacctgagtccaggagttcaagaccagcctgagcaacatggcaagatcccatctccataaaaataatggaaaaaaaaaaaaaaaagaagctcttagtcttgacttgggcttaggataggaaaacttcccctaggaattcatatccacaggtctgtcccttatatagatttaggatttaaaagtataagcaagtagtctaaaatctacacagaaactggacctaggctttcaaacatggaagaggcaaaagcaaaaacactctggagaagcaactgtattcgtttatgcaatgctttgcacatgaaaacctggatctgtgattaagcatttaaggtaacactcataaaactatatcatttgcagtaaacatgtctaccaagtaaattaaaggacccttatactatgcagcagctaaagcaaagtaggatttgattaaaagtccttagaaatggaggactgttttaattctagaagtgggggaggagaaactcataccctttaactgactactacaagtctttctaagaactccagctttccataagacatgtacccacttaggagatcataggtcaggttttataatatactttataattaatataaaaaattaaccatgattataaatcaatgcctcatttataggagcctggagtctatcatacttgttttaaatgttttttataccaatttatttatttatttgttttgttttgtttttcttgccaacatggtgaaatcccatctctactaaaaatacaaaaaattagccaggcatggtggtaggcacctgtaatcccagctacttgggaggctgaggacctgggaaggggaggttgcagtgagcggagatcatgccactgcactccagcctgggggacagagtgagactctgtctcaaaaaaaaaaaaaaaatgccttgtccttgttggtacccatacccataccaggtaaacctatatttggtcacttgataatcacctgactttgcatgccttcttaaatgtcccatatcttgtcattctgaatagcattcaaaattatgttcatcagacgtaaatagatattttactaattagcatgatcccttacttcttatgtataagtgattgacagataatagctgactacctgccaatttggtttttgtactccattgagtataatacccctcctcaaggtaggaaatgttaagaattttttttctcatttactgctgtctgctgaactagacagctatctctaaaaggtacacaataataactgctgcttttcataaactgtttatagtcattcacagcctctatttcttctgtacgcaagtaaatcatgtttccagatgaaaatgaaaaatacttttattaatggcttttattatttttaaagtgctataatttcaaagatgttaattgtgtaaggatgtaaataaatgtaaactctccaggtcaattttcttaaaaggaagtccagatactaaaaacaacttcaggatgtaaaatgctgggaaacagcacgagcaactcatatgcatcagagacggaatcacattgtaagtaaaggtgttaggctgctctgtggacaggtaaagaagagccaaaacagctctggtaaacagaactcatagctaccatccaaaggtaagttaaacatacaggtaatgtagagaaagcctgccataaccacatgatgaaagcaagagcacaaacaaatgtcttcaaatcgaatgacaataatgttatgactatgactagtatgtaccttagcaatcactcagggaacagaaaaaaaatgatagattcagaatataaattcactaaaatgatttcttagctattttatactattatttatgtaataataatttgttatatattcttactattgtattaatttacccattaataaaagacactaacaataagccactacattaaaatagcagatcaggccaggcatggtggctcatgccgcctgtaataccagcactttgggaggccaaggcaggtggatcacctgaggtcaggagatcgagaccagcctggccaacatggtgaaaccctgcctctactaaaaatacaaaaattagctaggtgtggtggcgggcacctgtaatctcagctacttgggaggctgaggccagagaatcgtttgaacccgggaggcagaggttgtagtgagccgagatcacgccatcgcactccagcctgggcaacaagagggaaactctagctcaaaaaaaaaaaaaaaaaaaaaaagcagatcagaattcatcattaaattcctatatacaaaaattccataattagaaatatcaccagcagatacaaatttaaatatcaagtttgtattagaaaaaaaagaatgctggttggttaaaatggatagaagacagcaataatgagtcaggttataggttcaatcccatagagcccagctgggttcacattgagaaaagtacatttcatggtcaaagacaggtccctgatctcagcaaagggtcacacatctatgctattagttgaaaagggaattatactggagatggttcaaaaaacaaaaaactatcatcattacaggaaataactcatagcatacatcctgatgacaaatgaatagtgctattttctttgtgaataacatcttctgctgcactattactaactctaggaagatatgctggacttcttggctttgttttaacactatccacatatcatgaaatattatattgccgaggcagtatttatgaagccaaatagaaagcaaaccatgaactccatacataggaaaacaacaacaaagaattaatggctgggtgcaatggctcatgcctgtaatcccagcactttgggacaacgaggtgagaggatcacctgaggtcaggagttcaagaccagcctgaccaacatggagaaaccccatttctactactaaaaaaaaaaaaaaaaaaaaaaaaaattagccaggtatggtggcacacacttgtaatcccacctactcgggaggctgaggcaggagaatcacttgaacccaggaggcagaggttgcagtgagccgagatcacgccattgcactccagcctgggcaacaagagtgaaactctgtctcaaaaaaacaaaacaaaacaaaataaaaacaaaaaacaattaatgatcacaactctactcctcaatggcgcagggtcaacaccagcattagaacaacagggatcactcaactgtattctgaataatatttacaaagcacctgtgaactaattcttagcagttaagaatttttctttccccactatcattttcctcttgaaataaagcaaatttaaaatatgccaactaaggcaagagatttgaaccccacctacatcaggatcacctagggagttattccagggcttattccagaaaccaccagaaccaattttaataagtatggtgtagggccctgggatctgcattttaaacaaacactggaacactaaaagtttgagatgagaattactgactaaaaaaaaaaaaattgcagtttatgtagaatgcacacattagcaatataaaaggaaaagaagatgtctacttattattttctcttgtttatttttctaaattaagtatattttgttttaggccaggtgcagtggctcacacctgtaatcccagcactttaggaggctgaggagggtggattacctgagatcaggagttcaagaccagcctgaccaacatggtgaaaccccgtctctactaaaaatacaaaaaaaaaaattagccaggtgaggtggcgggtgcctgtaatctcaactacttgggaggctgaggcaggagaatcacttgaactggggaggcgggggttgcagtgagccaagattgcaccattgcattccagcctgggcaacaagagcgaaactccatctcaaaaaaaaaaaaaaaaaaaaaaaaaagtatattttgtttttaacttagaactatttaatattccttaggaaatagttcaacaagccgaatttaagtggtctctccataaaggcacttacatgatttacacttcaaaactactgaattttttaaaaccacttaaattccttcatacaatttttgaattaaaatgacaagtgtggcttctttttcaacatttaaatataactcacataccacagaattcatcctttaaagtgtacaattctgtggttttcagtattatcacaaagctgtgcaaacatcaccattaaattcagagccctttcatcacaccaaaaagaaactccgtacctatatggcactcactcccatttccctcaccctcacaccctgacaaccactaatctactctgtatttctatggatttgtctattctggatattttgtataagtggaatcatacaatatgtggcttttatgtctggattatttaacttagcatcatgttttcatggttcatgctgtagcatgtctcactatttcacttctgtttatggctgaataatcttcagcatatggatacaccatattgtgttaatccattattaattatttggtaggcatttgggttgtttctactttttggctactatgactaatgctgctataaacattaatgaatatgtttttgtatggatatgtttccaattatcttggatatacatataaccaagagtggaattgctgggtcacacggtaactcaatgtaaagaatgtgcaccattttacattcccaagagtaatgcctgagggttacagtttttacatatcttaaccaatacttgttattgtctgtctttttgctagtggttgtgaagtggtatctcacgtgaggtggtgtgatttgcatttctccatgactactaatgttaacatattttcacgtgccttttggccattcagatatcttcttgggaggaatgtctattcaaatcctttgcccagtttttcattagactatttatcttcttattcttgagttgtaagagtcccttatataatctgcatagtagactcttaccaaatatatgatttgcaaatattttctcccattctatggattgtcttttcactttccaagtccagtttatttatttttgtttttgaggctttggtactgtatataggaagccattgcctaatcagtgtgattcactacttttattttttacaaaatgaatattttagtaaaaattggctctagcctatcattagcaggagagtagccttgcagtcttgttttgtgtcaatagagatttgctagaaaactgaaactgagtaagaaaccattctggggctgggcacggtggctcatgcctgtaatcttagcactttgggaggttaaggtgggtggatcacttgaggctgtgagttcaagaccagcctagccaacacggtgaaaccccatcctactaaaaatacaaaaattagctgggcatggtggcacatgcctgtagtcgcagctactcaggaggccgaggcaagagaatcgcttgagcctgggaggcagaggctgcagtgagctgagactgtgccactgcactccagcctgggtgacagagtgagactctgtttcaaaaaaaaaaaaaaagaagaccaggctctgaaaagttagtttgcaaatattcacaggctttttgtgctttttcaaggcaaactaaaccaatagtttctaaggtagttatttaactaaatttaaattaacatagatcttcaaaagccaaaagtagtgaagaacttaaactggattgtaaaaaaacatagaaataaaaatgaaaaacatggtctaaactactgacaaaatattttttcaaatttctaacactcataaggacaaacaaccttctgaggacaataacaaatatagaaataaattgcaaaatttttgtgggctgctaaagtggtggtaaacaagtactgaaatatgccaagattatttgtttataacatttactacttcagctttcatcaggtttatgaatatttatttgttttaaaatatatccccaaaaagatacttaatagcccatttcagaactagcacatcttatggatgattaacattagcaaggaagagtactgcctacagaaatctgatagtagtgctcaaagtagtactaagtacactgttctttaaaaatatgcttattaacgtcaccaaaggaaaggttgcttaaaatataattatcagtttttagtcaatcttttcttttcttttttgagacagtctcgctttgtcacccaggctggagtgcagtggcgcaatcatggctcactgcagcctcaacttcccagggtcaagtgatcctcccacttcagcctcccaagtagctgggactacaggtgtgtagaaccaccatgtctggctaattttttattttaatttctgtagagatgaggtctcactatgttgcccaggctggtcttgaacttctggactcaagtgatcctcctccttggcctcccaaagtgctggggttacaggggtaaaccactgcacccccaattttgtatagataacttaaaaacaaacacactttttttgagaacataaagtgttttagatagtattggaagtctgccacgcaggtatcatatcgctcttgtgtgacaggtgtatttcagggaaatgtatatgaataagatgtatataaaagaccaagagcatcactgttgtgtccccagtgcttgtagtactgaacaagcttaacaaaatgcaagtagcaactgctaacttcctgagggcagaaatttaaaaaaagccttacgttagaacaagacactctcaaaaagaatgtctaaatgctaaaattgctaatacccatccatctgcctccaggtggtgaaaaaggggagtgtgtatagcattacagtctggcaggggtaatatatgtagctttaaaagcatattcaaattattataatattctattgtttattggctccttaatacaaacattaaggaacagtttttttatttttattttttatttatttatttatttattttgagacagagttttgttcttgttgcccaggctggagtgcaatgtgcgatctcagctcaccgcaacctccatctcccgggttcaagcgattctcctgcctcagtcttccgagtagctgggattacaggcatgcaccaccatgcccggcaaattttgtatttttagtagagatggggttcctccgtgttggttggactggtcttgaactcccgacctcaggtgatccgcccacctcagcttcccaaagtgctgggattacaggcctgagtcactgagcccggcccagtgtgtattttttacatctatataaaaggttgtgaaactgataaataaagccttcttttctaaagagatttaaattcaggacatttaagaatgtgaaaagcagatcctcttctttcctgatcctcctttcttatgctctgcaaaggagtaagagtggctgactcctagttaaggttatgaaacagcatctaacttcttatgggctaatgcttcctttaaacttagacccagcattaaacctcacaaactaaataaaaataccttcagggaattacgatgagaagggcattttgtatctttaaaatacagacctaattgtggaggtagagtaaaacaatatatattttggttaaataaggctagagaaaaagaattcacaatttgttggatttataaaatacaaactttaatttcttttttttttttcagaggaaagaattaagattagggaaatgagaggaggaaggagataagggctttaaatgattctgatctataattatcagtatgaatttttcatgtttttcttttgcagacatttggaattgtcctgtagattttgttggcagttaatgatcgaggcctgcagagcactgttactgttcttgatcccccaattcataggtataatctttatgtcctaaactattggtcataaatattagttagctaagaatgcctaaaagttgtttacaaaccattacttgaaaaatgaacagccaacatttatagcatattcagagaaagttagtttgaaaaataactcaaactgtgtattcgaatcattgtatgtaaaaaaataaataaataaaaataaaagtagcttttcttttccttgtaaaacattagctagaaaaagattttacttttttcccacatcacagatcatcttgaatgagcaggcctgcataaaaacgatcttcacaactctttatgtaaaagcacaaaaaaaacaaaaacacaaacctatacacttttaatacaaaaaatctgcattatagccataaaggggcgaatagaccagtcataaaaaataaactcgttttttagttgatccaatcttgagcaaatgtttaattttaaaatttactattgttttattttctattacaagtatctgcctaattctggggcatctgctatactaaaagcagaaaaaaatcatttgggagattaaagagagtaagagaaaaataaaaggagagtcaaggaaatggatgggtaggaaaaagaaaaaagaaagatgaacagacagaggaagaagggaagagggggcaaattggcttagtcaagctctcttgggacagtgtgctgagttaccagaccagaaatgaggggttgaaagctactactgataactggtgcaggctgaaagtgctacttaagtgcctggtgtctgtggaaaaaagagggaggagaggtttaagactaaggatgccaagtacatttccagccagcagagtaaaaaggaagcattaacagtagcctcaggggaagctaagcatgctatcccatgagccagagggcaaatgtggcaatagcagtaagtagcagctggataaagggataaagaaataaagaaaccacaggaaaattggcagctttagacccataaggctgactcggcctcgtctagatacttagaggaacaaacagcctggaaaaaacactgccatctttctactgccgatgggttactaatcaacaactgaggtgcaatcaactaaaatttacttggcaaaaattatattaagcatggatttaactttgtggaacagaagctctgctcagaagatacatgtaagatattctcagtatttggcatcataataatcaaaatcagcattctccataactctccaaatgatactccgaaatgtttaaaatgaaaaaaaaaattaaatacctttttctaatgcagtatttcattaatgttttctaaatattatttcatacctcatagtttaacaaatttaaaaaggatacacataaatatgctctatagtatatattagtgaccctttgagtattaagcccagcctccattagctattcttcctgatgttttccttcctcccaccccccaccctccaagaggccccagtgtgtgttgttcccctccccctgtccatgtgttctcatcattcagcttccacttctaggtgagagcacgtgctatttggttttctcttcctgcattagtttgctgaggataatggcctccagctccacccatgtccctgcaaaagacatgatctcattcttttttatggctgcatactattccatggagtatatgtaccacattttctttatccagtctatcagtgatgggcatttaggttgattccatgcctttgctattgtgaacagtgctgcaatgaacatccatgcagacgtatatttataatagtataacatattcctttgggtatatacccagtaatgggattgctgggtcaaatggtgtgtctgcctctaggtctttgaggaataaccatactgtcttcaacaatggttgaactaatttatactcctaccaacagtgtaagagcattcctttttctacacaacctcgccagcatctgttgctttttgactttttaataatagccattctgactggtgtgagatggtatctcattgtgggtttgatttgcatttctctaatgatcagtgatgttgagctttttttcacaagctttttggccacatgtatgtcttcttttgagaagtgtcttttcaagtcctttgcccactttttaattttttttttgtaaatttgtttaagttccttgtagatgctaaatattagacctttgtcagatggatagattgcaaaaattttcccccattccataggttgtctgttcactctgtggatagtttcttttgctgtcaaattattttcattcatattcttccattaaaaaaaggttcaaagttatgtcataaggcaatctatattacctttatatggttttagaatggaaggtaaataccacaatgagagttcttgttttaaataagtatgtgctgtaatattttagtataatatccgaaaataagatttaccaagcacaacatttttcaaatgactaggcttgatatatttgataaactgcaatttgtaattgattaaataaaccctgttggcctaagagttgctcaattctctcttttcttcatcagggttattaaggtattataagattgatgttatgaaaaaagatcctactcctaaaagaatttcaaacatttaaggaaatcaaactgaaaagtaagaaatgccaattaagttgtgcaatgtatataacaaattctataagaattcaaggggtgaggagggggtggagtcagggaaaaaagttcctaagggatgtaaaatttaagatggctcctaaaccatgcataacatttgagcaaaaattatttggaaggaaaagatataaaaagagtaagttaagaagcagatacttcaataaagcaactgtaattactaaagttacctttggaaaattaagatttgacagctattacaggtagagtatagaagggatagaaggtaaagagagtgatgatacatagaaagtcatgatactaaagtagaataaaagactcggggtgttttagtctgctctggctgccataataaaatacctcagattgtgtggcttaaacatgagaaatctagttctgaaggctgaattaatttagaatttctgaaagctgaaaagtccaagatcaaggttcccataagatttggtttatgatgagcactctcctcctactgtgccctcacatgatagagagagagtgatctctggtaacccttcctctttcataaagacaccagttctactggaacagggctccgcccttacgacctcatttaaccttaatcacttccttaaagaatctatctccaatacaatcacaggggtgtaattagggctccaacataattttcgggggacacaattcaggccatagcattctgcctctaacctcctaaaattcatgcctttatcacacgcaaaatgcattaattccatcccaaatgcctccaaagttttaacccattccaaggtcaactctaaagtctacagttcaaagtctcatctaaatatcatctaactcagacatgggtgaaacttgaggtacgaatcatctttaggcaaaattccttcccagttgtgaacctctgaagtcagacagattatttgtttccaaaatacagtggtggggcagatataggatagacattctcattctaaatagaagaagtaggaaattgtgatataattttttaaaagcctgttgggagcattaagtgagattacatacaataaagtgcttaaactagttcatgaatatcagcagagtagaagtataaactccaagaaggcagggactttatcatcaaccactgtatctcaagagttgcacagtcaatagggtagtcactagccaaatgaagctatttaaatttaaatttaagttaattaaaactaaaaattcagttcctcagtaatattactcacacttcaagtgctcaatagccacatgtggctagtgggtacaataatggaccatgcaggtttccatcaccacagaaatattagtagacaagtctgttctagagcctagaaaagtatgtgacactataattattgaatgaagaaatataaaaactattagcattcatggttcaagaagaataacaagaaaacatcaagaagaatgagtatcttcaattttggatctttgtaaaagatccaaaagaatcacaacacaagattatcttattaacttttataaaggcagtaaatttagggctaggaaaatgccaattaagaaatatttctgtagccaggtgtggtgacacgtgcctgtagtcccagctcaggaggctgaggtgggaggattgcttgagcccaggaggttggggatgcagtgagccatggttgtaccactgcactccagcctgaacaacagagtgagactcagtctctaaataaataaataaataaataaataaatactccataggagattaggttaatattgttcagagttttgctttgttatgacctgaatcaagagaggaatcaagagaggaatcaggaggctgaggtgggcagattgcttgaggccaggagttcgaggccagcctggccaacacatggcgaaaccccatctctactaaaaatacaaaaattagccaggcgtggtggcacatgcttgtaatcccaactttttgggaggctgaggctgcagtgagccaggatcacgccactgcactccagcctgggtgacagagcaagactctgtctcaaaaaaaaaaaaaaaaaaaaagaaaggaatcaaaactccagagactaaccatgaacatgtctaatagtctcactcttaggcaccagcagtcttactaaatttgttagtggcaggatcaataatgaatggattcaccaacaaattcctatggtacataatgtcagtgttgtcggcaacaaatgtgagacaatccattgtgaatacagagatctggacttccatttttgtctgggtatttttttttttttttttttttttgccagtggatgagaaggaacggagtatctgcaactaacatcaatatttattcagaaaagtgcttcttatctttttaagcacttggaaacacaccaagttctgttccattacatggcattctaatgggtaattcttcatgatgtaatactttagcttacatcattagtgtaagatcaatttatttggttatcacaccgattaaataaaggaagtttccttctccagcagttgaaatgtttctgcaactcttatataaaaaagagttacaggtctttggcctaagctgtctatcttcttgaaaagtacagaaccagagaatacacttttccagcctaagccatccattttcttgataaatccaaaccacagaatgtgctttccctggacttaacactttggctatcttttctgagaatggaaaatttttcttactaaaacatctgcctcactccccacatcacattctctgccatctgacctgcctttgctatgctctgataactgccagaagtctacagcaatctcattttaagagtgaccctaccactaactgtgaataaagttttctcacctggtttttgccagtcttactctagaacctttccttcccttgacacatatttcttattccataggtagtgggatataaaataggcaaaaatttcttcctcaaggaatttttacccaaaatttcccaaaatttacccaaaaattcctcaaggaaggaattcttcctcaaattcattctcttagtttatcctctctttccattgctgagtaatcatttcttctaccccctaatacctttattcttcttgagtgataccaggagaggaaagcaaaggatgacacagaaaattctgataaaagaaggtgacagcaataaggctaaataaactgttcagctagaacctctcaagctgaaatcagaaattttctcctgatgtattgtataatatcagtgtcctcatttgttattacagcattagctactaattgtctcccattgtctatttacctccttcttccttttagcaatagacccatcctcccttgcagttttaggaagcccagcttgataccgcacttcccaaactcccatatggctaggagtcaccaggtgatgacattttagaaagcagaatgtgagcaaaaatgatgtgcccaacttcctagtcacattcttttaaaaagcaactgtgtgtcctctacttactgttgcctctttccaaagggctaaaatgtggatatacggggtgactgcaaaagaacagcaaaccctgaatgatgatgaaaccagacagaaggaacccgggtcctttgatgacatcatggattcaatttgctctaattccttggattgcctaccagttcagacttttacttcaggaagaaactttccatgtccatttaaccactactttttggtctgtatgaaagatgtaaaccttaaaactggcttttatataaaaagatttattttgggagaaacagagtatgtgggcatagtctaaaaaaggcaatatgatcagatggaagccctaaaagatcaattacactcaaacatgagaagcatttcttagggtgagacagaaagatgactggagaacatatttgattcaacaaactgttactagattcctacttaggccagacactatgtcatatacgtgacaggaactaggtaagtaaattgtgtgtgtgtgtgtagttcccaacttcactgaattttctgtacagtgagagattaaattctagggaattagctaagatataattggtcaataattactgttcaagtgataccatgtgccaggtaatgtgctaggtgctggaaaagatggtctctcttctaccttctaaatatttttcttcctcttgagtgccacttctttggtttaggctctcagaatttatttcagctcacacccttctaactggtttcctttccttcagtttcttctccctccaacccactgtcatctgagtaacataaaaatcctaaaataagaatctgattgatactctgttactctttaaaaaaaaaaaaaaaaaaaaaaaaaactttacaaaatttttcttactgaaacatctgcctttctattgccaataggttaaatttcaaaatgtcctttctagtcttattcttcatcactttattattcaccccagctacacggaactgttcatcatttacccaacataccttcatttgctctcttcttcctttctcagttcttcatctttgagtcagtttggactgcgataacaaatatcataaactgggtaacaaacaacaggaattttatttcctcacagttcttagagtctgagataaaggtaccaacatggccagtttctagtaagagcccttttactggattgtagacagtgccttctcactagttcctctcacataggggatttgggagtccagggggaaagagagagcagagtgagtagggtgtctgcatatttgctgtttcttcttataagagcactaattccatcatgacggctccaataccctcacaatgtcatctaaacctaattatctttatttcttaaaggccccatctccaaatatcctcacattgttggtagggcttcaacatataaattttgggagattgctaggtagtttattctctttgtgagcgaatggagttcactcatgatttggctctctgcttgtctactgttggtgtataggaatgcttgtgatttttgcacatcaattttatatcctgagaatttgctgaagttgcttatcagcttaaggagttttggggctgagaatatggggttttctaaatatacaattatgtcatctgcaaacagagacaattgggatttgaacaatgagaacacatggacacagggggaggggaacatcacataccagggcctatcgaggggtggggggcaagaggagggagagcattaggacaaatacctaatgcatgcagggcttaaaacctagatgacgggttaaaaggtgcagcgaaccaccatggcacatgtatacctatgtaacaaacctgcatgttccgtacatgtatcccagaacttaaagttaaaaaaaaaaggggggagaatatgattccatccatagcagatggcaaactaatccttcaatacccagctcaactgtctcttaagtatcctcattctctgaatgaaatttagttgctctgctatctatgctctgattaacgacattctggattaattatttccattattagatggtaaatacctacagggtagagattatatatattcatctttgtattttctcagaattaagtaggatgtttggcaaacattagccccaatacatatttgctgaatgaaacactggactttcagaagcaatgaaagatatgtgctaaaatctttttttttttttaatgcttttctctacttgcaggtcaggcattataataaactctttctcccccccacctctacaattctagactctgcattcataatttctttcattctttccctccttctcctcacctcttccctccctttccctccctccctccctccttttattagagacagggtctccctctgttgccatgctatagtgcagtggtatgatcctagcacactgtaacctcaaactcctgggctcaagtgatcctcccacctcagcctccctagtagctgggactaaaggtgtgcatcactacacttggctaattgtttaaactttttgtagagatggggtcttgggatgtttcccaggcaggtcttgaactcctggcctgaagtcatcctcccaccttggcctcccaaagtgttgggattatgggcatgagccactgcccttggtccatagtttgtttctttatagcatcattgatctcaagttgtctataaccactaatttctatggagttgaaatgcagattctatcaaccaatgctagattattaatgttgactttataattgcagacacttttacataaagagtaggtcaacatgttttcacaagagtaataagtaacttcagatgcccttgtaagaaatgcagcaataggactcacctattacttttctctactgaatgcatttccacatcaacagtgttaccaatcattattttatgttaccacagcagagaagatttaatcttcttttacataacaatttctttgccttagaggccttgtgatcattcaatattattcctattctaaatctgtcatgtttaaaacctactgcctgtattaaatatctattatctatttacagccaagagaggttaagtaacacagctgtggtcaaaagttagctaatactgaagctctgggattaatctccaaatattctgagtatgaatgcatattcattcagacatgaccatgcatatgtcataaaattttataaaattacagaggcagttgatatgaaaagtgtaaaatatgtgatcaaattaattagatatgttaattatggtacttaagttagagttgtaggtctatcaataaatattcactgaaagtttactaagtttaagtcactatttacaagtaacggaggagggggcacaggaggataaagctaataggtagaaagtataataaatggcagagtaaagggttaaaagagaagtacaaagtacaactgtgatgtcatagaaagaaagaaaacctggcaggcatggctattgtctttacatatcaggactaaagtgagatttaatttgctttgtttaagccttagagctagaatgaggaccaatgggtagaatttacatggcacaggcttcacttggtataagagttatttgaaaatagaatgttgaaaacagaatatttttgtgataatatactataagcttaatctacatgtagtagaggtgtcatggtgagatggtggggagcaggtggtctgtagggaacaatcccacccaagaccagtgagtacctgaataaacactattatatgcttgtagtcatggcttaaatgcaggagcataacacaattgtactgcccatttgcaagatatatttatcagcagtgtatcaaatgtataaaaaagtgatagggagactagaaggacgttattaccatagttcatataagagataagaaaggctactgtggtaaaaatgagccagcagagttaggaaaagatgttctaattacttcaatcaattatatgctaatattatctattactaaagaagataaaaatgggattaagtgtacataatagaattatcatctatcctattatttaccttaatatatttaaattccatattaatatatttactgtaacatgtctaaaactgaatttatcttcctcaaagaacttatcttttcctctttctgtaatgcctatttcaattgttagtatgacaattcatgcagtaactttagttaaaaatctcaatattatcttcaacttcttccccttatgttctttatgactctgatatgtctctagaatctagaatgtcttctctgtcctctctgtcattgttttaactaaggtcatcatctcctgcttaatttcctttaactgttatggcctcctaattgattttcctgtctccattctttcctagcttgagtccgatactcacactgccatcttcctaatgaataaattaaatataattatatcattcccatgtctttttagcagttcctggctgtctgtaagagaaagtaccaactcctcagcaaggtataaatgcctcttcataaatgtgacctcaacttaacctcccaagcctcatccctggctattctttcccaagaaacctatgcaatggccatacaaaaaattccattatcttaatcttttcctatactataagcttattcatttcatatggcacttgtcaaatatcagtgtctgggaaaggtttgagtgaacatttttaatcaattgctatttagtaaataaaccaacaatctttcagtacaatctacagtattctactggtaattgattctctagaattgaaaaaaaaatttccctcagcatctttcccccgtagactattatgatgattaattttgtgtcaacttgagtgggctgcgggatgcccagatagctggtaagacattatttctgagaatgtctgtgagggtgtttccagaaaaggttagcatctgaatcagcacactaaacaaagaagatccactctcactaacatgggcaggtatcatccaatccaatgagtaccagaacagaataaaaaagcagaaggatgaattccctccacccactccttgagttgagacacccatcttctcttgcccttaggcattagagctcctggtctgtgagtcttcagactcagggacttacaccagtgccctactcctgggaatttaggcctttggcatcagactgggagttacaccattggttcccctggttcttaagacttcacacttgggctgaattgtaccaccagcctctgggtctctagcttgaatatggcatactgtggtgcttctcagcccccataatcacacatgccaattcccataataaatctcatctcacacacacacacacacacacacacacacgtactcccagaaataatgtttatcacttatcctggcatccctcaacccactcaagctggcatataaaattaaccataatagtagtctacagggaaaagctattgagggaaaattcttttcaatcactctagagaatcaactagtagtagaatacgaatgtattggtttatttactaattagagattgatgaaaaatgtttgctcacaagcctttcccaggtactgacacttgacaagtgccatatgaaatgaataaacttatagtctagaaaaaataggaaatgattaggacaatgaattttctatatggctgtggcataggtttcttttattatacaaacactcacacacataaacatatatagatgttattggctctgattctctgggaaatcttaatacaactacaaaactttatttgccacttgttcccactttcaaaacacaatttactatttatttccattattaaaaataataactaatcattaaaaacatttgaaaagcaacggaaagagaaaagcaaaaaaacactgacgctttaagacactggagtaggtgtatgtccttgtaatgtttttattacattgagatatcatacacataaacacatcttatatactacatttttatatcctaaatttttcttttctccgaattctaaaataaaataaattttcatattttttctgatgaaaagtgaaaaatgaaagtaattttcctctcattaagtgcatattttcatacaatgtacgatacaaaaaggtattcatttttttcttttttgaagacagggtcttgctctgttgcctggtctggagtgcagtgacacaatcagggtttgctgcagcctcagcctcccaggctcaagcatccttctgcctcaggctcccaagtagctgggactacaggcacatgacaccatgcccagctaatatttttactttttgtagagatggggtcttactatgttgtccaagctagcttcaaactcccaggctcaagcaatcctcctcccttggcctcccaaagcactgggattatagatatgtgccaccatgccaggcctaagaatgtattcttaaaataggtatggtctcatttgtacaactaaaacttattaaaacatatgcagtagtataattttatcataggaagtataatgtagagtataacaacacaggtttcttgcactggaatcccagttcaatatttatgattgctgtgacaagttacctaaactcacaagttacctaaactctctatgcctcaagtttctaatctacaggttgagagtaataatagcacttacctcataaacttattgtgagacctagatgagttaatccataaatggcttacaacaatgtctggtgcatattattaagtgttcaacgcacgacagctcttattatccttctaaaaatctaaagtttaatgaacaaaatcccattaaacaaagcgaaatataaattttgtctattgaaaatatgttgcacagtgagcattacaaaaataattacatatatattttagtatcttctctagcacagaaaaaaagtagaaagaagaaaataagggatcatgagatcctggcaagagtttttctccacagacattctgttggtggaatagaaatatgtgagatggtgaatggaacagatctaaataagcatgggactaacaaagtacaatgtatgaaagattttacttagaaaaaacaattacaaattgactatacaatcaataagactaaccgaagggaaatgcagtaaaacactttcaaagaaaaatactgtggagcccagaagaaaataagccaattgacagaggtagatttcacgagctcataaaaatgaaaaagtaaatgctgctggacaaaaagtggtccttacttttgctctcaatgtttctagtatgctatgtagaacaattattttgcttttactgaaaaataactattgcatttggtataaaacgattcataggaaaaattattttttacttctgaataattaatgtatttcttaagtaatagaggaaactattaattaagaggcattcatgaaggtggatatcttacacctaaacattttagacttgttttccaattttctttctttctttttttttttgagacaaggtcttgctctgtcacccaggctggagtgtagtagtgccatcacagctcactgcagcctctacttactgggctcaagtgatcatcccacatcagcctcccatgtagatggaactaccggcatgtgctaccacacctagataagtttttttgttttttgtagagacagagtcttgctgtgttgttcaggctggtctcaaactcctgggctcaagcaatcctctgctttagcctcccagagtgccgggatttacaggtgtgagccaccatgcccagcccttttcaatattgtttttgaaaattccatcctatactgccaaatataaatatatcccaagaaattaaaatacagaaaattaaattgcaaagaaaatatggttgcagaattcttgcaatttaattttagtaaattctttatcttttttattaacataccttaaaattgctatgcacatattttctgtctcagttatgtactcaactagaaattacctttacttaactacctgtattttattgaaatactgtgcccatcctgcatggactattttgcgtcacttattttatgaatatcactattggatatgctcttttgcaccaatagactcttattcaggtatgacacacagagacacaaaatgctaaattctcctttcctgtgaccatggcagaaactactaatcaatattcttgggcaaagttggttctcaagatgctcaagctctgctgttgtcataaagcattttggttctcttctgatactttttgaagactcatccatttttcattctttcagcaaacatgaccatgataccccatatagaccagatattgtgctacagttgcgaaaacaaagaataagagaggtcctcaagcggctcaacatctcatggtgaaaatgagatgctgagccaccactaacatgctagctgttaagtatgtccacttaaaagagaacacaggagaaacatctcaggcggactctgttggcgtggttggtggtgagggaatgttgaagagtggatagaggtataattaaaggctttctggatggcgtggtggcttatatgagtagtcccagcactttgggtgggattacagcacttgaggtcaagagctggagatgtgcctggccaatatggtgaaaccccgtctctactaaaaatacaaaaattagcagctgagtgtggtagtgtggcgcctgtaatgccagctacacgggaggctgaggcatgagaatcacttgaactcaggaggtggaagtttcagtgggcggagatcgcaccactgcactccagccagggtgatgaagtgagactctgtcaatcaaacaatcaatcaatcaatcaatcaaggcttcccaagggggaggaatctggcatttttgtaggcaaaggaaacagcttataagatgtgagagaacacagccattttagagaagtgtacattgttcagtgttactggactatagttttcaagagatgaagttggggaagtaagcaggtaaattgtgaagatcattccaagtcatgttgtaaagctgggaaagctataagtaaccactgaagaattttaagcagtatttgtgagagcctccaatttagggagtatccaatttataaatatcttcatatagtttaaaaagaaatagttattttatgtggtttcctatggcaccaactagaatgtttctgggatgatccagaaacatgtacaagtgatctgctgctgagatgcagattatatttcttcaaaaaaacctggatcaaaaattttgtcgttttacttttaaaacgaatttgagtcagaatccattatatattattctctggtgtagagcataatggaataactataatacagctcaataaaaatgaaaacaagaggatatcataaaaagacggtttcaaagaacattttgaggccaagtgcagtggctcatgcctgtaatcccagcactttgggaggacaaggagggaggatggcttgaagccaggagtttgagaccagcctgagcaaacattaggagacccccatcttcacaaaaaataaaattagctagatgtggtggcatgtgcctatagttctagctactcgagaagctcacttgactccaggagtttgagactgtagtaggctatgatcagccactgcactccagcctggtgacaatgagatgctgtcttaaaattaaaaaaataataaaaaaagaagttttctttcaaaaagacagaacaagtagttgagtgagtgttatgggttgagctgtgtcccctccaacacaactccatatgttggagtcttaaactccagtacctcaaaatgagattggagataggttatttacagaggtaaacaggttaaaatgaagtcatttggatgttccctaatccaatatgactggtgtctttatagaaaggggaaaatgtggacacagagacagatatgcacacagggagaacaccttgtgaagaccgaggttacactgctgcaattgaaggacctatcagaagctcggagagaggcctggaacagatccttctctatcgccttcagcgggagaatggccctgctgactccatgatctcagacttaaagcctccagtactgtcagacaataaacgtatgttgtttaagccatgcagtttgtgggacagtaattattcacttaacattgtcaacaggttcttggaaactgtgactttaagtaaaatgacacataaggaaagcaatttttttccgataacatcataactaaatgacattatctgagaacctattgtaattatttcacttaaagtcccagtttccaagaacttatccatgatgttaagtgaggacttactatactttgtaatggcagccctaggaaactaatacaagtagggttacaggagaagtaacttctaagaatttacatggcaactaaaagcagtaacttaccctagactggatcccatattgcagcgtaaaaattatataaatattacatgttatatatcactaacaaaagtgatatatatggagagtaaattagacgaaagtattacatcaacataagtttataaaatggataactgtgctgtagttacataagaaaatatccctattcttaggaggtacacactgaaatatttagaggtaaaagaccatgaagtatgtaacttaccttaaggaattcagtaaaaatattgtgtgtatatataattatgtgggtgtgtgagtatatatacatatactacagagagggtgaaaaaagaggagagagaggaggaagggagggagagagaaaactcacataaaaaagagggagggaaaaaggttaacaatagtgaacctgagaaaagtgtataagaattctgtgggcacggcggctcacgcctgtaatcccagcactttcagaggccgagacgggcaaatcataaggtcaggagatcgagatcatcctgactaacacggtgaaatgccatctctactaaaaaaaaaaaaaaaaaaattctgtgtgctatttttttctttgcaagtttttataagtttggaattatttggaaataaaatacaaaaaaagaacttattttagacgagatcaggcactttcagggtggtacagcagtagaccaaaaaaaaaaaagaacttattttaagaacaatgcctaagcatattgctacaaacattttatttttagtatggcataagtatatgaacaaaaaaagtgaaacgataaagtgaatgaataactgattaagaaagaaagaagcggggaagaaaagaaacaaaaactcaaaaattgatttaagctatagaaattctaagtgccacagaaaattttgagatataaatttctcaaaataaaaaccaggtactatagtcacggcatttaatacaataaaaataatacaaactaaatttgcctttgcttaaaaataagaatcagaatatctactttttctttagaaagtagcttaacatttatttagaataactgttagtggagagaaaaaatggcctatttttgtttatttatataatactcacacaactattcattgtttcctagcattgcaatactttgatatttatcctaaagtttctctatgttctaatgataattctaaaatatagaattatctatctctctctatatatataaatataaattctaaaatatagcattatcattaaaaatatagaaaggaatcaaccggaccacaaaaaactaagccgttctggataagcatgtggcaatcctcttcttcctttttctttttttttggaggtgggtgggaaggtcacagtggttaacataatcaaggaaatttgctagtatatacagaagtctttgctaagaaattttcgtttgagatacaccagttaccggcaaatcaaacagacataaataccacagtaagcagtcatttatcgggtaaccctgtgcagagttgcatgaaagcatccagaggcagaacaaaatccacagcagagccgctgcttttcagatagactgccactgcaggtgccatggcccagtgccagaaacacaggcaggggaggggttacaggcagctcctgcacagcaccactgggcagaagttgcctgtaatcagagcactactgaaagcaatggtggtggcaaggtgaacttggtgagcaagcattcctctgtgaattcaatttcttcttgtgaatttcatattgcgagcccattagcctcacttctcttctctagccattatcattagcccctcgcagaaacgatgactaccagctgtaactggcagcacactaccatgataatttacacaaagattaaaaatgaaaaattaaatactgggatttctagccatcttttaactttttttattataaaaagtatctctctctctttcttcttcttcttccccttctcctttcccttctccttccccttcttttttttaacttcaaacctatagtaactttggacaagcactaagttaccataaatgaggttttgtttatttctttttcctgaagtcagtgcaacaaggtatttcaaaaccttaaagaaagaaattatgaaattaagaaatagatgacaaaatatacacctggctgggcacggtggctcacacctgtaatcccagtactttgggaggctgaggagggcagatcatttgaggtcaggagtttaaggagtttgagaccagcctgaccaacatggtgaaacccggtctctactaaaaatacaaaaaattagccaggtgtggtggtgagtgcctgtagtcccagctacttgggaggctaaggtaggagaattgcttgaacctggaaggcagaggttgcagtgagctgagattgtgccactgtactccagcctgggcgacagagcgagattctgtctcaaaaaaaaacaccacccaaaccagaagtattttgaataaagtgtcaaatacttacaaggtgtaattactattgatatcatgagcagccactgtgccaaattcatgcaccatagaagattctgaactccaaagggcctggcatgggtctttgcaatttagttatggacatgactgaatctcacatgaagaaatgtttaataatcaataaagagaaataattgaaaaactgctctaaaatgaattagatcagccatctgcacaataccatctcaagtaataattgggaaagaatatataggggtgtttctgaaatgtttcaaagaagatgagagttctgagaagagtatttgtaagtttttagattattttgctttttgagagcatagtgataagaagggtaacgatgcacgctttagggtatcatttggctaaaaaaggagtagggtaggctcatactgcaatgataagaagaacatgtggcaggcactgtggtaagaaaagcatgaggagtaactcaagctagaagcctaactattacaggttcctgtgtcaggaagagggagaaatctggcatttccccccacactttcagctatatcactgaggctgaagtctatagggaagagtaactactattagacaatccttttcaattatatagatgagatacccacggggaagaattttccaaaatttaaaaatcattaatatattttaatgaaatactaacaatgtggtagaaaatcatagaagttacttaccccagaataaacacagaatttgaatatttttctaccatggatgtagcatatattagaaatagtatcattttattttatttggcttgtatctagcacaataacatgtcactaaacaaaatgcggtttactctcatttgtccagagttcagaatttaggtgttcagagaatctagaacacagtcaaactcaaagcaactgaaggccaagaggaaaacaagcaaaaagctcatgaactttaacggtgggaggcattgggtcattcctcaagcttttaacccagccatatatgcattaaataacataatcaatcacaacaagatggaaaccctaacagagaagtgacatctgacatagaagagaactttgaatgctgacagaaaagctaaaagaaagcaaaggaatgtgggtcattttaagtgaggaacaaaaagctctatgcatctcagaaacttcaaggcatcatggaaaatgtctggaatattcaattgttagtaatacagaaaaggctatttaagatttaatttcagaaagaattctccatttaagaggcaaagaaatgtgtaatccatttcataaagagatttctcttcaagggaaatggtgaaaaccactggtatttgaaagtgtaaaccccaattctataaaacttttactgtatgatgttttaattccattcctagatgatgctgagtacctgatgcactcttctgatgccattttgaaatgtttctattaaggtaaagtagtgaatacaattaatagatattttttctcctcttaacttctttaggagataaaagatcatataacacaacatttataacactgcatagtaggcttatatataaatgtaatatatatatataaataatagcacaaattaggggtaaggaatggagctgagttggagcaaagctgctatattttactggaattaagttggtaataacctgaagtaaattgtcataatttaaaatgcagactgggtgcagtcgctcatgcctatgagcccagcactttgagaagccaagataagaggattgcttgaggtcaggagttcaagaccagcttgggcaacatagtgagacctcatctctatgaaaaataaaaaacttagctgggtgtagtggcacacgtttgtactcccagctactcaggaggctgtggtgagaagatcgtttgagcccaggaggttgaggctgcagtgagccgtgattgtaccactacactctagcctgggtgacagagtgagattctgtctcaaaaaataaaatgtatattgtagtctctataaatacgactaagaaaagaactaaaacaaatacatagtaaaaaaaatttaatgaaaatagtagaccagaaatattatttaatacaacaaagatgataaaggaggaacagaaaaacaaaaagacccaagactaaagaaaataattaataaaatggtagacatgaatccaactattatagaactctctactagatgagatttctttacatgtgctgatctatttctggattatgctattggatgctatctggattgtgctattattatgctatcaataataacattaaatgtgaataaacacttcaaatggcagagattgtcagtctagataagtaacatgatccaactatatgctatctacaaaagacattttgaaagtgtccaaaatccaaaaaaatggattgaaaataaaataatggaaaaaggtataccatgcaaacagttaccataagagaactgacgtggctttaacagtatcaggcaaaacagactcaaaaattactaaaaacaaacagagacaatttatgactaaaaagttggttaatttatcaggaagacataacaattataaacatatatgcactgtgataggctgaaaaatgtacccctcacccccaggaagatatcaggtcctactccctggaatctgtaaaatgctacattacatgggaaaaggttctttgcaatgtcattaaattgaggaattttttttttggagacggaatctcactctgtagcccaggctggagtgcagtggcataattgcagctcactgcaacctccacctcccaggttcaagcgatcctcctgcctcagcctcccgagtagctggaactacaggcacacacctccatgcctggctaattttttgtatttttagtagagatggggttttgccatgttcgccaggctggtcttgacctcctgacctcaggtgatccgccctgccttagcctcccaaagtgctgggattacaggcatgagccatggtgcttggcctcagttgaggattttgagatgggaagattatcctgattatgagggaggaccctaaatgcaatcacatgtatctttagaaaatggagacagggacagatttggctatagacagaaaagaaggcaatgtgaagacacaggcagacatcctctggacgaagtgtgatactgatttcagatttctggactctagaactgtgaaagaataaatttctgctgtttaagccaccaagtgtttgcagtaatttgctatagcagctataggaaactaacatatacatttaataacagagcccaaatatacatgaagcaaaaactgatagaattgaaaacagcatttggagacttcaatatcccactagcaaaacaaaaacaaacaaaaacaaaaacaaaaaaaacaactagacagaaagtcagcaaagatacagaatagttaaacacaaaaaactaagtcaatcaactcacatccacagaacactcaacaatagcagaatatccattcttctaaagataacatgaagaattctcctatatagacccaatgctaggttgaaaacaagtctcaatacattttaagcaactgaaatcatacacagtatgctctccaatcacaatgaaattaaaaatagaaaatacaggagaaaatttggaaaatacacatttggaaaatacagaaggggattttggaaaatatttggaaaccaagcaatgcacttctaaacaatccataagccaagaaagaaaccacaagaatattaagagaattgcataagctgaatgaaaacaaggaaacaaaatatcaaaatttatgagatacagcaaaaaccacacataacgagaaaattgtaattggaaaacctgatattggaagagaagaactcaaataaaaaaactaggtttccaatttaataatctagttagagtaaactaaacccaaagcaagcaaaaggaaagaaagaatgaatattagagcgaaaactcaacgaaagagaacacagagacaccatagaggaaaccagtgaaacaaaaagttggctctttgaaaagacaacaaaattgacaaacccttttagcaagactgagccagaaaaaaagataacaccaattaccaaaaatcagtataaatgaggtaatatcattactaaccttagagaaattaaaatgataataagtcatactatgaacaactttataaaaataaattagttaaatggacaaattccaagaaagaaataaattactgacatagattcaagaaaaaatttaaaaaaaatcttgatagacctataaaaactaaaaaaactgatttggtaatttaaaatcttctcacaaagaaaaggccatgcctaaatagcgtcagtggtgaattccaccaaacatttaaagaagaaataatatgtagcattcacaaagtccttcaaaaatatagaggaagaaggaacactgccatgtctcattctatgagactagtattaccctgataataaagtcagatgaggatatcacaaaaaaactgcaaactaatattcctcataaatatagattcaaaaatcctcaaaagtagtaattcctcaagaaaatactaacaaaacaaaaatccaggacatatcaaaagaacttaaaacatataagtgtaatatatttgtgaatgcaaggctggtttaacaaccaaaaatcaatttatataatatatcatatttcacttttttgtttcttgcttgaaaatctttccctattccaatatcacatagaaattctcctgtattatcttgttaaagtttatagttttacctttatatataaagctttaatatactttcattttgtttgtggcataaaataaggttccaattaaaatttttttccccatatatctgctataggttgaattgtggccactccccccaaatttttatgttaaagtctcaacctaacagcacctcagaaggtggccttatatgaaaattgggtcattacagaagtctttatttaggataggccatactggagtagggtgagtccttaatctaatatgaatggtgtccttattaaaaggaaaaatttggacagacagacatgcatagagggaggatgatgtgaagagacacaaggagaagacagccacatataagccaatcagagggctagaacaggtccttcccgtacagcatttaggagaaatcaaccctgctaaactttgatttcagacctctggactccaaacctgtgagacaataaatttctgttgtttctacccagataatcatactttgttacagaagccctaggaaactaataaaataactatttatctcagaatcctaaattgaaaagtccttcctttccccacagttctgcaatactagctctataatggatgaggtttctttacatatcctggcctatttctgggttctctgttcacttttcctgtactacttctccttccctaattactatagctttataataatttttgatatctagtaaagcaagtccctctgaaatctgctcttgttccccaaaaggattttggccataatggtcctttgctctttaaaatcagtttatcatcttccaacaaaacaaagtaaacctactgaatggtttttatatttttacattgactttataaataaatgtggggagaattaacaatctatcaatatggcaaatcttttttcctcttatttaggtgtcctcgttttttaactaaaaatttcacagtaaattacatatcacggctaaaagcaaaccaaacaatagtaattttagactcttcatacctatctccctacattcccagggaatttaaatccaaccactgcactgggagtaaagaggatgaagacatgagagggagataccctcagctaacaataattatttccaactgcagccaccacggctgtttacattcttggccacatcattatcaatatgggaaatgaaaaggaaacaataacaacaaaaaaaacaatttgaaaaaagcttctggcatttcaattccaaaaatttttttttttaaatgttgtctggtcagtggtcttaagaatgtcatttccccactcttgttcagtggggggcatgacagtctgtctctatgctgtcatcacttgagaagtgtaaattttccattcagagaaaaaaattatacaagattgacctaattcattcagaggtgtaagatctataaaggtttatgttgaatagatttaaattttagcaatgatagaaacaagtttagattttatttctttatcaaccttgttttttcctgtcaggcaatactatgaaaggacagcatctcttttaacttgtccacatattctctgatgataatggaaagcagatagtatattcattttatttttctttaccttgttaagtgagtactatttgtgtcaccattatgaaatagtagaggagacaaaagctatagaacatacacaaaagtaaatgtgattttaactggtaaccttaggacaattcaacaagagaacgcttcctttgctatattaatgccacctccaggccttgagaagctttctgtttcaacaaggtatcaaagagaaggtaatctccaaatagggatattgtctcttattcatcgaatctaatagtgctggtccataagcaagcacccaataaatacatgttaaatgaatgaactattataatttgaatcaattatgtatattatgtatcttttggctaaaacaaaatgctctatttttaaaggtcaacttttagtgattctccccagagtatggttttctttgtctcttattcaacatgaaacttgaaggttataagaggcagtataatatgtaggtccaaacattgacattatatcataagagacagatgatgggcattccgaactcataaatttttctattatttgaaagtatgaaagcctttttctcatttatatttctgatgctgtatctgaaataaatttttttcctagttcaggtaatagtagataacagggaccaatctcagggatataattaagactgctttggttttaccctgattccaactgttcagaacaaaatataatttacttctctgaaaaactaatgaaatttaggtgagttttccttctaaaatatgtaggatattatcttctgttcataagcccatccacttagccagttttccaatcctacatttagatcttcattacttacagaaaactgaggataagagtcgttgggtgagacagtagttacagtcctctaacacaaacagggaatgtagcattactggttcactaccaaaatcatgctcctaaaaataccctatcctcttgaattaacaaccaaatacttaaaaaagacatgctgggtatcttaaaatgagtatgtcagttaattaattctctgatcccctgctaccaaccgagtattgtataatctgttattattcactgtcctatagatcatctgttcttggtgctggtttgttccaggaagagggacagctgcaacactatatccctgttcaacctgaggaccatctgactttaattgtaacacacagcttgatgtggctctggctatgagaagccgaagtatcgtctgtaataatctggaaaagcagaaacctgccaacagagggctgaaaacagggattgtgctgtctggctgcctgacgggctgcaggaaatatgattaatgagtaaggtataatgatatcaggaacccgattagcaccacaaaaaggtcacagatcaaagtagtatgcatttcatgagctgcaatcattgcataaaatctgtggaattgaagtggtaaaccaaaaagaggagggggatgaaactcttatgtgacaatatgctaaccaatacataagatacaatactaacaatttagtcacttgtagaaagttaaaaagaaattacaaaatgaatcaatatagactatattgtaaggaaactttgttcatcagaggtgtaaaataaatattttgaatgaatgaatgaggtattaaattctttcataaaggcacatatatgtaaaatcaagtatctttcctaattatgaattaaaatgaccagatatatactcaactctaaactatgtttgcatttgaattgcagtgattttatatacagttctgtttaggaatgtaagctaattcagagtctaaacaatgaagacatctataaaactcaagcagtaggaatcactgggaaaaatattaagtaaactcaataataatgttataacaaatgcacagttaatactgcaaaatattatttggtatataactttacaatcatgcccaagtttagagcgtgggtagccaaaatccaaatctacttgtaaagcaattacgtaaaccacaatcttcttttccttagtgcccttgtaaacctgtcccaaatagacctggctcttctgaggtgaaggcagtgagggtagagatgggaggtactgtcaagagagcggcttgccttaacttatgtaattaaattttttaattgtcaaaatgttggtgaaaaacttaatatataacttattcaaatgtttctgccttttagagctcctttaaagtgaagtaaacatactaacaaacttctttatattattaataatactaactatggtaatgattaacagaaaaccgattcccttgagacttaaaatttcaagtcatatttgagaaaaagtgtgtcaataaaaaaatgatcagaacatgattttttcttaaaagtatattcaccaataatgaggatattttgtatcttttatatattgtataaatatttaatatctaatatttagttaaaacattttttaaatcgtgattcaaaagacaccattaaaaaataaaaaaaggctagttaaaaaatattttcaaaatatatgttggataaatgacttttatggagaatacacaaagatctcttacaattcactaataaaaagacaacccaatttaaaaacaggcaaaatatttgaatggatacttcaccaaagaaaatatatatatatatgagtagcaaataagtcggtgaaaagatggttaacattttcatcattaggataatgcaaattaaaataacaatgacctacctactagaatggctaaaataaataagactgacaataccaagtcttgttaaggatagggaaaaactgaaacttcatacattgtaggaatacaaaatggtaaacatttttattatatgacccaggaattcccagaaatctacccaagagaaataaaaacagatgtccacaccaagacttatacgcaaatatttataatagcccaaactagaaaaaaaagtccattaactagtaaagagattttaaaatgtgatatatctataaaatggaatactatacagcaatacaaagaaattaactactgatatatgcacaacatggatgaatctcaaaaaacatcatgctaactgaaagaagacaggcataaaaagactacatattgtatgattccattaatataaaatttctagaaaagcaaaacagagacagaatcagtgattgcctggagccggcagtggaagcagaggctgactataaagaggcccaaggaaactttttgtactcgtgagtgttctaaagctggaatgtagtggcagttacataactgtatacacttactaaactccttgaattgcatactttaagaagttgaattttattatatatagattgtacctcaatgaatttgttttaaaagaaaaatcactgaaagaaaaaagttgtagtatgaatgtaacttctattcacttttgtgtatccctggggaaaaaaaaccacacacgaccatagacacctgccgcatttaaaggtttgacatttccttcagtatctttcagagcaagtttagtcttcatctctcaatcacagaaactttgtgagaatctttaaaaattcttggggtaaaagtaaaatgcaacatgttccataagactgtgatagaataatattatttactattttctgagtgcctactataagccagataatattctaggcatttacatacataattacaattgtttactcataatttcaaaattacaaatgaaaaaaccaaagctcagaaaggttaaactgctaaggtcccacaatcagcaatgtgattgataaaggattggaaaatctggtcagattccaaagcttacatattctttccactcccctgcattgtttccagtatatatagaatgcaaaatttcaataataatgagactgtaataggatctggaagataggattaattgttggtatgaaaagaaaggaatgccacattaaaaaaatgcaataattttccttttttacatgtgaagtaaaaacaatgcaactgagatttcacttttaatgtagagtgtggtaaacattctacttttattttttaaatttattttattttttattttttcgagacagagtttcactgtgtcacccaggctggagtacaatggcatgatatcagctcactgcaacctctgcctcccaggttcaagcgattctcctgcctcagcctcccaagtagctgggattacaggcgcctgccaccacatccggctaatttttgtatttttaatagcagtggggtttcaccatgttgggcaggctggtctcgaactcctgacctcaggtaatccacccaccttggcctcccaaagtgctgggattacaggtgcgagccaccgcacccggccaagattctacttttaaatactaagaataaagctccctgattccaaacttctgtgaaacttaaaaggcaaaaaggaaaagtcatattagtgtctcgaaaataatactgaacccagataatgaaggacactaaagaatccactaaagaggatactaaagagttgtttgtaagcacaaattcaatgtgcttttaagttttaacattttcatattctcaatattacacgaagatttccttcaaatgatagatacaggacataatttgaaaatcttgtttctattatgaaaatgtgcaatggccttctaacctggaacacaaaattatgttcctttcctggaaagagaagctcatatttggaaaaacttacaatcccaatttcacttctaactttcgcttaaaattttgaatcatcatgtatatatgaatgtaacttaacttctgcataaaagaaactattactttatatatcaattcaataacatttcataaagtatatacaaggattcttgagctattatgtcactttcagttagtcctatcacctacagctttgtccagaagagcaagggttaatgattatacaccaacacatgaaagatgctttgagcaaaagctcatgacagacagagtagatgattattatcttaccaatctgtttatgtgaacaaattcttctgaggttttggcccaaggaggaagttcgacatcagacactactgtcccatcatccatcactccaagattataattattgaagttgacaaacatctcagggagataataaaattcagggatcaactcctatataaaaataaaagacaatgtgatattataaactgtaggatactgactagatattcaaaaaaaggacctgatcattttctattgttcagaagaacaaaataaacacagggaatttttttttctttgcatatcatagccctgtcacagtttctcataagatagacagatcctatctaacccaacttaaataagatcttactggtataaataactttcataggctttccttcatgacatgtctcataacctcaaaactcttaaatacaaatattttagtaataactgaggtttgacaagatataaacataaattaccatgctataacaataatgacaacctaactagattttttatgaggtatattgaatttttgccagaaaaacccaaaatctttctaagcattaaaatgccaatgtcttggtctcttcatcaaccaggaagataatttattacagtttagccatggtttctcagtaccttttcctcacatttcaaaacggtcaagtttaaagataccaactctgatagaagatcaaaatttaaaattagtctagaaaatgacttgcatgagaaactgagtaaattcaatatgtaactttaataatgacatttaataagcagaaaaatgcagctgcttagccttttgtgtgtaataaaccccatatataactatttcagaggctctgtagatcagacttgaaatccagtcttgacatgggtcagtggttcagtggtctttcagatatcccctcagggccagcaatggcaggcccggctttccaaacagttgagtaaaatagggaggtcatcagattttggacaaggtcagtatgaacttgccagagcagagaaaaaaaatccagcaggaattaagctattatcacctccatgatccatgtgaaatgttgcctgactttgaattgtacatcctttgtttacaatcacattaattaactaagcagggtagaaacgagcttgttcttccaaatggctgacaaccacctgaccattagacttaaaaagcattttaactgaacaattaaaaaaaaaaaaagaccttatttaaagcttagctataaataaaattagattataatcacacaaaaattttaagattctcatcttcaaaaacaatgtatataattctaattgacaaaagaggaaaacacaggtgtgtgttattttatgaagcaaaaagccatatccaatttgtctgagctaacacttattgcatggtatgagtcatactctcataccataaataaataaactcttaataaaccttattacatttaatctcacaaccactttacaaggtaaagtatcaatcatttctacttaaaaaatgaactaaggctcaaaaaagtgctttgtccaacgttaccagttggacaaaatatggaagttggaccaggacttgtttaactgtaaagcctgtgtcctcagtcatcaaataagcctgggttctacctacacagtatatgcagtgctaaacattttaagtataagtttttaacttatatacaaagtgatttttaaaaaaggaaaagaaactctaaacttttagcattttcatgatgagaaaacaactggctatcctgaatacatatatctttcatatatatatatttatctctctctatacagcaattgttatataaataattgaaaaagaatttttgtaatgtgatttatcccaataaatcactatataattttctagtattaatttgcccaagtgtgtattcaattaatttccagctttgacaaattttaccaaaatatgttattttcacttcataatacttgtgctactgaagatgaatgttactattcccaggccttgtttcacaataaagagggaggaacatgctttccttgttcattgacaatcaaaagcagcatttgcttaattaaatactaattattctcatttcagtaatacccgctgcccacttccacccccaattcacactctatcatgattagaagatagtgtccttcttttgctggttatacctaccatgctcttgttttataattctcctagattcaaagcaataattataatggatgaattttaagtgctagttttcccctgagttttaaaatttgagagatgcatcatttccattgtaaattagagatgcataataaaatatacctaaatgcatagtaaaaatatacctaaaaagtactcttaccaacaccaatttgaggaagcagaatggaacaaatgacatttcatagcaattgttacaaaaatgaagttttcaatccttctaatatatagtgtcaaaatattatgattttgtatatttgtctgtatcttctacatctgttatttcattcaggttactcaacaaattgacaaaaaatttatttgctcaaaacaaatattctccacaagtttttttggttttttgttttttttttttttggttaagagacagggtcccactctgtcacccaggttggagtacagtagtggcacaatcatagttcaccgtaacctcaaactttaatcgatctttccaccttagcctcccaagtggctaggactataggaatacactaccatgcctggctaattttttaattttttgcagtgacagggtctggctatgttgcccaggctagtctcaaactcttggcttcaagcaatcctccccaaaatatattttattcctggcccaatttatttttaaatacacatttattatgaattattatgttactttaatattgacaccttaacctaaatataaattcaattagttaaactagaaattaaatggagcaaaaccacccataaaacaaacaagaatttttaaataagtgatatgaagaaagcaatttcaaacttttaagtctttcagctacataatatctatcatgctgggaagaaggtaataaccatcagtttccatttaattactatggattttgtgatttcctaaggaaacattttatgtaaattttgtacaatgggcattgtaaacatatttcaaaattaaaaatttaaacagtaaaaattaaaaattagctttcaacatttcacttgaaatttatcaagatatgtatttgtgttttactctattttttcacctctcactcccttcacctttaattttaagagagcagacaggcatttcctttctcaagaacatttgcagggtccagagcagaggcctcttgaaggcatctttcttttctgtcttgtgtgaatctctaagcaaacagagagtatatgaggtatctaggtgaaggaggagtcaaatgttagtatttttaaagagagagaagccaaacaggcataaattttttccaagagtagggaagcaagttctcaaaatctacagtcagcattttttttttccccagcctgggggaaaggagaagggattaagaggttaggcaggaacccagaggatggggaatggtgagcgggtcactatatgcccatacagtgcctctatgtgaaatagaagaaaggtaacactgctaggctaatgcagtcctaagagaattcagtttggtaaatggagtaagtacaggctggattttagcttccgttctttctctcaatcaagtgccctttcatgaagaacaatctgcctactgtacatagtggccccatgcatggtgcacatagggaagctagtcccttggcaccatggtttttggcatcagcaaatattttctaacagtaacttggtataatcatcagagctgcctgccttcgaaagaccatatgtatcttagacaataaagatatgactaatgaagaaaacgatggactaaagatgtgaaggctagttttctaggtatcacacaagcctggactctcattcaagccttgagaaaagaaggtccctgccctaccaatctaataactatgaaggaatttttcaacagcctaatatgaagaagggctaagttcaaattaggatatttcttgtacacttgagttggtggttataattttatacctatgtcaataatggtaaaaagttagcaatatattcactgataatatcttttttttttttttttttttttgagatgaagtcttactatgtcacccaggctggagtgcagtggcgcgatcttggctcactgcaacctctgcctcctgagttcaagcgattctcatgcctcagcttccttagtagctgagattataggcgcctgtaaccataccaggttaatttttgtatttttagtagagacggggtttcagcatgttggccaggctagtctcaaactcctgacctcaggtgatctgcctgcctcggcctcccaaagtgctgggattacaggaatgagccaccaagcccagccatgataatatatgtctagcccaggcaccgtggctaaggcctgtaatcccagcactttgggaggccgaggcagaaggatggcttgtttccaggagttcaagaccagcctgagcaacatggcaagacccgtctctacaaaaaaattaaaaaatttagccaggtatggtggcatgcacctgtgcctgtagtcccagctattcgagagattgatgtgggaagactgtgagcccaggaggctgcagtgagctgtgttcacactactgcactccagcctgggtgacagagtgagaccctgtctcaaaaaaaatacatatatattatacatatatggtatatatataaagtatatatataatacacattatagtataaagtatatataatgcacattatagtataaagtatatataatacacattatagtataaagtatatataatacacattatagtatatataaagtatatataatacacattatagtatatataaagtatatataatacatatataatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatatacattataatatatataaagtatatataatatacattataatatatataaagtatatataatatacattataatatatataaagtatatataatatacattataatatatataaagtatatataatatacattataatatatataaagtatatataatatacattataatatatataaagtatatataatatacattatattatatataaagtatatataatacatagataatatataaaacatatataatatataaagtatatattatacacatatataatataaatatatacatatatcatacatattttatatatataatataaatatatacttatacatatattatatatataaagtataacatataaatatatgtcattttatgtatatatttatatatacatatatacacatacacaaaatgcaggaagaattcagtatggacagaaatacaaatagaatgtaaatgttatttcttattaaaataataaaactcataagaacacctcttaattatttgatttaaaccttaggtagaaatgaagggtgatgtagcacatcattatcacaaaaaagaaaccacatttatttagttcttattctttttttgtttgtttaacagagagcttcagtttcacgtcactgtcctagcttcatctacctgttgccaacaacttgaaggagtttctccatagcccttgattcctgaattgttcaacatatcaacagcaatagtcacaaatacattgacttaaggagtaaacaagcagcttttctctacagaccactgagcaccccaggaaggtgcagctctctgctccaccccagcgtcttggtgtctgtgtccagcaggaaggacctggcaggaggctgaatccaagcactgctttcaggccactctattctcatccctggatcctccagggaaataagggggaaaaaaaatgacttttcctgctttcaaaatggagggccttaaaatcaaccaaagttccagaacaaaaacaaaacacaggagctggctgggtgcactggctcacacctgtggtcccaacattttgggaggccaaggtgggaggactgattgagtgcaggagttcaagaccagcttggccaacatggcaagaccccatctctacaaaaaaagtaaacaaaaatcagtcgggcatcatggcatatgtctgtagtcccagctactctggagggtgaggtgaggactgcttgagcctgggagggcaaggctgcagtgagccgagttcatgccactggcaccctagcctaggaaacagagttagaccttgtctcaaaacaaaaacccaaaaaaccccccatcatctgcaaagccatgttgggagcacaactgtttcccataggctttctttttccttgccccattgacttccagaaggttttccccttacccatcattgtgacttttctcatctttcacaatggtgcaattcaataggaagaattaacaactagaaaaggaagaacaacaacaacaaaaaatctaaccctatgaaaactctgccttcaacataactccagggagatgaacattataatactggcactcctgacccacactatcctctgcaccccgtccctgaccacatcctcctctctggacacttagacatcaggttccccaagggacaaggttccatgaagagcaccctgagttccttagaagaactggcactgctccggctcctctaacaactgagactggcactgtgggcaccaccaggtgagcctctggaacccacctgagggcccaaagggcttcttcatgacctggtggccagctgggcactgttctttctggtagacctgcatgtgctgcggtttgccctggaacttgccctgcagccaggctgtactgaactccaccacgtgatccaccagggcctcctaacatggaggcactcaggactgaaccaagagaaaggggatggatgccagctctgtacaagacttcattcttaatgacgttccctagccctgagaagtatttctggtccaatggtgtataagtgacaggctgagcctggcctagagcttccaaggcttgtcctcaatggaacttctcagacaggatgtcacaggtgggtgtgacctctggggaagagctccaaggcatctgacaattataaagtgccaggaagctaccaccaccaaagtacaggaccaacctcggggcagggtccctccggtcccccttcttgttggctttcttggctctggagaagtcgttcacccaaacgctgccaagcaaacaagagctgacacgcagccgcctcccagcatctcctgtaggggtgtctcccttcaaacattcctaatcatcctctccctgggggacgagctctgcggactgtgaggaggcgtcaagggtcttctgcccacttgctcccgggcctgctttgagtccacagtcccttccttctgcgcttctttttgtggaggctctggcggtgagctgttgccagcgggccccatttcttcatctggatcaaatctaaggaataatttctttccatggacctgggtgtcctggagccacagagactggaggctggtgggctatacttcttactgttgctccctgtctttaccacctgcttgcccacaaaaggagagaccgaatggtgaaatgtcctcaccaacagcccttctggcatcccagctccgggtgggcagccccttggcccgacccagcaccactgcacgccccgcacagcagctccagcaccaggcagagatttctcagcgccacggcacacgtgggctccgtccccttaggggacgcccctgtaggttagttcttactctttagagagaactgttttagggtctgggatacataaaatgagtcccccccaccgcccgagaatacagatctaaatcagtaatagagaaagaatatatttttaggagaaaatacgttgtgaaaacaactagcactccagaagttcaaataagaaaattatgactaaaagttggggtggccagagaaagctttagggaaaagattgtaatacattgtatttcgctaacacagaactcatcaatctgtattataactgcttgtttgtttctatctccctctaaatggaaggatccatgaaattgaggactttacatgtgaatttaaagtatgacaagcatttctaagaaactaatagtgaggagagagattattaagattttacatatagtatgaagaacaacatcaaattagcacaattaaataagagagcgagcatatatacagcaaatcctcacctactgtcatcgatagggtcttgaaaattgcaactttatgtaaaatggcatataacaaaaccaattttaccacaggctaattgatataaatgagttaagttcccacggcatattttggttgccacaaaaacatcaccaaacttctaaaaagagacccaaaacacttctactattaaatattgaaataaatgtgagctatatgtacatctaagaaagattaacaaaaataagataattatttacccatttattccacttcagggttgcaggtggcctaacacctactgcgccaactcagggcacaagtgaggaaaccatggtgccttggacaggacaccaggtgccatcccatagcagggagcacgtgcgcgcgtgcacacacgcacacacacacacacacacagagtcagatgggtaccaggtagacacaccagttcaccttatgtgcacatctttgggatgtgggaagaaaccagagtacctggaaaaagcccacacagacatgggaagaacatgcaaacaccacacagaaagtggccccggccatgaattgatgttttttttctcaccagcgatataacaaaacattgaatgaaatgacgttatttgaggacatgctgtacttaaactatattgcagtctcatcacaagaaaatctgcatgaataagtcggtgatgagagtgcaatactctcttaatacgaaataaacatgctgaactcaactgatatataccaatatgtaacaaaataaataagcataatacagccaaaatcttactgtggatgacaatggcatttaagttatacagtagaattccattttaatactaaaagcatctttctaagaaccatatcttgatacaataccaaatattacagttcaaaattatctcttttgacagatgaaatgtagtaacagagtcaaagattatgcctttctaatacttttaatgcacatttacaaagtgaagtatgttttatattcatcagaacagaacagtcagctctggataaaaaacacatgttcagcaattctttaaaacatcagtggaaaatgataagtaaacaacactgacagaagacagatacatttacaattcacgttttcttctggcttgctcaaaataattttaatctctatcacttaattaggtagatgggtcttagaggcaggtaacatggccaacatttagtgtatcatctcctaagataaaaatttgaaaggttcaaccagaggttacaccacagttcaggataagctcattgctttgatcacaaatcccaaggctttcatggcataatgacaaggattggttgtgaccacacatatgctttagttttctttattaaggtataatttccactgatatgaacaacctttgcagccaggctgtatgattctccttttaatagtcaccaattctatgcactgaactaaacccaccacttcaatatattggggcaaacataccaactactaatctatcaaccaaaaagaaacaagataatcaaaatagaaataaaaatgaagaagctcctttttagttaaaattaaatatttatttcatttttcctaaatatgaaatattgacaactcaaatagaagcatgataaattagaagttaactaatttaaggtgcactgcttagggacactgatggtaaaaaaatgtgaaagcaaaattttagcttttcaccactgaaaaaatgatttaaaaaattgaaaataagctttcttaattaacaaaaaagagctgattaacaatatattataaaaatataatgtgcatgttttgatacattttaattttcaagatttattttgttagcccataataaaacttttaaaaaattcactagagatcaagaacattgaattgcatttataatagttattttaaatcaactgcatatctgaaagctttcaagttgatatttaaatttagtttgtcctaatttggtagataaaatgctgttttttcctacagtaaaagaaaaacaatcattttcaaaattggaaaagaaaaaataatctataatccttccagaccaaccccataaatattatgtggtttttagatattataaaactgttatttcaaatgcattacaataaagaaaaatcatggattacaaatcaatagataaatgataatctatttcaatctgatatagtagaaaaaataattgggtttaagtcttgtctactcaacttactgtcacatgtactcaaattaatttaatttctgtgacccttactcacctcaattgccatttcaaaatcacagggtttgctgtgaggctcatatgggataatgcggaattctatatatacataagatattattatcattagtaggattcatgataaaaatcccaaattacagactcaacttgcctaaatcctaaagccaataggtcattcactgaattatgcccatttataaaagcatttaacataactctaagaatacttaacaaaacttactttcaaaaatatatatgcccacaaaaatatttgagacttaatacttcctgccaaataactatgacattcaaaacaaatatattattttttttattagcaatgacagtagggtttaacatgcttcatattatgataaatatccccaataatttatggttctttcttgctttcaacacatttttcacttccatgtttgaaatggacatctccattgggccttttgctgttctagacccttatctccaaataaattataatttggaaagaaataatgggcaataataatgcaaacaaaaagtgagctgtaactgccgtaagagaagatgcaaataaaatttctggaataagtggtagacatatatttagtatgggagaagaaccacttatctcagtatctaagaacgcattaatgaacagtctacattttctagttgaacaaaaaatatgataagatcaccagtcaaaaaacaaatcacacttgacatatgcatgcatttttataattctggaagacatgaatattttccaaatgccttaataggtttttaattttcctgtatagtatgtaaatagcatgagaagaaaaatattcagggtttcaagtaatttttatcaatgagcaaaatgtagttcattgtagacacgagtacaaacttcaatacttaattagcacaaagtttcatcatttaacctactgatacttgaagaaaagggctaaagagatgtggctaaattaacaaatcgcaagttatctataagttacgtataaaaagcaaggataaacagacatatttgagaaagcttgagctcactgatgaaaaagaagagaggctggcaaaaaacagaaggaaggagggaagataggaaggagaaaggaatgagcacttaagttgaaaatgtgcaaatgcatgaataaggataagattttaattttactttctttcagcattttttaaaactctaaattattaaaatggtgtctgagaaccggatgcagattttttttactaagaaaataaaattactaaatcatcgaagtttaagttttttaaaaaataaatacattaagaaatacattgccatcaattatgttctattaactgtagctaagcattttcttataaacgggcctaatgttgatgatatcagcatccatggaatgtattaacatggtagaagatgtgctgctagggaaagaagaaacctaatttatcttcagattgcagacctctgggatttctgaggtagtaaagggaagtcaaaggtctcatgttttacaaatctcacaagccacaaaactattctatgatcacctctactgtatattattatttaacatgcatatgtaatttaaaactttttaagggttaaatattaaattatatatgagttcatataatattactgcatagtcatttatttttaaaataatatttagtatctcttaggacttaattgcattctatttacttaactgtaaatatagaatatactttactgaccctactaacttcataacttaatacactcaccactaatgatgcacattaaattataaaataggtttttaagtgaaaaatccaagatatgaccagtgatggtatgtccatgttcgcaaagctatcacagtaataaaatgtagaaaattgaatcattaacaacttgtggtcagcatctgacatccagctaccagttctcttgtggacataaaatctcatcctaaaaaatgagatgttagtagtcccacttcatatcaggcatatatccatttgagtttggctgtgcccttctggctagaataagcatacactctccattttctcctcaaactacctcgctatttttcccaggctctttcactaactcttagaaaagctttatgcctcctgtcccttacagtcaaccaaatgctcatttgtttgcatatctttaatagctgtgacacagatcaggcagattgcaaagtcaatcatatctattatctggctattacttgctgaactggcttatataattaactcaagcatttttagactgttaccaaaggccttcatattagactcaactgcctttcagaatctctgtttctatgttttctacacacccgaaacataagaccaattaacagatcaataagcaatgtgccaaacgtcttttctgagctttgttcatgtcacttcccttgctcagaaccctcttcctcatttcatcacattattaattcaatacatatttaatttagtgcctaccatgctccaaacacctttgtagattgtagggataaaccaatgaggaaaacagtcaaaaatttaggatctcatggagctaatggtcaagtgggatatgacataataaacaaatcaataagcatgagataagtatgtcagatggtgagtgacataaagaaatatgaagtcagggagtaagtaaaagtgcatgaggtgatgggggcaattttaaatagggaggagagagaaggccttactgaaaaggtgacatttgagcaaaaacctgaaaggcatgaagaatgagttcttaaagataactaaaacaaatgcctcaggtgaaaggaaaaggaaaatcaaaggtgctgaggtcagaagtacttgaaggacaccaagcagaccctgtttagctagaacagagtgaacggggtggcaaacagaagagctcaagatgtaataggattttggaaaggagttaggtagtgtagggtcttacgttgcaaagatttcagcttatactcaaataggaaaccatttacgatagggggaagactgtaagaatagctttgaagaaatgaagatcaggaatttagttttgaacatgttaaatttaagatacagtttatatattcaaatggagatgtcgaggagggagtcagatatcaggagaaatgcacaggctagagacataaatgtgggaggtctgttagactctcctgcatcccttaagatacagcttaaaaatcacttattctgtaaagtcatttgcaatcccatctcccccagtcagaattaatttaattttgtttatatcttactatataagatatagcacttatcactatctaatttgtactaaaaattattttatatatgcctgtctttttcatctggagagatatgctaactaaagaactatgtctattttattcttttaattctaaatgctctctactatatattaaatatagcaaataaccaataaatgctagcctaactaaacgtgttttgggggattttaattgacttctcatagttttcttcttaaaggcagggagctaaatatctatgacctaacaaaacttgttctttcttctgtgctatatatatatgcccaagtcaaatttaatctttcactctctctctctcatcttacaagacaaatcaatcaccaaatcttaacagttaccttctaaatatatcttaaatgtatccacatttctctagccccactggcattactgaatataagccttcactgctccttgcctaattaacaacttactgactgcttccactctgggccatagacaagggcaatacatatgtcaacaccaatcacagcggtctcttaaaagcacaaaatctattcatgtcacttctttgcttcaaactctcccaagtctccccactgcacccaggataaagttcatcctctttcacaaagcagaaggcccctcatgattggtcctgaatctcctctttcctcttccttctcttcatttcagacgctgtatccatgagcccaaggggcatgagcctactgtactaaattgctgggacttgttttactgtaggtatctcctctagtgcaaaagcccactgaaggcaagaattgtgtcatatttggtgctatatcacaaccagagtctgacactggataaacacaattaaaatacaaaattttaaaagtaaatgatatctcagggttcctccaaactttttaatctaatttacttttgtacaggttataatttaataatatattattatattaaattcggggtttctaaaaaagtatggttctccaacaatctccgtttcagatccatttactactgtccccattccaaagtaatgaactgggatgacatttatgattccttctatgttctagtaccaagtagtaatcatttctacaggagagaaagaaaataatttaaactgcagcaagtcagattgtacttcaccattagattgaatttatcaacactaaaggaatctgaaatgagtaggcaacctcaagagaaggggaaaaaatcaatgacaataaattgcctagaaaagcttagatatttgcctaatatttagatgtagctgtctagtcaaattcatttaaacttcatgagtctaatttgttacataaaatttggtcataataattcaaggttcaggctgaagaaagtaaactattctgaaccccagtttctaaatttaagtgaattttaaagatttaaaacacagaatctactggggattttaaaatattatttatcacagtgataattctccaacccaattttaatactttgtatttcagtcttcaagattacagattgttgctactaattgtctgtttatttttagatgaagtacacatcagaaacatcattgttcaaaaagggtgaaggcattctttccataagcccaaactatcccttgatgtgattccaaaacaatgctctgaatctgcactgccccaagacagcagccactagccacaaatggctattgaacacaaaatgtgtggctagtctcaacacagatgtgccatgtaaatagagacatgttgagtataaaataccactggaagacttagtatcaaaaaatgtaaaatatctaataattttatattgattacatattgaaataatattttggatatatacggttaagataaattattaaaattaatttttttttacttttaaaaatacgactatgaaatcatttaattacataagtggcttatatttgtggtttgtattatatttccattggagagtcgctctaagtctacttagaaaactgatcaacactactgatctgcttcttcagggagaataaaaaccatcattgagaggtcagatctgaaatggaatcaccaatgatgcagagaaatacaaattatccacaaaactttaaaaacagtaaattatgctataaataaaagattgctttagtgtaaaaaaaggtctcttctttaaaataaaaagaattaacattttaaccttcatttcataggaataacctcaattttgggtaatattattctttgagtattgggaaaatttaagaaatagggattttaagatattcaagtaacagctccccctcagcaaaaaaacaattaagttaccagaaatgtgaccctattcttatttttttctttctgaaaaaatttaaatcttcttcataccttacatttcgtttttggaaaatctcacaaaaacattttacagaatgtatactatattaatcaggcaaggtatgctttaggatctactcaataaaatgattcctaccaccccaccatcatatttcaccatctcctctctactgtttaacatttctttagtatttctaggaactccagcaagacaatacaaataaagttgacaattataactaataatgactccacctgaaatatgtgatagctgaatgaaatatttacatatatttacatatattacagtaatttaagtgtgttcttttttttttttttttttttttttgagacacagtctccctgtcacccaggctggagtgcagtggcgctatctcggctcactgcaagctccgcctcctgggttcacgccattctcctgcctcagcctcccgagtagctgggactacaggtgcctgccacattttttgtatttttagtagagacggagtttcaccgtgttagtcaggatggtctcgatctcctgacctcgtgatccgcccgcctcggcttctcaaagtgttaagtgtgttcttatatatttatctctattataataatttaaatatactttctaaggtgccaaaatataacattttaaaaataaacaggatcaaaacaacaacaacagaggcatgattaaattcctcctgttttagaaagaccaaccaacaggaggttctttaaatagcctgtataaccatatattatacaattgtcaaagtatttgaaagtcactaagttttagggcccaaattagctggttatcaatataaaaatgggggtaatttatcaatgccctacttactatcctacagatattagggcatggtgatggagatggagaaggagaatatacacattggtggaaaaatatcagtaggcttcacaaagtaagttctgaaaaaaattttgtgcttccaaacataatgaaacatattccaaacataagagggagctggatttgactccttattatttgtgatgaaacaagaataataagaaaaataaggaagaagaaaggtaaagaagaccatgtgatttcttttgatgttatagttgtttagatttcttttttattttttttacaggtagggtattttaaagaatttttagagaaaatgaaaccagacacaaaccaattaaagaatcttgaaagaaaaaggctgaggttcaggaaaaaaagaaaacaaaatcactagcatctatcatatgtacctcctgcccatcaaagcaatgaacaggaatgtctagtacagatagaggcagaaagctgaagatacctactattgctattataaagcagcaaaacataatattcaaattcatgacttcatttttgtttatatttctagtagcaaacttaggtatgaggttaaaatttggtcatgagatgcttaacaaatgaaggaatttggaaagaaaaaaaaacccacacataagtcttcaatttcataacaaaatgtcaggcttatcaatattttcatttctcttattatttctcaaaagagttacataagtaattaaacagctttgagattagaggtaaaatttaacaaaattattatatctgttaactattcttacttacttttatctaaacatccaattcaaaattatttactggtgatttttaaagagtatgatatataattttcaagagtatatcagagtatattatttgtgagatcaaaaaccctgatagatgtcccaataaaagattatttttgtatacaatagaatcttctttaataaagtatctttcacataagcaatgtactctacagtaagatgtgaatacattttgtagactttaaagtatcatacctaaaagcaagatgcaattgtcattatactgaaaaaatttttaagtactctacagtaacatacacattagcagtataacttttctccttttggactccaatatttctcatctggcacttattttctcccatatggtataattatttatatatgtcatatttctctatggaactataaggaacttcaaaaccatagggatatctcattatacttaatagatctaacacagtacaccttgcagaaagagacaccatttaaaaaaaaatagactgtatttctgtaggtagaagcaaaattctagtaaggactattactagctactgtgcagtttttgatcctttgatctttcatgcatatagatagaataactcttgtttttgctttattaataatggaatgctttactaagcaaaatcaggtatgcttttagaaccagcagcaggcaaaacacaattatttcaagaacgggtacataggatatctaaatatctatgtctgagatttttctcatggtatttttcagactatagtaattttgttcactgagtttggaattccagccaggcacaatggctcacacctgtaatcccagcactttgggtggctgaggaaggaagatcgcgtaagacagttcaagaccagcctgggcaacatagggagaccccatctttacaaaaaataaaaaattagcctagcgtggtggtacatgcctgtggtcccagctactcaggaggctgaggcaggaggatcacttgagcctggaaggtcgaggttgaggctacagtgaattgtgattgtgccactgcacctctagcctgagtgacaaagcgagaccttgtttcaagaaaaaaaaaaaagagttcggaatcccattacgcatggtgccttacatgctttacattcacactacctaccatattttcccttcaacaaaaagattctaaagagaaagggaaaataaaaaaaacactctacaacaaaagacagagagagaggaaggagagattctgatagaggagagacagtcatgtagaacttacagggagaggccgggcgcggtggctcacacctgtaatatcaacactttgggaggctgaggcaggcagatcacttgaggtcaggagttccagaccagtctggccaacatggtgaaaccccatctctactaaaaaaaaatacaaaaaaactagccaggcgttgtggcagatgcctgtaatcccagctacttgggaggctgaggcagaagaatcgcttgaaccctagaggtggaggtggcagtgagccaagatcacgccattgcactccagcctgaaggacagagcaagactctgtctccaaaacaaaaacaaaaacaaaaacaaaaacaaaacaataacaacaaaaactcccagggaaagacaagagatagagacagagagagacatgctgtaattcttggccatttaattaaggacttatcttctgagatttatcttttgtaaatagggctgtatggcagtagagaaaattttcaacattcactcaacaagtaatgcactggcaataacaactataaaacaaaacatttctgtaccttaatatcagaggtatcacgctgactgtttcgccaagctctggaaattgatgaaaaagttcgatctgcatgatcaaatttgcctccttgcaaatttaggaaataagttgtaaagggttcctaaaaaatagcaattaaaaaaatccatatgttccctcaggcataaaaatgtggtttttataaattcttagaactaaatactttaatgactaataggcattcactagtaatataaactaggtatataatgagaattatatctaaattattacattaatgttctcaagttatttttccctcaaaagaaatatttctaaatatttcaaaaatttggtatttgcaacattttcttcaggtagccttcctttccaagaataatgtattaatatcatacagacataaattagatgtattttcttcatagtacagggaatagtccagtatgtagttttcctattgttatggctcaatatttaatttatgattaagaaaagaaaaatgtttggatgatttaaaagcctcctcttagttaaagaacacttaaacacatattagtggataattgcttgaaattagctaagcactataaattacttctaggatttatgtctgcctgtatccttctaacaagctttaattaatgatgtgctgctaatgcttttccgaagaaattgctttctagtagatgaatcacctttcaatttcacagaaacatttcttgtttaaccaatatattatcaatacacgacagccttagttttaccaacaaacttaccttattccatttgggacaaccttccaaaatatataagtacatgtctgtgttagtaacaacttacttagttcttattttaatagactacattttaaaagaatttatgctacaatttggaatctggtaagacagcaagcatctgaaggggcaaatttaagaaaaaaattcatacaattccagatgaaacatttttaaggcaatacaagccaaatgagatagagatatttataattagaacttcaataatttaaactgactcttttagtattcaaaaaaatatgcttatgagttctaatttttgcatatccttcacaacactgaatttatttagccatggtgtattattcaaattgaacttactattcttagcagccatgcaagaacaaaacttgcagttgagtaatgagtaccatagtgaaactttggaacttgatcatcttcccatgattcataacgctcagcgaagaatgctgctctttttgggttcagagctcctattggctgccaatagggagggaaaaaacaaagaatacatcaatgtaatcatccttcatgtcttcctctcttctgatgatatcctactggtaagtataaaagtgaattttaaaaatatatactacttaagctgcaacacagtatcatattgggagtaaaaagcaatattttttccaacaagttaaacacaacatataagtaagtgaatggatgaacccatcatttctccataagtctagttttcatggaacataggtgtttaatcatcccataacaagcatcagataaagacaattacatgaagtgaaatatcagctgtacaacactttggaaagcacctataaaaccacatttagttaattagaagcaacaaccagaaacagaatcttaaagctgaaggactgacttataatgggttcttagaagaggatgaaacaaaactgggagataggtgagatggagcacaaaggaagaaagaaattgtgggaaaacagggttaagaaactagaaatttctactagtgtgagtgaaaacaaaggataaaaatatgcctatatgtctatataggatatatagatatatacatatatatgtatatactttaaccagaggattaaaaatatgccggcatgaactctctctctctctctatatatatatattataaaattaaaaatatcacattaaaaataatgctatatatatatcgcattaaaaaaagaatagtagacagattatgaacttatactggaaaataatactttacagcagaggtcccagagcaatatagcaacatggtgaaaaccctgagctcactggaatgataataatactcattcaaaaggttgttttggaagataaaaatgagtaggtacgttaaagtccaacaaactatgcctgacaacgttcaatgaatgctaactatggtttttaagataattgtttagaatttgggttaaagagtttgaatgaaataattgcctttagcaaattgcttagcataagataaagcttaataaatgttagttggtacctgtatctttattattgctactgctgttgtcatttaggtaatacacgaactccattaaatagcaggcaaaattctgtgtgatcaagcctatgcatgtacatatccttacaaagacgtagagaatatgcttgagagtctcaaaggagtctaaggctcaaaaaatgttaagatcaactgctttaagtaacaattcattctcaaaaaacattctgatctctagaaaatctctattccgtattcaaaatgttaagtacccactcactgaaaaagacatgatatataagattacttcttttcataagatacagaggccaggtgcagtggttcacacctataatcccagtgctctgggaggtcgaggtgggagattgtttgagtccaggagttcaagaccagcctgtgcaacatagtgagaccctgtttctacaaaaaaatttaaaaatcggctgcgcatagtggcatgtccctgtaatcccagctactcgggaggctgaggtaggaggattacatgagcccaagcaccttaaagcctacagtgagctatgattgtgccactgtactccagccttggtgatggagagagtccctgtcctgtctctaaataaattaataaataaaaaattctttatttaaaaaaagatacacaacagtcttttgccttatatcatttatgaacacctattagttaatcactccttatttataacagaaagaaaatatctgattatttgtggagaaaatgttaaaataaataaatcaaaaatattggtttaaaagggatgcactgagaaatattttattgaaaatgaagcaatgttcagaccagtttttaaactgcttttcatgttacatgttaagcaacatcttaaatttatcattttggttatccttattaaattgttaattattttttcaaaactatctttggcatcatcactcaatagcttggttttaatgaatattattgtatgttaaggcattttttcctttacaagcaaaattttaaaaatctttaattaccattttaagtcagtttcacagtaaactaatttaaaatgctatcttttaaagcattagtttctgtacaaaagaatcatatctgacttactaaatatgtgccagttaagaatggagctgactccaaggattctttctttgttacagaaccaatttgaaatgcctttaaatgtattttagttgttgtccctaaagaatgagccatggaaaagaaaagagagaagaaataaaatcactagaagacaaattatatgaattaaaaatagaatcaatgctccttttgtatggtctgaagcataataagtattcactttatctgctcctatttttattactctccaaatgagtaacccccaaaatcaatagttatagaatcacgtttcttgaatataatgctaaaaccaattaggattgatttcactagcatctgaaaaaaaatggcatcttgcagagatccatattggtagaacccacagtattgattttggctgttattgttacagttggtttctgaagcctgctatacgacagctatcaagacataccacgtttatttgcaagcatataaaaaagaagtccccaaataaaagaaagttaaaaaaaaaagaccagtggagctgtgcaatgacaatgatacactatcagcttactcagagaagttacagtgggaatacacacattgaattatacattacgcgaaagcactgatttattgtggtaataacatccacctcattaaaagattctgctttgctgcagttggaaggctacatattgtttactgctataaattaatggcagtgcaaagaagactgtggaaccatcctaacaatagatctgtaatgacagtgctgtatatcacagcttcctcagcagcttcataataaaatggagacaatgtattgagctaatacattctaccatgctggcccacatttttctgacaactgctttaaaagatgatctgaattcaactatgttataatgctgcaaaacatttaactaagcaagagtcagtcatataccaaagtgcatcaaagcatttttaaaacattgtctaaatcagcatttcaggatgtttattcatctctgcaaaagaactaaaagtaaatgctgacggatcctcttacttatatagtatattaagagtcaaaattctaagtcagtttgggaagatgctagcaccatcatcctacatagagcttactgtacaatgtaacaagcttgacaaagtatttttcttaaaaagcaagattttaaaggaaagtgactcaaaatactggccattaaaaatggtcataatttcttttaaaaaatcagtaaaagtaagtattgattagaaagtataaaagtggtataattccaggtaaacacaaatagctctagaatacagaaaaataattttaaacactacaaaaagctaacaaataaatagaattatagaaggttttcttaactctacaaactaagaaaaaatctcaatcacaatacaatgaaaaataggtttaagtaaaatagaatagaataatttaaaatgtagagtattaggtctaacaacaaaatattatgttaaaaatataaataaaggacaggcacagtggctctgcctgtaatcccagcattttggcaggctgaagcaggagaataacttgagcccaggagtttgagaccagcctggacaacatgatgagatcctgtctctataaaaatcagaaatcagatgggcatggtggtgtatgcctatagtcccaactacttgggaggatcgcttgagtccaggaggttgaggatgcagtgagctgtaatcgcgccactgtactcagcctgggtgacagagtgagaccctgtctcaaacaaaacaaaaagcagaaataaaaacttagattaaagtaggaaaagacaaattaaagaaaaccaaaactcttggaaatggtatgaatagccaaaaatcactgtatttaggatattttaataatttcacaaatagcaaagctgacatctgtggtagaataataagtattctgcttatgagataataatgatatctttcaaaacaggatatgcaaaataaaacttgtaaaattggttttgtaagaagactgcaattaaaaaaacattttttgttacgttctttgagaagtaattttgctagttaacaaaatccctgcatataaagtgatcagttcagtgcctggtacataataataatgataataattattatttttttcaggttatttgatgaagaatatttaataaaaaaaggcactaagtaagcctgatgaaattaatgggatctattaggaaagaccgtgattaaacatcacaatcctctaaagacaaagcaggataagaacatatagtactgtggatgatctgtaagaagcctaagagtaaacagtagtccccatcaatgaattttactactttaagaacataatcaaaacaaaattacttttcaaaaatccaggggcctccaaattttactacgaaaagcataagaaatatcaagcaacttataatcacctcctactatattatttataaagaaacagtttgaattaacagactcctttaaaagcacataacagactttggtctaatattagtaaaagctgtaaaaaggtatctgttttttctttctttattaaaattttaggaactcttacctgaagttatctaattaagaataccacctccagcttacattttgtaatttattaaacattattatacattctcataataaataggtaatctagatattcctattttaataataaagaaatgaattgagtaacctagctcgaaatcaacataaatttagaagactcaaacctagtactcaaaagtccttctctgggccatgttatgtatttatatttaaaactattgtattacaagttggttttcctaatttcaaaaatgtgctgtaatctcaatttttcaaatatttctttacttaacaggttgatttaaaggccaatataagtaagcacttagaagagttcctggcacacacacaaaaaaatacttaacaagtgtagctgctattaatgtgcttatataccataactataattccttctttccttctgaaatttatatatgaatgattacaattaatatcaacctttcagaagtgaaattccaaactactggactatacttatagttattgaaggtaagaaagttctgggaaattggcaagaaatctcagattttttacaaagcagagatttgcttgtgttagctaacttctcttttaaaacccaaaagtctcaagggagtttttcacacctttctgtaaaggctttctttggaaaatcattaaactccaacgtttggagatgagaagcagaaaagattggggttaaagaaaaggaaaaaaaggtaactctaaaccaaaacactaataaatagggtgcttgaaaatgcttaagcatagtattttatcaagatacattctgtgggtatacagaggagtgaagaaaagttgtcaaaactgaaaagaagctcaggaaagggaggcaaaagagcaggactgctttacaaccctgcttaggatcctgatgactggctgaaagccatctgccaatgtaatcttcatttgatatgactgggaaatcagaaacatcctttaatttcgtgatgacagataaagcctgccttacagtactgaagaaggtgcatgcaattagaggttatatgttatttcattcttccctaaaagtagggtaggccacaggaaacaaaagaaaaccactgcaaagtaagaggaaaaaactagtaaggaatagaatacaagatggctgaactcaatgttcttctatgctataaaaatgtcaggttaaaggacagaatatcatcaagcatctgatatatgttaacatattaagtaaaaaatttcaaattcagagaataaaagaggatagatacactattaggaaatgttacatcataaaagatggtcattcttgattagggaataatgatttggtctgagaagactccagggaaaaactatgatatatatgtcaaaggtgccattttatctgatgacaatgctactatttgctgaatataagcaaaggttctacgagtcttacataaatcatctcattatctttacaacaactcttaatacaaagaccaattagcatccccaatttgcaggtgaaaaaaacagttcgggagaaagtaaatgactatcagtggttggttaccagccagtggcagcagcaagattaaaagccacctcctgactttttaatgatcgccattctaactgctgtgctgcagaggatgtagagaaataggaatacttttacactgtttgtgggactgtaaactagttcaaccattgtggaaggcagggtggtgattcctcagggatctacaactagaaataccatttgacccagccatcccattactgggtatatacccaaaggaatataaatcatgctgctataaagacacatgcacacatacatttactgcggcactactcacaacagcaaagacttggaaccaacccaaatgtccaacaataatagactggattaaaaaatgtggcatatatacaccatggaatactatgcagccataaaaaaggatgagttcatgtcctttgtaggaacatggatgaagctggaaaccatcattctcagcaaactattgcaaggacaaaaaaccaaacaccgcatgttctcactcataggtgggaaccgaacaatgagaacacttggacacaggaaggggaacatcacacaccggcacctgttgtggggtgggagcaggggggagggatagcattagaagatatacttaatgtaaatgatgagttaatgggtgcagcacaccaacatggcacatgtatacatatgtaataaacctgcatgttgtgcacatgtatcctagaacttaaagtataattaaaaaaatatatatatatatatatatttttttttttttttttttttaaagccacctccaaccaaactgactagcaaatcccagagtgatttgggttgtgtggactggtacgctgcctctgcaaggccattagaatcctttcatgggagctttagattaaatgctcttttgaaaaaatactattaaagtttttatccctacttacataatgtctgtggatatcaccttagaagaaggcatcaaaaccgaatttttttaaaaagcgtattttatcttggggacatcaaaaacatgcttggcaaatacagtttttttaaaaaatgtgaacaaaaaaggtaaatgttgtcaccaaagtttattgccttatcttccttttaacttttctgtttttttcttttctatcttttccatgaacccaaatgagagcccttaattttctgtgttgctgaggctttttatagaagccaatgaatttgattcccagtgtctccatcacctgccttcctcccccaccactctagtgaagaaaataaataaataaatagtgtctgtcatttcagcaacattgccactgttagggggtgcagcaactattttctttcaactgtagcgctctttcatctaaatgacaagtataacaggcagcctgatcagcattttcactcaaccttggcttttagggtatttcgttatatgctatataaggccgaaatggtttggcacttatcctcacatgctctagattttatttaatactgtcaagaaaaaaatttcatcagcacaccaccgtggcttttagagttaacaaataagcacttttgttgtcaagtaccagaacactttttaatcccttgaaaacacatcttcttacaagtggcattaaatatatactcactacaccatttcgatttaacaaacacatcttggggaaaagaaagtattccattttacttattgtgcctatgtagaatctaaatcatttcaaatgcttgcactgatagatttactagtgatgtcttcatagttctatgttattcagctacacagtaagtattaagtaatttttctacaggtgtttatctcattttgagaaaatcacataaactgttaaaaataatctattaatccaatgccactgctgagctaaatgcctataacgaccccatagacagtccaaaaaatccaaggataattactaaaaatgttttaagttattatgaaaatgataaagaatgctgatataacaagatctatcaatttgcagatatattcatctgcccacttaaaaaaccagttaaggccattaaaatcaaataaatctatatgcttttaagataggtcattagtggcatacatgtcaacattctgctagcttctataaaccagaaacaaaacaaaattgggaactacttaagaaacattcagcttttgaaattcattttctatttgctttgaaagtcatctgaatataataaaactggttttaatttcggaaaacctctctctctctctctctctctctctctctctctatatatatatatatatatatatatatatatatacatatatacacacacacatatatatatgttgttttgctcaacgctgagttgggaaactgtgtgcttattgtttagcttaagcctgggctaatggcactaaatatttcaatgatttgcatgtgaagcacaacaaaatatatgattataaaaagcaaggaggattccaaatccataaagattagtaaaaatagttattttattctgttttagactaataaattgctttttggaaaaaatattaaatcgttttaaaaatgtgtttatttatttagagacaggctcttactctgttaccctggctcacatgcagtgatacagccatagctcactgcagcctcgaactcctgggctcaaacgattcttctgcctcagcctcctgagcagctaggactacaggtgcatgctaccacactgacataattttttagttttttgtagacccaggctggccttgaactcctggcctcaaacaatactccctcctcagccttcctaagtgctgggattacagccatgagccaccacccttggctggaaaaatactaaatcttaatacaaaaattagacataaagtagcataagttaaagatatcaatatataaggcatggatggaactagaggcattatgttaagggaaataagccaagcacagaaagataaatatcacatgttctcactcatattttggagctaaaaaaaaaagtggatctcataaagattaagagttagactggtggttatctgaggccaggaagggtaaggggaaaatcgatgaagggagattgattttaaaaattatgttaaagaacacagagagagccaggcatctgagttgtaaggcattttaaaactatagtgtacttcaaatatcaaacaaggagataaaatattgtttggcaaatgtaaatgagcctatgtggtagctttcagaagaaacagggcaactggaatcaatttaacaagataatctctaatgattccataagtgcaacagaagacactctaataattctcatgacttaagaatagccatgggtcatacataagagctggtaaatgttgataacgcttttggagtagattattagcaatgtgaggactgacaggcagttacattgcagttgtattcctagaaaaagcccaatcctggcaaggaaggtcaatgatattcaacctctaaaacaatccccaaaatgaagcccttataccaaaaagcagactctgctaaaatagtccagtccctgtatattcctccccagtgctccctcaaggaaagcaaaatccactagtcgaataaaacgggagcagccagattgctgaccaaaaactttgctccattgctggcgaaatgagtcaaaaaataaaggcggatgagattcacaactgctatctaaaatttaccttatttctctgtgcaagagggtatgttgggatagtcatcaacatagagaacttacattttaccctttttaaaatgaaaattttattgtacttttccctctacaactatatatctgatctatatggtgggggagggggttaaatttagtcatttaattgtagtacagtgataatcaatacttatgagggactagaaataagccagtaaagctcggatttagaaaccactgcacctgcaatagctggacagggttttgggctgcctctacaatttaagacaaaaagaaataaaacatagcataaaacataataaaaatcctttgttcagtttataagttactaccttccctttatcaactggaaaaaaaataacctcatgtaacacaaatcatatgaaataattttatgtgtcaacttgactgggccacagggtgcagagattaagcattatttcttggtatgtctgtgaagatgtttccaggtgagattagcctttaaactggtggacacagtatatagatttctttctccaatgtgggtgggcatcatccaatctgctgaggatctgaatagaagaaaatgcagagaaaggaggaatttgccctttttttcctgtctcactgctgaagctgagacagctcatctcatcttttcctgttgtcagtctgggatttacaccatcagctcccctggttctcaggcctttagacctgcaatgaattacaccaccagctttccagggtctccagcctgcagatggcagactgtgggacttctcagcctccctaatcacatcagccgatttctcataataaatctctttttggatacagatacatagataactcctattggttctgtttctctggagaacctcaagataccacatcaagaggaaatgaaattaattcataaggtaaatatagagtatttcttcatattttgagatcaatattgagattacaatcacttataaaatagaatacaaagttttataaactacctcattctggtaatagatggcaaaactatggttccaccatccacactccttttcccaaatgaggcaccttttttaaaactttcaaatttgacattacttaagaagctcattttaaaaagtgatttaacaacacgtggaggtcaaagaatgcactagacaattcacaggaagaaaagcctaagaagtccattaaccatgtatccaaaatgggtaatttcatatttaaaaagctagctaagttgaccatttcctactaaaaggaaccagaggtccttaaacaaatcgctgattctaattctggggcaggaaatatacaaaatagcctaggacaccttgttgtgccacaaggcaaaggatttgtcaaatattaatgggattgtatctaagggacataagacccttcttaaagagacctcactagacaaagtcgtggcaatttcggtaccacaaagaataatgcagttctaccttcatataaaaatgtagaaagtatcagggaatgttgctgtcattgtaacaacaataaaaagactaaaagttgataaccatttttgtactaatcagagagctgaggtaaaagacaaccaaatgaagtaaattccaaaaagttacaggcctcttcaacgagagatggtacaaactgctataattttggcaaagcatgggaggaagaggtagtcaacataaaagtaggtaagaagaaggccgggcgtggcggctcacacctgtaatcccagcacttcgggaggccgaggcaggtggatcactggaggttaggagttagagatcagcctggccaacatgatgaaaccccatctctaataaaaatacaaaaattagccaggcatggtggcaggcacctgtaataccagctacttgggaggctgaggcaggagaattgcttgaacccagaaggcagaggttgcagtgagccaagatcatgcccttgcactccagtctgagcaataagagtgaaacagtgtttcaaaaaaaaaaaaaaaaaaaagggggggggggtgggcaggaaagaagaatctgctaaaatttataaagaatttctaaataccagtattgggtgaatagatcaatgtagaaacacacgggagtttgcatgcacttgtaagctcttttccacgggcctctcccattgctcatgagagagaatacgactgaggcaaggtagaagaccagggggtagctctctaagtaacacaggcacacaggatatgatttacagttactgggaatggcaacaaaacagaaatcaaaatccttaagctgatgggagaggaacaccaaactctcattccaggtcctaagcaaatatcaacttgcacatggggaaagagtacgagcaaaactaatctaccgcaggaaaagggatagaaaatcctgtgtaccacccctaggacccaggcaaagatccactgcttctggggtagggtaaaagcaaaagccctttcaagaagacatgtcctgcactgatgcaaagaagaggtctgctactactgggagaaggataggaaattctttcctgtggatgccatgaggggtagaggcaagaacactgagaaagtccgtacctgaggaccatttcaatgggatctacttaagaatgaggatgaatcaggagaactgaggagctaccctatccaccccacaacaagcctggcactgagttaccaacaacagcaatctacttctggaaaaaaaaaaaaaaaaccagaaaagtacataaaaaaatgcctctgtggcacaggcatagagggtcggctagagagtagagcaagaacagtgagaaaaaacatccaccacccaggccaaattcttacagaagaatttgaagtttatactgtatttaaggtaataatagcaataacaaacctaactaagcttatctattgactagattgactgaactccccacactaactacctgacataagaagaagcatatacttctttgggcataaaatcttattcatatcccagcctatactgttctcctatctcagataaaatagaatcataaaaataatctaaaagaagcacataaagggagacaaagtacaaagaactgatgtgtagaataaaaaacagcaagaaggtagatttaagccaaccatataaaaaattacattaaatgtaaatgacctcaacaccccaattaaaatgcacagattgtcagactgggcatgaaagcaaggctctattatatgttgtccataaaaaaaaagttaaatataaagccatagacaggcttcttaaaataatagaaaaaatgctgcaagtaataatcaaaataatgccctcctgggatattaacatcagaaaaagtagatttcagaacatgaaatattactaagtataaagagggacattgcataatgaaaaatgaattcttttatcaaaaaaataacaatttgaagagtgtatgcactgtattagtttcctagggctcctataactaaatatcacaaactaggtggcttaaaacaatataaacttattgcctcagagttcttgaggctagaaatctgaaatcaagttgttggcaggttcatgctctctttgaagcctctagaggaggatctttccttgcctcttccaggttctggtaggctcagctgttccttggcttgcagcaacacaactctaatatctccttccatcgtcatatagtgttctctccctgtatgtctgtctttatatgacgttttcatacaagaacaccagtcatattggatttgggcccaccctaatgaccttatcttaaattgattacatcttcaaaaaccctatttatgaataaggtcacattcataggtacctggaggttaggactttaacatatctttttggaaacaaaattcaacccataacatgtacccaaaaataaacttgaaaacacgtaaaataaaaactaacagaactttggtgaggtggggtggcttacacctataatcctagcactttgggaggccaaggcagacaaatcacttgaggccaggagtttgagaccagcctggccaacacggcaaaacctgtctctactgaaaatacaattagctgggcagggtggcacatgcctgtaatcctagctactcaagaggcgaggcatgagaattgcttgaacccaggaggcagaggttgcaatgagccaagatggcaccattgcattccagcctgagtgacagggcaagactctgtctcaaaaacaaaacaaaacaaaacagaacaaacaaatagaaaaactaacagaactgaaagaaaatatagacaaatctaacttatagttggagacttcaacactcttctttcaggattcaacaggacaagtagaaatcagtacggatacagaagacatgagcaacgacatcttcaaccaattttacttaattgatatttatagaacaatacttaacaacagaatatgcactcttttcaaatgcacatggaacattaatcaaggtagactatattctgagccatcgaacaaattctcagtaactgaaaagaactgaaatcatacagcgtatgttcctcaaccacaatggaattaaactagaaataaacacaagaaagacatctgacaaatccccaaatacatggtaactaaacaacatatttctaaataatccatgggtcaaaaagcaatttacaagagaaattagaaaacatttaaatgggatgaaaataaaaacaatatataaaaatgtgttggacccagctaaatcagtgctttgagaaaaatttgtagtgctaaatgcttatattaaaaagaaaaaagttcttaaatcaatagtttaaagtttgcaccttaagttactaaaaaggaagataaattaaatctaaatcaaatagaaaaaatatagtatggaaagcaaagatcataggaattgaaaacagaaaaagcaatagaaaaataaataaaatctctaaccagactggtccagagggagaaaaagaagtaaatgccagtatcaagaatgaatgaagggacaacttagatgaaataaacaaattttgtgaaagatgcaaactaccaaaactcattaacaaaaagataacccgaatagcactttatctgttaaggaaactgaattcaaagttttacaaaaaaaccttcccagaaacaaaactcttggcctaaatggcttcactcatgagttccaccaaacatttaagggtgaaataataattgtatatcatcttttccaggaaatagaagaggaaaaaacaacttcaaaactcattttgtcacgtaagcattaccgtgatgccacaactaaacaatattacaggccaatatcctttgggaacatatatgcaaaaagtcttaagaaaatatttgcaaatgggatccagccatttattaaaaggataatacatcacaatctggtttatcacagaaaggaaacactatacaatcagccagtgtaattcactatactaaccaactaaaaaagaaaacgcaattatcttcagaaaaagcatttgataaaagtcaatacccaattatgatgaagactctcaacaaacttcttatagaagggaacttctttgggaggccgaggcaggcggatcacaaggtcaggagatggagaccatcctggccagcatggtgaaaccccatctctactaaaaatacaaaaattagccgcgtgcggtggtgtgcacctatagtgtcagctactcgggaggctgaggcaggagaatcgcttgaacccgggaggcagaggttgcagtgagccaagatctcaccactgcactccagcctgtgcaacagagcacgactccatctcaaaggaaaaaaaaaaaaaagaagggaacttaacctaatagaagcacctacagaaaagcctatagctaacatcacacttaagggcgaaagactgaatacttttcccctaacacaaaagacaaggcactctcagtacttgttaaccttgtatagtgcagtaagtcttcatttcacaatgccatttatgtataaagtcccaaaaagtctacaaaaaggctgctagtaataataattgagtttagcaaggatgcagaatacaaggtcaatttacaaaattcagctgtatttctatatactggcaacaaacaactggaattaaacgttttataacaagattaaaaacatgaatttttaaaggataaattaacaagatatgtgtaagaattgtatgctaaaagctatggaacatttgagagaaactaaaaaaggactaaataagcggaaaagacactatactaaggaattggaacattcaatattcttagtactttatttttacccaaaatgatctacagattgaatgcaatcctaataaaaaatctagaaggctttttaaaaattagaaattaacaggaagcaaaaagcctagaacagccaaacaatttttaaaaagaaaaataaagctggaggattcacatgactttattacatgatttactataaaaccacagtactcaagactgtgatactgatataaggatatactgattaattgtgaagaacagagtctagaaatagacctacacatatatggccgattgatttccaacaaagattccaggagacctccagagaaaaagtctttctaacaaatggtgttagaagaattggacttctacacacaaaaaaatgaaccttaactcttaccatgaacttacaatacattctagacaaaaaataagtagcattagcagccacaatacagaagaatagtaataattctgtttgatccaagttgtttttagaaaacccattaacaccattgggtcaaaataagtagatagtcaattacataatctaaatcagcagctttcaacttttcctgtaagacagtctctaatatatatacacgtacactatctattcacagatctcttgcaacaaacccacagtcccctcaagtgaccagagctcacaggttgggaacaactggcacatcttcatcttcctttctaccaacaagacaccagcaagtgttatacatttaacactgactaatcttaaacctcttttcttccttttcctgtacgaaaaattcaaccctaaatgtaagaattcataatagtccttcatatttcacttgaatatttcatgtgaatgtttcgatcaaaacgatttaaaagttttttttttctttctttgagacagagtctcactgttaccgaggctggagggcagagcacgatctccactcactgcaacctccaactccctggttcaagatattctactgcctcagcctcccaagtagctgggattacaggcacgcaccaccacatctgactaatttttgtatttttagtagagacagggttttaccatgttggccaggatggtcttgatctcctgacctcatgatctgaccgccttggcctcccaaagtgctgggattacaggcgtgagccaccacaaccaacctcaaaaatttgtattttaatttgtgtaaggtaagctacatggtcaatttgttatattagtgaaactgctgaacaagtcagaaactgggacagaattctaaaaagatgccctaaagaaggcaatatctcaagtttataaagacaattaaacaataggattgtatgatgatttgaacagttattaatgttactaacgacttttaattaccttgtctgtatttcagacaggtaacactcagattttaaaataatttactgagataggtcacactagatctataactttcccaatttactggcctaatcaaaacttttatttttcttttttaaatttttaaaaatttcaatagctttagggggtacaagtagcttttggttaagtggatgagttatatagtagtgaagtctgggcttttagtatacttgtcacccaaagagtgtaccataggtgatctttcatccctcgccttccccctcagccttctcccttctaagtctccaatgtccgttatgccactctgtatgcctttgcatacccatagcttagttcccgcttacaagtaataacatgtggtatttggttttccattcctgagttacttcacttaggataatgacctccagttccatccaaaaacttttatttcttattattaatttttttggtgttcagtgttttttatttttttttattgcttactccagttttattttattttttattttttttattatagtttaagttttagggtacatgtgcacattgtgcaggttagttacatatgtatacatgtgccatgctggtgcgctgcacccactaactcgtcatctagcattaggtatatctcccaatgctatcccctcccccacccccaccccaccacagtccccagagtgtgatattccccttcctgtgtccatgtgatctcattgttcaattcccacctatgagtgagaatatgtggtgtttggttttttgttcttgcgatagaaataccatttgacccagccatcccattactgggtatatacccaaatgactataaatcatgctgctataaagacacatgcacacatatgtttattgcggcattattcacaatagcaaagacttggaaccaacccaaatgtccaacaatgataggctggattaagaaaatgtggcacatatacaccatggaatactatgcagccataaaaaatgatgagttcatgtcctttgtagggacatggatgaaattggaaatcatcattctcaatgttttttaatttttaatttttataggtacatagtttgtgtatatacttatgggatacccaagatgttttgatacaggcaagcaatgcataataataccatgtaaaatcaagtgtctaccccttcaagcatttatcccttgtgttacaatcaaattatatttttaattatttttaaatgtacaattatattagtgttgactatagtcaccctgttgtgctatcaaatattaggtcttattctatcttgataatttttttttgtactcattaatcatccctacctatactccattccctcaccacccttcccagcctctgggaaccatccatccttctactctctatctccattagttcaatggttttgatttttagatcctcacaagtaagtgagaacatgtgatgtttgtctgtctgtgcctggtttatttcacttagcataatgacctctagttctatccatgttgttgcaaataacagtatctcattcttttttatggctgaatagtactccattgtgtataagcaccatattttctttattcattcatctgttgatggatacttaggttgcttccaaatcttggttattgtgaacggtgctgccaacaaacttgggagtgcagatacctctttgatacactgatttcctttctttagggtatacacctagaagtggaattgttggatcatatggcagctcatttttagttttctgagaagcttcaaaattgttctccacagtggttgcactaatttatgttcctaccaacagtgtacaagagttctcttttcttcacatgctcaccagcatttggtattgcttgccttttggacataagccattttaattggagtgagatgatagctcattgaagctttgatttgcatttctctgatgatcaatgatgttgagtgccttttcatatgcctgcatgccatttgtatgccttcttttgagaaatgtctattcaaatcttgtgcccatttaaaaaattggattatgagatgtttttcctatagacctgcttgagctccttacatattctggttattaatcccttatcatatgagtggtttgctaatattttctcccattctgtggcttgtctcttcagttttttattgtttcctttgctgcgcagaagcctttttaacttgatgtggtcccatttgcccgtttttgctttggttgcctgtgcttatggggcactactcaagaaatctttgtgtagaccaatgtcttggagagtttccccaatgttttcttgtttcacagtttgagttcttagattcaagtctttaattcattttgatttgatttttgtatatggttagagataaggttctagtttcattcttctgcatatgaatatccagttttcccagcactatttattgaagagactgtcttctccccagtgtacgttcttggcacctttgtcaaaaatgagtccactgtaggtatgtggatttgtaaaatcttttctttttaaagtaaataagttaatgcagttcaacgggatgtgtatcccagtaaaactactgattttcttttcctctaaattaaaaaaactatttgtctattctaatttttatattgctcccacaataatatgattttgtttgcagaatttactcctttccacttccaaaaacttgcttcaaatgataaattttggattcacactttttaaaaaattccttttctgaaagtaagacaatctaaaaattaagctactgaaaaatgttgtcttattagtcttgtataaatgttttaaatataacatgcatgcaattataaaggtctttaaaagtacgaacaatttaactcacttttgtttctggaagagtcctcagaatagtgtagacaaaagatgcccagcaaatacttaacaattatttgaacaaacacattgaatagaacttggagaatagaattggacaggaatttgaacataagaataaaatatatttattacattatccactgtaaaaaagcatagtacatattcacatacaaagtaacttttaaaatcataggcaagataagaatcagaagttgatacatgcaagtatattttaaaagctacaaatgcatacatgttttttaaatgtccttctactaaattcactttctataattaaaaaaaaatagccaaatcaggaggatagttactactactaattaaacttaaaaaaaatttcctaggtgttttgaaaatagttcctatgtaaattcacagtagatattccctactctaaacctacctcagtttgtacacccagcaccaaacaaatacaaagcattatgggataaaattaataatgctatgcaaataaaacaattcatttataaataataataaatagtcactccacatcacagtaacttagcatgattagagaataaatacttaactttgagaaggattactgactggcagtgtgttgctggtatatgtcaggattattcatcaccctgacagtaatattaaccacaatccatttcagttgcttcagtttatcattttctgactaatgttaaaaaacaatgtctttggaggctgcttgaattaagtgtagaattaacgtctgttagagtcattcaaaaacttctattagaagataacttctacagaaaaccaaatctgctatacagagtactaatgcttaaaagatgtaagtttcgaaacacagccatacaaaataaatggactaattctgttttaaaagcaaaacttcaacaaatcctgtaaatgccttataacatccatatacatatatattccttaaatatatatgcttccactttcctgaacttagtattaaattctacataaagagttgcacagacacattttaaactaacatgccacattgaacacgtaataattcaatttaaaaaggtcagtgtacccatgaaaaattttcttcagggttatataaattaaatagctacacagtttgctacctaggatcctcaaaattaagtaatctgctaaaggtctctctacttataaatggtaacaggaatatacaactctatctaaatccaaagattccctgctctggtctaattttatctttccaggctgttttctccacatcatgttgatattccttttagaagatatctgcatttataactcttctattaatttttatactgctctttcttgttttatgattattcactttccatagcataattttcttgttctattaatgcaatagtttccctttatctgaaaatatttattctagtttttttttttttaaaaaaacacttctgtttcataaattgcctctgtttcttctggttttgttttgattttctatttgctttggtctttgtcatctttcacattagaggttgtctttaaatgtttgctaatacttggctgcacctccatttttaagaatgagacactgaagagctgactgagcatatagaccataagtagtgatgtgaactggtagacttcactgaagggaaatcaagtgggctcgaagtagaatccctaaatgttttatttttttaggtgttttcttttgagccagtgaatatgtccaaagagtaatacaatcttctgtcttatggggtggggatggtataagcttagctgccgcagttctaatagcatgacagcagaaggggtctaggggctttcacgacttggtacttaaagctttcagttataatcctcctgttttccatcctttaccttaaaccctccttctggtgtgcttggtgttctcatatcagaaacgtgtctggtaaaatttctccaaaaaagtcaatctcttgctttttgacaatacagagggaagagtagttggattttggaatgaagcagatataaagcaagtattgaatttaaaatgttctttcagattatacctaaagtctaccagttgactgacagacagatttgagatcaaatcctgagcttaccacttggaaaatgtgtgacctcccagaattctttaacctcactaaatcttagtttccttatctgtaaaataaagacaataacacattccttacagggttattgaaggaattaaatgaaacagcatatgtaaaatgcctgtcatagtggaaagcacctattagggcttccctcacaatcctacaaatacgttgggaactctccccatatcatttttatgcttattagactgcaaactttccaaggccagacaatgtaatttatatcataatctctaaaatcaatgtggcatacaacagcatccatgtttgatgccaagattaaactattttaacatattatgtcagccaataaaacatatccaaaacataatcaagtatggggtaatttttagtttctttctctgcatttatattttatttaaacaatttaagatctattatttactgttgtagtatcataagatgtgtttcttttggtaagcttgaattcctttagcttcactgaagcccaataaatagaaaaatgaagtaaaagccataacacctaacaagtttaaacaatattccccccacccccaagagtgttcttttccctctgtgacatctagatggtatattgattcccagtgtatctgttacagagcagactaaaaggactggcattcatcagaaacagcacttaaaacttaaagagataaagaagtgctgtctgatcaacaacagttaaatgtcggtagtcaattccaggtcaagatgcatgctgtatattaaatgtgtgtgttaaacagaaatatctcacacataaaaatatacatccaaatggtaggagatacatgaaggagagaaaaaaaaatcacttacttttcctgaaagagagagcgagaaacagaaacatatactaagcacaaacaggagcaactcagcaatgaataacaaattcactatggttctgtcactcagttctcttcggttttgtcagaatctactctttagaactatttggatccaaactagggcaatgtaaactgctaggttaacagagtgtgaatagtctagcattgtaacataggtttaaaaacaaaacgaaacaaaacaaacatgatttcttagagcttagacaaaaatttaaaattcagttttagtcaattttcctctgattcctatgttgcaagataggaatcaggagatcatggtgcaggttcattttcttctactctttattttcctgtttctgcactatggaccaaaataacagctcattttgtggttacaatctaaagatgaaaaacagatttttctttaccttgttcctcaaactctctattttccttcattttaaaaatgtgagttgtaattattaaaaagtaagtatttgctttatcttggccattcctgtttctcccaaatcttcagcttattcttttactaggatagtaatgacttcattttattctttcacatcttcagaaactagcagtccatggcatattacagtactcaattaacaaccaataaatgaatgaacaaatgaataagcagtaacactggggatcctctagttttaaccgaacattcagctttttttgtaaaataggtttaatcaaaaaaggctggagcataacctgggataaagacaacaagagtagggcaatttgaaaagaaaaaaagctttcctttttcaagcaatagcatgctgcttgtaggtactaggtacttcagcatgagaagtgaaaggcaacttcataaataacattaaaacagaaccagcaactggtgccaaaagtggaaggcactattggcatattacagagtttctcaaactttctgggccaaagctcacgttaagaaatatgttactttaaaaaacacacatgtacatacactcaaacaaattgagcagaagatttatacaatatgcacagtgatggtttcttttttatgttatgctacggtatcccattcattttttaaaaacgcaattgtgagctacaggttgaaaacttagtgttcaaattctgattctacctacgtgcaacttgacctcatggtgcattagtttctgcctctgtaaaaaacaataatgttacctacttaaagggattttgtgaaggttaaaggaattaccacacacaaaacacttagacaaatgcctggcatatagtaaatgctcaataaatattagttaacaataataataaagtggatgatcctgtcttgtgaatttcatagccaagataattgggttttcattggcaagtggaatagttatcaattgcatttcaatccaagaacatgctggtttttttaaaaggtacccagattactatacaaatacatattatatattctaaaataactacactggtcaactagaagaaacatgattgcctcagattgtcttggtttccctctctcagaaaatctgttttacacaatcactttccaaagtaaagaaaaaataataaatcacaggtacaaaggaaatcatcctaatctacaaaggaagccctggtactgaaaaactcagccatcataatttacttttatggtatgacattttgtaaatatattcctgcgctgattataaattcttataaagaaatgtcaaaaagaaaatgttgaatcttatctcttccaaggaggttgtcaaaatataaaatcaatgtatgtttataaaatatggattaatgtcactccaaattctatgcatggttagatctgtcttctcatcagtcagaatttcagactactgatgaaataactgggaaagtagagggaaaagaaatcaacctcaaaattgattcctatttttttcagctttgaaagaataaattaaaccattttatgctaaatgaggacttttgcaatacaagaaaagatttaattttcaccagtctttcagaataaaatagatttgatcttctcaatgtacttatgatactaatttggaatgattataaagagatatattgtacatggaataaaagcttatacatttaaaaagacattttttacactgctccattcagactttttttttcttaaaagaagatcagaaaaataatacagaagaaaggatgctgattacattaattcagcttcagaaagagaattcccagtgcaacatggaagagattaccaaataaaattgtagctttgtatcaaaggtactaaaagtcctctgaaaaacagctttggcaaaattaaatagatataaatatgcataaataattcaatacattttaaagccagtcaggcaatattatccacttaagaacggagataagatctgtttgtattctacattaagctatgcatacaatgttttctaagatttcacaagtttatttaaacaaacagtaatgtttacaaaatgtatactatgggacaaattttaatacaattctattataatcattatttgtacagatagagctcatttatatatgagatgtattcttgaaaatgtgtgtataaacaaatatttgaaaactgaatcacactgtaaacattttggcaagccttaatactaaaaggaatgaggtacttttactaagtaaacaatcaccgctattttatatgtgcaaagtacaattttcaaatatctgatgtgcttgattatttcactaaatgcagttgattccaaactcacttatttcatcaatatttaatgaaagcaattagtactagtagaattccattctcatgaacctgaatgacttttgtagcattcacactaccattggtttataggaaaggagatattagttgtaaggcggtagaatgttagagctcctcacttctccccagacctactaattacactactgttcattattcaactgtgtgcccttcagttcttgttgaaagcactttttataactattccttcctcagccaaaagggcaaatatttcacaaaatttctaaaaatataaaaatgaatgccattacaattgaagtcacaaaattacacaaatgacatttcttatgtctttgtttagtggatgtggacatatttggatagaggttaatgaaagcaacagttttgttttgttttgcagcccccccttttttacttttaatgtagcaaaataaaaaagcaaaattactattgatcatctactggggcataaggtaaccttatttctcatatcctgaagaaaaggcattagttaaaataatattttacccacccaacaaaagtatttcacaagttccttaggtacagctgtaatatacaaataaaatttgattttaataaaggattctgtttagctggccactaatctacaatagcatttttctgatataatttcaatgaacattcataataaaaatcatacagcctacataataaaaatgtcctggaggcttccttctggtcatttaacatttttagtagaataggtaacaaagatgaggggcagagaatggaggcagttggtaaaaaagggtggtgttaggatgaggtaaaagggttatgagaacttttggtcaggtacaaagatggaggaagagaaaaacatatcctcaaaaaaaaaaaaataacctcccacttgtcaccattaggtactgtttcatcaagactgaatcatgagtccagcccgagtccagcccacaatccatcttagtactcatcacatcttaaagagatttctaaaaactcatctaaagcacaaaaaacatctgaataagctatgtgctgaaatagagtccaaactgtggattcagccctgaaacagaaggcaaggcaatacttctaggaccctagaacacgtattcatatatatgtcattcattttgtgaagcaaattttatattctaacaaaatcaaccccccaaaaatgatatttttacttttgcaaacacaaaattcaaaccatagagagagagtagggtataatagcctgaggattaaagagctgcccagtttttattattgacctactgcatggctcattacacaagtcaaactaatacagtcctcatttattagactacagagctctacagattccataatactatggggtcttagaacaaatatgataccgaggtgtaaggccttccttttcttttcaattttttttaaaccaaccatttatcattcctcatggtcaatgggtcaattgggaaattctgctgatctgggcctggctttgttgctcttagttggactccttcatacgtttgtggtcagctggcaggtcagctgaggactagcttgttaaggatgacctaagctgtcacagctcaagtgtcctccatgtgtcagtcacaacccatcagcaggttaacttgggaatgtttagggcatattctcaaagtgatcacagagaagcaagagcagaaacacacaagcactttttcaaattgtttctagtttgctaactttttttttcttgctggtttctcttttattaatggtggcaaaatatacataacataaacgtacagttcggtagtattaaatacattcacattgttgaacaatcatcaccactatccatcttgagaacttttttcaacttgcaatcctgaaactctatacctattacatgaaacactaactcctcattctctccctcaccccaggccctggcaaccagtattctactttttgtctctataaatttcacaactctaagtacctcatatgaatggaatcatacagtatttgcctttttgggactggcttatttcacctagcataacatcctcaagggttattcatgttgtagcatatgtcagagcttccttcctttttaaggctgaataatattacattgtatgtatataccatattttgtttacccatttatctgtcgatggacatttgggttgtttctatctcttagctgttgtgtgtcacgctgctacaaatatgaacatgggtgtaaaattatctgttcttatccctactttcaattctttttaattttttgagaaactaccatactgtttgacatataagctgcactatcatactttcgcaccagcatgcacaagggttccaattttccacatccgtgccaacacttgtgattttctgggtttgttttcattaacaatcttcctaatggttgtgaagtggtatcttattgtgattttgatttacatttccctaataattagtgatgttcattttcatctcattggccacttgtatatcctctttggagaaatgtctatcaggttctttacccatttttgaatgttgttgagttttaggagtctctacaaattcttgatattaatcccttattagacatgtgatccatgaataaggctttcctctgaaaattaaaactcccttttagagttcagtaagtagatatagaaactggtacaatttcttagctctaagcactatatcaggcacaagagatacagaaattaacaaaacaaaatctttgtattcaatgattttgcttaatagggaacacagagaagaaaatgttaaaattataataaattatgaaatgtattataacaagtatatggaaagtaccctgggagttcaaatttctagataaagaaaagagccaacagcaaaagcacaagaggtgaacatgaggcatcacaggatcagatgatacagcaaagatggggacagagacagaagacgtggtaataaaacagacaatggctagatcctaaacactattgtttgtcatgaggaaaatgttaaccttcgttttgacatcctcggtaactattgtgattgtctgaactgtgtgaagatcctatcctgtggatagagagtaggaattactcctgaacatcttcctggaatgagtaaataagagaacacactcttagagtccctgagctctaagtaaaggacactggatatgttgagtgaacttgtacttctcatgctgggatctgcagacactgggcaatgatcttctgactgagactgtgaatcactgagagccttgcatttctgctatgattgggtattcagtggagctttacataaacacttacctgtggcctaagatggatttagaagagttaagggaaatgactatgtatacccttgaaaaaagttagtactaacagcaagaaatctggtgttttgagaatgtaagagtgacatacaggaataaaggaccaacactgggtcagggtacagacagggaagaagcaacaaaaagtctccaggtcaaagatgtagaagacataaacatttgttagctgttcctagaaattactaaggaaagaagctttaggaaaaagactggatattccactcacctaaaaaatgagggtagagactttgtactcagacattaaaggaaatacaattctgaatataaattggaggaatcagtttgaactcataatgtatttcatcctaatttttttcctagcaccctctaaaaaagggatagaaataatgacaaattcagtagcaataagcagaatagacaaaactgtgatctccagatattaattcccactataagaggtcccacccgggctcctcaaagaaacagatgattctgtatctgggccagaaaatgtaagggttaagactagagtgcctggtcataccagagagcatgaaagttatcaaagactacaaacagtgtcaaaaatgtcccagtaataacttcaagaagctcccccggtcaaagaaagaacaactgaacatcagtaaataactgcaatggattgaaacatcaaatacattgaaatctatgagttcataaagatacttttttaatagtcagtttgataccattggagaatgctaggaatcaactcaatattttgaaaactgttatgtaaattaacagaaaagagaaagaattaaacttctatcctgtcttttctctgcaatgtaccactggataccccagtagtagaagagaggaagtgtctctttatagaatgagtcccataaataagtgaaataaaagtgatattttaaataccacaatttggcaatgcttactaaattaatgaatccatgcactgaatatcagtgctaacatcacaaaagagaagtagtgtttatcatgcacattaaatttttccatttgaaaatctgtttaagagataattatattaaaggtacgactatatttgaaaaaaatttttaagttaagtaaaataacgaaagacaatccaatttatttttatatgcaagacaattatatttcacatcattactgagaaattaccttggacaaatctctgaagttggtgggcaaggtaagatccagttcttctgattcataattagtgatgacccaaggaaacactggatactgatttaagtcattataactccgtcctgatagggaaaaaagttactcgtaatttataattttaaaagtgaaataaacagattcagtaatataatttactaaaaataagattaaacaatttttgattgccagacatcattctcagtatccatactttctctcatttaatcctcacaacaatcctatgaaattgtatcatctccatttcacagatgaaaaaattgagtcacaaaaggttaggtaacttgccccaaatcacacaactagtaatggtcaaaccatattgaaatccagattttctggtcctaagtttgtgttcttttaaactacatttgataattttttttatcacttgaaagcctgccccaaataaaatactcttttttttatgactttaaaaagctatttgtaattctcacagtttttcaaaacaagaatcctttctctgccattaataatcaaccaactaagcaatcaagtttaaatgacttaaccctggtggacattcaccagtcatctataaaatgagggcattgcactaaataattctgaaatgtctgtggtagttttcaaatcctataatcctctgaaaataatgagcagtattatcaatgttgcttccttacatgcccaaatgtggccacatgctcttctatacatctttctaatgacattttcaatgacatatttagatttattaaaaatacaaattacagcaaaagaggaggtagtccttctacatatgtacagcagttttttggatattacctttttagggaggtagcatagtgggtgagatcattgtttctggaatcaaaatgctggtgtttgaatcccagttcctatttactagtctatacatatttttagttagatttaacatgaacagacttttacggtgaacatagagacaagtatattaatattgtttgaattcctttcttattatatattctatcatttccattcctttttctttctcaaatatatactgatgttatatcaatacgtagctgaatattaaagtagttctctgtacatactcttggtatctaagccttttttaggtctgatgtttttaactttttattttactctattcatcttaggcttgaggcctattagggtaacagagttcatttttggctgacctggaacagtcttataaaacatcataacaatgacatttttaattcatagatcattaatgtcactacatatttctatcaataattttaatttctccattaaaaaaaccaaacatagcagcagaaaaaaaaattttatgctcccccacttccttctccttctgatttaaatgttggtaaacagtaaaatcgtcttgtcccatctacttaaataatcagaaataattttttattgtacctaaaaaatgaagagtatggacctgctcagtgattagacttaattaagttaaactcaatacacagttattgaatatcaactgatggccatttgggaaatgcatcatgatatcatgtttatctatatgtggcacaaataataatgtaaaagaaatcttaagtgagacttaactccatcctctaatgcacatttaaaaaatctaaagcaaatgatagattctatatttataaaacatatacagggaatatacttaaaggacactgcaggcacaataaaagctatttgagaacacatgatttcataaatgttgctccataatcataactgtgcattcaacatgggttaattgatttactacatgcaaaatatgtccattaaacttgttatataagtttcctctcactacttaaaaattcttttagtcactagttctataatttctactaaattcaacataaccattgacattttcttcatcccttttcctcagctgactgtgagataaacttctaataaaatttagaactttcaatgtgagcccctcaacttccaattctttgcaacatcccctcactctttcccatttctctaacagggtcttttctttgctaagagtaattgcttcacctgagctctcaaacctgtctccctcataacttgaattgttacttttcttctctcctcctcttacatcatttctcctctctgccccaacccatcttctctttaataacacatttaaaataaccataattggcagggcgtggtggctcacgcctgtaatcctagcactttgggaggtagaggcgggcagataacctgaggtcaggagttcaagaccagcctggccaacatggtgaaaccccgtctctactaaaaatacaaaaattagccgggtgtggtggcaggagcctaaaatcccagctacttgggaggctgaggcaggagaatcgcttgaacctgggaggcggaggttgcagtgagccgagatcgtgccattgcactccagcctggggaagaggagagcaactccgtctcaaaaaaataaaaaagacctgtaattacatctacagttactatttcatttccaaccattcattctgaagtctccctctccactctgtaacatttgacacaggtgaaaatgccttcctccctctttcaccttgcctctcaagacatctgacttacctcagttctcctactatatctgcacattctaggatcactcattcctttttgtcctttactaactttccttctctcttctcatatgcaagagaatttccctgtcttatctcactgctttctgtattatcttccttgctgatctcacatctcttggtgatttcctctctatgcagatgaaatccaatgtcctagttctaagttccgaatatcctccttgacctatacttccaaaaactctgataccttaactagaaagtctgccggcacagtaaaatcatcatctttccctagatcaaattttctgacttctttttccattaattgcaccaccattttcccactaacgcaggccagaagcctggaagtcttttcagatactttcttctcatttaccacctacattcagtcagctgcatatcaaatggttggtgccttgtgaattcttatagaatttgttccttcttttttaattcccactgatacctaatggaagccctcattactacacacacacacacacacacacacacacacacacaccacacactaaattacttcctaactttactttctgcctagtctctagccacccaaatttatcttacacacacagcctccaagttaatttttgatgcagctctaatatcacttaggtgctcaaaaactttcaaaagtttcccaatgaactgacgctaactcttcaaactgacaagaaaatcgttcttcgcatttctaacattcttattttttcccattatatctttatgaatatatacttcatgcacacaaaaatatacagtatatacatagatatacaaactataccattcttgctctctaggtatactttatattttcccatctttgtatgtttgcttatgctttcagtcttacatggaatgacatctaacattccaaccacctcctctgctagtcaaatagtatccatccttatacaaccattgaaaccttattttctccttactcccaccaactgggtgaatataatttccctctctccctgtccttttaatcaccacagtactttgagttttttactgaatctatatccccttgctctagaatcatgtaaacattcacatttgtacttaaaatgacttctatgagagtaagcaacataccttattctctttgtatatcctttgtagtattctagtagcaataacggcaataaaacaagctagttataccactacttaaaataatctaacaattgaaattaataatttattgtctaaaataaatcaatacatggaattaggttacctgctatcgtgttgagaaacatcaagtactcaaaattagatatctctctgtgttgccatcgctgggtcatattagaagccttaaaaagctgacgtggactagctaatgaaatacgtctgcaagaaaaagaattcaatgtgatatgattaattatatcacaataataaatcatgaattatctgtgcttattcattcataatatctataattctgaaaagttctattcatgttagactaatgaatactagagaggtttcaatctacaattcatggttaaacaaatgatttagactagccacagaggtattatacatgttgtattcattcaggtaagctgtcattacagtgccattataatgtacaggttcaataaaagttgattaataacagtataattaataattcactgctttaatgatataaaaagaagaaattatagcagctgggaagtgcatataaaattctattcacatgtctttattaattgtaatagttatcttaaatgaacacatttttacattataaatttaaatatatttgcatacactttgtatcaaagagaagggagactctaaactatttgggcgtctgttcatggggtaaagagaaatttttttaatatagcttaatagaagacaaattttcctgtagcctcctaatgaaatgtaaacatcagtgaatagaactgatcaatacaaagagtagtgagaaacagatggcagaattagttattacattcaaagcctagaatctcagagaaataggctgtcacagttctttctaccacaaaaaacaaggtaattattttgtaaaaggttcactgaagtataattttcatgccataaaatttattcaatttgtacaattcagtaatttttaaaaaatatttcaaaagttgtgcaattatcacaattcactttagaacattttcttcatctcttctcggccttttggctaaaatcaagtgtagaacattttcatcactacaaaaatttgccttgtacctatttacagataatcttcattcctatccccacctacaggcaactagcaatctactctgtgtctctagtaaacccaccttttctagacatttcagatcaatggaatcatacattagtatgtagtcttttgtgtcaggtttctttcactaaacataatgtctttgaggtttatcaatatggtagcatgtatccacagttcattcctttttattgctgactagtatcccactgtatatagaatacagcacattttgtttatctagttgatggacatttaacagtttttgctattataaataatgctaccataaacattcatgtatatatctttatatgaaaatatgttttgatttcttttgggtagattcctaagagtggaattgctaggttgtatgttgagtttatctttaattttttgagaaaccgccaaattgttttccaaggtggctataccactatatgttccaatcaataatgtatacattcatctccacatccttgccaatacttgctcttgtgtgtattttgattattaccattctagttagtgtaaaataacagttttaatgtatgttgttgagcatcttttcatgtgctgattggtcatttgtatatcttcttcggtgaaatgactaatcaaatcttttactcatttattgagctgtttgcattttatcactgagttgttagaattctatatacattctgaatacaactctgtgatagttaattttatgtgtcagcttgactggattaagtgaccttagagagctggtaaaacatgatttctgggtatatctgtgatggcatttccagagagattagtacttgaaccagtgggcttagtaatgcggactgctctctccagtatggtgagcatcatccagtcaattgaggactgaatacaatgagaaggagaaagggtgaattccctcttctgctcaagctgggaatctatattctcctcctcttggatagcaggagctcttggttctctgtccttcacttcttaccccatccctctctccttaggccttcaagccttgggctcagtcatgggctcccctggccttcaaattaggattgaattacaccactggctttcctgggtctccagctgtagatggtgtattgtgggatttctcagcctccatggtcatatgagccaattcccataataaatctcctcttacatatctatacatatcctattggttttgtttctctgaagaatgcagactaataaaaagtgctttatcagacacatgatatacaaatgttgtatcagtctgtggcttatttcttcatttacttagtggtcaattttgaaacacaaaagttttacatgttggttgagtccaatttctcaattttttcttctgtggattatgcttttagtgtcacatctgagaactgtttgcctttcccaacatcagaaagtttttctcctatgttttctttctgacattttatagttttacttctcacatataggcctataatatattttgagttaatttttttgactggtatgtggtaagcatcaaaattttcttgtatgtaaacatccaattttgtccaccaattgtttaaagcctatcttttcctcactgaattgtgttggcacctttgctgcaaaacaattgaccgcaaactcaaggatttatttctgtattgtcaattctcttcctttaatttatatgccgatctttgtacaattaccacaattgaagactgagtacaatgaaaatgaggaagggtgaattccctcagtattttgataactgtggctctacaataagttttgaaatcaaggtacatcttccaattttgttcttatatttcaaaattgtttcagctactctaggtccattgcatttcaacttcccaatttctccaaaaacgtctatcaggaattgatagggattatacagaatttacagatctagggaaaactaccctattaattatattgaatcttctgatccatgaacatggaatgtctccatttattaaggtctatttttaatttctcttaaaaatgttttatacttttcattgtacaaatcttacacttctgtgatctgtaaagagggctactttctttcttcattcccagtgcagatatctttaatttctcccttccttcctctctttcttccttattgcacaaactaacatctccagtgtaacgctgaatagaagtggtaaaaatgggaggacatttttaccctcctaaacttagggggaaagtattcagtctttcaacattaagtatgatgtacgtattgggagttttttggtagatgatttttgtcactttgtggaaatttctttagttgaaagttacttgagagtttttaatcatgaatgtgtgttgaatttggtcaaatgcttttttctgaaatgatagtaagctttttctcctttataaatactggtgcatgacataaattgattttcatatttaaattaactggcattccagtgataaaacccacatgaacattttataaatcctttttatatactgctgaatttgtttcctaaattttgttttaaaaaaatgtgtctgtgttcaggacggaaattggcctatagcatttttcttgttagttttcctgtaatgtctttgtctggcagtggtattgaggtgactgaccttatagaatgagttgcaagtgtttcctccctcctatcttctggatgagtatgtgaaagatttatatcatttctagtttaaatattttattgcattagccaggaaagacaactgggtctgggcttttctttatggaaagatttttaaattaatagctcattttatttatgtgttataggtctattcaaatttccaatttctttttgagccagttttggcaattctgtttttctaagaatttgtccgtatcatttaagtatctaatttgttggtaggaagttgttcatgatattcctttctactccttttaatttctgtaggctcaggctgggcttggtggttcacacctgtaatcccagcactttagaaggctaaggagggaggatcacttgagcccaagttcgaggccagcctgagcaacataggaagaccctatctctataaaaaaaaaaaaaaatcaaaatattagccagacatggtggcatgtgcctgtagtctcagctactcaggaggctgagatgggagggtggcttgagcccaggagtttgaagctgcagtgagctataactgtgccaagtgcactccagccagggcaacagagcaagatcgtgtctctacaaaaaaaaaaaagaaaaataaacaggaaaaaagattctatatgctcaatagtcatgtctctactttcacttctaatttaagtaatttgtgtcatctttcatggttaggttaaagtctgtcaattttactgatctttgcaaagaatcaacttttgtttcattgatcttcttcagtgtttttgctttatgtttcattgatttttgttataatcttcattactctatttttctacttgctttgcatttagtttgctctcctctactgtctaacagtagaagcataggttattgatttgaggaatttatttcagatatgggtgtttaaagctgtaaattttcacttaatactactttagctgcatctcatatattttgatatgttatacctctgttggatataagcatccaaattagtatgcttctcagtcccatgggaggaagagttgctggccacagaagtaaccaaagcactaatagctacatggcagagacatggcagaatgtgtgaggacaaaaagaaagatgcccccaaacccaggcactctctaggttctgggaggtatacagaggaggaagtggtgcagaccaaggagcatggaatcaaaaaaaatgaagccccctacaccaccaccactctagccacacagcctaagctcactcccttctctgtacctctctaagcttctaactgcaaaataacatatctcctggtagctgttataacccctgatatgcatgtattaaactccttggttagtgctcctatagaaaaaaggaaatgcctgaaaacaagtgatagggttaggcaaaacttgcagtgaaacagaaaaactaaaatgaaaactattgttggtggcatctttgggctgactcaatatatttttgttacggcttaaaactggtatctgtgtgtatatgcttgtactgtaagagctcctgggtgtcagaaagaatattccagatcaagaaccaccacaggtagaaaactgataacaggactaattctcttgctgattgccatcagtggtgagtcaggatttagcacaatagtccctaccctctcacgtcctactggctgacaagtcagaacatttggtcttaatggccctgacttgtagtgttctcacaactaaaccaaaaggagtagctcataaatgccaacaaaattcagggtcctgcttgccaagtaaagcttcttgatattgtgtgggcaaattcacaacattcaatcctctggaggtcaaaagctaaatgtgatggacagttttcagtctatgtcttactgatttctcatcagatattttcatgtttaaaaactaccatcccttggtgatatggtttggatttgtgtccccacccaaatatcatgtcaaattgtgtattagtccactctcacactgctataaagaacagcctaagacggggtaatttactaagaaaagaagtttaattgacttatagttccacatggctggagaggcctcaggaaactacaatcatggtggaaggcaaagaaggaagcaccttcttcacaaggcagcagtgggggtgggagaaccaagaaaaaattaaaccatcagatctcatgagaactcactcactatcatgagaacaacatgggggaaactgcctccatgatccaatcaggtcctctgttgacatgtggggattataatttgagatgagatttgggtggggacacagagaaaaaccatatcaaattgtaacccccagtgttggaggtggggcctggtgggaggtgattatatcatggggtaaatttcccccttgctgttctcatgacagtgagtgagttttcacaagatctggttgttgaagagtgtgtgacaacccccctccccgcttcttcctcatgctcctgccatataagatatgtctgcttccccttcaccttctaccatgattgtaagtttcctgaagcctctccagccatgcttccttatagcctgaggaaacatgagccaatgaaaccccctttctttataaattaccccgtttcaggtatttctttatagaggtaccagaaaagactaatacacttggcatcatattttcctggatttcctgtcttttgagccactcctgtttttgctcttagtgttgttgtttttgggagggcagggatgtcctgtttcccttacctaacctttacatgttgaggttttctggatgtagctctagttcctcttggcattttacaatctctccccagatgaactcattccctctcatggcttcaaatttcatctacttggtagtcattctcaattactaggcctttcttttgagctctcaacatacctccttatatctagcttcctattcaacatttcaatctggatgtctctcaggggttctaatttcaaggacctaaaattaaactcattttctgtccctccacctcctccacacaaccccagccatggggatggaaggatgtttatacaaatactgttcgtccattattcctaatcccagtaaatgccactgagcagctcaagctgagacttgagtattgactaaagatattgaatatctccccttgtcatcaccccccaaatctctgagtcttataaattatatttcttaaaaatctctaaacaagaatgtctctcttcagctacattatcaacatcacatatcatccagatgtcttcaataggctccggtcttatataaataacaccctcttcctaatatcactaagttccagtgatacttgctttccaacatttcttagaacactagaagctccctgccttgcttcagggcctttgcatatactgtgccttcgttcaaagaatagctggttatatttcttcaaatcaaaacttaaaagtcacataggaagatattcctggttatcttatccaaagcaacccatctctactctactaatcactactacaacactctaattatatccttcctgtcacttatcacagctatttagtttacatatttgttttaaaaatgtatgggtaaaatggtttctatcttgtacatggctgagtgcttgacacattgtaagtgaaaatctatttaagaaactgattaataaattaagacttataggctgggcacagtggctcatgcctataatcccagcactttaggaggctgaggtggcaggatcacttcagcccaggactttgagatcagcctggacaatggagcaagacagcatctcttaaaaaaaaaaattagccaggcgtggtatcatgtgcctacagtcccagctaccgggaagctgaggtgagtgattcgcttgagcccagcagattgagctgccgtgattgtaccactgcactccagcactccagcctgggtgacatagcaagaccctgcctttaaaaaaaaaggacatctagctttaactgtgggagaacattacagaacattcccaggtatgaaaacatatactaggtgtgataaacaaaacttttctaaaataaagagataatttgtagaaaaagacttcttaactaatataaggaaatccactatgctcctctgggctgcttcttcctgaactctgaaatcctcattaaattataaaaattatctaatcaaaagcattaccggtattgtaaggcaacatagcttataatccagaaggaccactttatttgccccatttacataaaagttgtgacctgtggtagttctggaatacatcctcgagaggtggagcttaattcccctcccctggactttgggctgtatttagtgacccacttgtaaatgaatacaatgtagcagaaatgatggtgtataactatcaagagaaagtaatttttaaaaattggggtttctgcttcattctctcttggatcacttgctctgcaggaagccagctcccatgtcatgtaacactccagtaacagatggaaaaactgactcggtaaggaactgaggcctactgctaaggagcacatgagagattcctttgacagccatccagccacaggctggctgtagctactactaacatcctagctgatgtttgtgcattctatcgcaattgcatttgtaataggatacttaaaatttaaaaataaacactgatcaaaagtagctcaattcaataccaaattaggtatgctaaaagtaaactgtacgtttccaccacgaatatgtttcaatcaatagaaaaatcccagtgttcgctctttccagttcttaaattagttaactaaattgtattgatgatgaatcaatacctactatgaaaggaaataatcagtaattatgctacttcaatgtagtcccagcatacaggagaaagatgcatacacctacactctcccaataccctataccatgagagatattttgccattttaacatttctctcagagacttattaggttactttcaactatataaatacttgttattaagtccatacattcaaatacaaaactaatatgtgaattctgatttaccagaggctacacatacaggttttaattaaatatagttacaaaatccttaatctatagatttaatatttatattaaataaaaaattgtatgatgtaatagagcaaaatccaatcatttttatcaaaacgatgaaaagtttcagatttatcatgtgtatattaaataatgctatagcacatactaaaatgattgtaataaacacttttttaaaacagcatcacatgtacagatgtaataagcacttttggcttagatatttttaaatatgcttagaaagcttatctttcaataattgtgattggaatataattaattttttatatttatttaaacagttttacatagatgtaataattgtacatatttatggtgtacgcagtgatgtgatatacataagacatagtgatcagatcaggtaattaggacacccattatctaaaacatttatcatttacttgtgttagcaacagtcaaaatcctcctcctagctatttgaaactgtattactgctaactctagtcatcctacagtgttatatagaactttagaatttattcctcagtccagctcttattttgtatactttaacaaatctctccctatcatctctccctccccactacccttttgatcctcgagtatccactgttctactttttactcatatggagattaaccttttggtagcttccacatatgagtgagaacacgcagtgtttaactttctgtgcctggcttatttcacttaatataatgtcctgcagttccatccatgctgccaccaatgacaagattccatgtttttttatggctgaatagtattccattgtgtatatatggcaccttttccttatccacttatctgttgctgaacaccactgattccatctctttgctagtgtgaacagtcctgcaataaacatggtgggtgcagatgtctcttcaatgtactgatatcctttcgtgtggatagatgcccagtagtgggaactctggatcacatgggagcactatttgtggtttcttgaggaagagatataatttaatacattatattaaatgtataatatttatcaaacttaagtgtacaatttgatgagatttgaatatatatatatgtttctgtaaccaccaccacaaccaagatacactctaaaaggtccctcataaccctctgcagctaattcccttgccccaactcttggcccctggtaaccaataatctgctttctgtcattgtgtagttttgctttttcagtaatttcatataaataaaaccatggcctatggctatgatgtatggagcccgtaatgtttaatttctttcatttagcataacacttttgaaattcatccatgttgttgcatgtaccagtagtcatttcccttttatttctgagtggtatttcatttattccagtgaatacaggtattgcaatctgtttagccactcacagttgatggacatcagaaatgtttacaatttgagactggaataaaactgctattaatatttgcttaaaagtaaatgtgaatatgtatgttttcattactcttgataaatgcctaagagtggaattagtatgatatacattaagttcctaacctatacatcctcattaactttacacattctttgttgttgtttttgaaaatcaagtttgttgaagaataatttacatagagaaaaattcattatttttaggtgtacaatataatgagttttctaaacatagaggcttatgtaagaacaattatgacatggaatatttccatgatccccaaaagttccttttattctcccttgtatgcaattcttcctcttttcccatagctcctagcaatcattgctctgttttctgtccctaacagctatgctttttccagaatgtcatataaatggaatcatacaacatgcagccttttgttttggctttgtacacctagtataatattttcaaattcatctgtgttgttgcatgtattagtgcttcactcctttttattactaagtactatatagattccattgtatggatttatcacagtttgtccatttaccagttgataaccatcttggttatttccaatttttgtgatgaatatggctgctataaatattcatgaagcagtcattgcatgaacatatattttcattcctctagggtaagagacctagagtgagactcctaggatgtatgggaaagtgtatggttaattctatatgaaagtgccaaattgtttacaaagaagtcgtaccactttacttccccatcaacaacatgtgaggttccagttgccttgtatactgctcttggtattgttagatttttaaaaagttattcgaataggtatgtcatgggatcacactgttgttttaatcagcatttctcagatgactaatgatgtttggcatcttttcatgtgtttattcggtatctatatctattctttgttgaagtatctgttcaaaacttacattttttttttgtagcaagcttatcttgttatatagtatgtttcctacatatcctggatgtaagtgctttatcacacataagttgaacaaatactttaatccagtctggcgtatattttcattttcttaagagttggcatttcaaagcaaatgttttttattttaatgaaatcaattaaagatctaaagaaatatttacctaattcaaggtcacaaagatttttctcctatgtgttctttcaagaagttctacttttagcacttacgtttgtctacactacgtttttttctgttacattttgagttaatttatatgtaaaattaaggggtgaggttctttttctttttggatatggataaccaattgttcatcatcatttgttaaaaagatcattttcccccctgggcataccttgacatctttgtcaaaaatcaaattgatcatatatgtttgagtctatttctggactctgttacagtccattggtttatatgagtctatccttaaataacaagctatcctaatgaatgtaattttatattaagtcttttgtttttttttctcaaaattgtttaaactattctggatatttacaatttcacttaaattttagaatcagcttgtctatttctcttttttcctttttttaagttaaaaaaatagagatggggtctccctatgttgcccagactggtcttgaactcctaggctcaagtgattctcccacatggactttccaaagtgctgagattacaggtgtgagccaccatgcctggccatcttgccaatttctttaaaaaagaaagaaagaaagaaaaagcctgctcagattttggatagagctgctttggacctcagatcaattctggagaaaactgacatcttaataatattgagtcttccaatccatgagcgtagtatagtacaattctccatttttaagttttaattctccaaaacagttttatagctttcagtgagtaggtcttataaatacattttcaaatttatctatatgtatttattttttgatagtatttaaacactagttttaatttcaatttctgattgttcattgctagcatacagggataaaattgagttttatatactgacccagtatgctatgaacagctaaactcatttattagttctaacagttgttgttgttgctgtttttttcctcatagattccctgggactttccacataaacattcaagaaggtatgctaaaatgactattttatttcttcctttccaatcaggatgtctgcagttcctatttcttgaaaggcctttgtatgcatttggtgttcaggtaatgctggtctcatataatgtttttggcaatttaacctccttttctattttttgcaagagtttgtgtagaaatggtattatttcttcattaaacatttgatagaattcatctgaactacaagttttctctgaggtaaggtcttttactacaattcaatttcctttgtagaactattaagattaaccatttcttcattagtgatatttgatagcttgtgcctttcaagaaatctatttcatctaagttgtctaatttagtagcataaatttgttcataatatttctttatttttcttttaatatctgtagtgatgttccctcccttattcttaatatttttaatttgtgtcttctctttctgcatctttgctagatatttactattaatacatttattaatcttgtcaagagacagcttttcattacactgatttttttctctatcatttatttttattatttttttctttcttcagcttactttgactacatgtgcttctcttttttcccacattcttcagattgaagctaagatcattgattttaggcaatgatcctctcctcctcccctcccccttaccctctcccttcttaaataaaatcatttaatgctataattctacattaggcacttctttatcttcatgttaaacatttctataggttgtgctgttattttcaattagtagaatatttctaatatctcttctaatttcatctttggcccatgttttatgtagaagcgcattaatttccaaatctcaagagattttccaaaaacctttctgtaactgatttctggtttgtaattaaccagagatccaagatctcaatctttctaaacattttgagacttattttagggctgaatatggtcaacgtgataaatgttctacgtgtatttaaaatgaatgtattttgtgcaattgactaaaatgttttatacatgtgacacagatcaaggtggttaataatgttccagtcttcagtatgcttactgattttttgtctacctgttctctaaattactgacataacagggagaggctgtctatatttcattccacttctatccacttttgtcttatgaattttgaagctctatttttagatgtatgtaaatttaagatcatcaccttgatgaactggctcttttatcattatgatatgtcactttttcctctgataatataatgctttgtgtggtaatttgataattgttatgggttgacttatgactccttaaaagctatatattgaagagctacctcccagtacctcagaatgtaacaatttgcagagagaatattttcaagttaaaatgaagtcatcagggtgggcccaagtccaatatggctggtgtctttgtaaaagagggaaacctggacacagagacatacacagggggaaaacaatgtgaagagacagagggagaagagaggcatctaaaaaccaaggagaccggcctggaacagatccttccctcatagccctcagaaggaaccaacactgatgaaaacttgattttgaacttcttgcctccaaaactgtgagacaacacatttctgttgtttaagccacccaatttgtggtactttgttatgacagccctagaaaactaatatagtaatgatatgactagctggctgtttttattaaggtagtgtttgcatggtatacctttttctgtccatttacctttaacgtataaatgtatttatatttaaatggggcttcttggttgccagaggcagaggagtgggggaaatggggagatgtggccaaagtgtacaaacttttcattgtaagacaagtaagttctgggaatctaatgtttaatatgaagattatagttcataatattaaattgcatatttaaattgctaagagagtagatcttaagtattctcaccacagacacacacacaaaggtaactgtgagggatggatatgttaattaacttgaatgcagtaatcatttaacaatgtatatatgtatcaaatcatcatgaggtagaccttaaatatgtgtaatttatatttgtgaattacaactcaataaagctggaaaaaaatacctactgcaaaagaaaaaaaagggtgggtttcctctaggtagcacataaatgagtattgcttttttatgcaatttggttttttcttcctttaaattatatagtttaggcaaatagtacttcaaggtagcatattttttattatattattttataaataagacattggtcataaaacttgaaagaaaaaatacataaataattttaccacagcattttttataataatgaaaacatggaaataaagcaaatcttcagcaatgagggaattactcaattttgatatattcatatttcagactattagcaaccaataaaaattatcatttttttgtcttgtatacatcacgaaatagctaatttgagcaaattaatatatccattacctcatatattcatcattttttgtaatctagtctccacaatttttaagaaaacaatatgctgttactaactatagtcactatgctgtaagatagatctcttcaactattcctcctaactaaaattttgtatcctttgaccaacatctccccagtcaccccacccctaacctctacccttggtaaccacgattctactctctacttctatgagtctaacttttttagatttcacatatttagatcatacagtatttgcctttctgcgtctttcttatttcacttaacagaatgtcctccagttcatccatgttattgtagataacaagatttccttctttttaaagactgagtagcattccattgcatatatatacaaccaaaatttctttattcatcagctgatgtacacttacgttgatttctgtatcttggctattgggagtaatgctgcaatgcaaacaggagtgcagatatctctttgacatactgttttcatttcagttagatatatacccagtagtgggattgcaggatcatgtggtatttctggttatacgtgtgtgtaccattatgatatatatcgtgtgtgtgtatatttatacacacatataccattatgatatatattatatatatatgtatctttgaaaagaatagtaattatatcgatatatatactataaatatctttcctaaaaggttagtatttaaactttccataaaagagataaaaagtaaatcttacaatatacacttttcttggggtaaggttaggcaatcttttatttaatgattatttgctaagtatatactctgctagacaccataccctatgctagggaaaacagtatattataatgcagtttagtcaaaagaaaacttaataacttaaaacagtacattataatgcagtttagtcaaaagaaaatactaataatcattatttactatgaaacataaaacagaaagttataaatttcaaaataagtgagaacattaatacagattaatgttaataagaatattaatactggttaattattataactattaagacactttactttccctaagtttctcatataaaacagtacctggtttgaggcaatccaaaacttgttccaacgccaacacgaggtagatagttaaccactttctttactgttgcagggtctgggaagttgaacatcacagcaactacaacagatgatttttaaaaattagaacacagtataacttcctttctggaaaactgactccttggtccaataaaatatttacttttaattcaggtatctattaaatacaattcttactatattccttttatatagtatatatcaagttttagtattaatatgccagtgataatattcatttcacttataaattcttttaccatagacagtgctttcctaaatactattaggtgttataacagttgatgttgcattgatatgacatgaagttgagattatgagacatgataataataatgataatgatagctgagataatgtgacatgaagctgcaactttaaatttacaaaaatgaattttggcaagtcaaaggtatttctaggagtttccagaaacaaatattaaaaatttaagtttatgtagttaaacaactaacactaaaaaacaaccaatatagctatgaaataatcagttacatttatttccaatcattaagttttaaaacagtctttttacaatgtctatatgtttatctttcatatgttcaaatgagcaaatgttcatataatccaaaacaatgtgtgatctgaaggaacatttttcctctgcagttaaaaatcaaatttaaatgctttctcatcctatttcaataatttcacatacatgagaataccaagaagtacatgtcaatatgtaaacatatttagcaataaatgttaatttatgagagtaatctataaatttttacccatttaaagaacatgaaagtaaaatcatacaatcttgagagagtttagaagatattcatttggtcagtcatggaattttaacttcaatgtcagaatcatatgtaagctacaagcgatcatctagaagatggtccttcttctctaccaacccttaaaaaaatatttaaagccaaaaaaaaaatataccaatgttcctatagtttttaaaacactggcattgccaacatgtttcaggtattcaggtaaataagtaatcgatcattcactaagcacctataacatatttagtaatgtcataatatatacacacacataagaatatatacacacacataagaatatatacacacacgagaatatatataacatataatatattatatataagaatatataacatataatatatataagaatatataatatattatatataagaatatatattatatataatatattatatataagaatatataatatattatatataatattatataagaatatacaatatattatatatcatatataatatataagaatatataatatataatatatcagaatatataatatattatatataagtatataatatattatatataagtatatattatatatacgaatatataatatattatatatacgaatatataatatattatatataagaatatataatatattatatataagaatatataatatattatatataagaatatataaaatatattacatataagaatataaaatatattacatataagaatataaaatatattacatataagaatataaaatatattatatataagaatataaaatatattacatataagaatatataatatattatatataagaatataaaatatattatatataagaatatataatatattatatataagaatatataatatataagaatacataatatatattatatataagaatacataatatatattatatataagaatatataatatattatataagaatatataatatataatatataagaatatataatatataagaatatataatatataatattatatataagaatatatattatatataagaatatattatatattatatattatatataagaatatataatatataataattatacataggaatatattatacatatatattcttatctgtgtgtgtgtatgtatcctttagataagcctcctttacatatccactattatactgaattcagggggaaaaaataaacagaagaaaaaaatcatcataggttatggcagatggtcaaggccacgaggcaaaggcaacagaaaaacacacatataaaaacaagcatgcataagaaatttcaaagaaagaaaatgaatgaggatgagcaagtaataaatattctaagattgaagctcctttgggacagcaaggatgcggactgaaataaagtgtgaaacattctcttgattatttgcctagaagaataatgtttagattagaagaagaggtatgtgccaggaggagatcaaacaggaagggaaaaatcttttcctaaagaaatttgtattccctaaagacagataatttcataaaggaaaaacaagatgtgtgtgtggaatataggcagttatgtgtacctttaaaaataagaaaccatcaacccatgtatatataatacaaggaatatgtacaataaatcagtaggttttacatatattccattgtacacctccacccataccaaatgatgcttttccttcaagttcaacttgtctccccttcttttcttaatggatttcaccaagttccatcgtaaaactgcaaattaaattttagttcaactttcaagaatgatgaaatacagagcaaacaggacagttcagtatcattttctcatggttcctttataaaagcaatatatcacatatatcacacaaaagattaaatagacatatgaatcgttattgtcctctcctctccccaaatgcagccaccttccagaaggaattaagtatcaaagcaatgctcaggacatcaaaactcctcttcaagctgattaaatggttatgtattccttatgtttataaagccttatatcaatttgtgatatggcaaaaaaaagaaaagaattacaaatgattctattaataatcaaggtgggaaaaaaccatgaagaagcatttggtacaaaaaaagaggtcactagaacagaaggtgggctacaaataactatctaaattgaagcaatatggtatgttcaaaaatgaaatcttaaagagatggaagttagctctgtaacaacgtatttctgtaacacattacctctgtttgccataaagatctccagggctgtattttgcaaaagataacgacgagaaaagattgatcgtatctctgtgaacagccattttccatgcagcccttctgtatatgccaagatctaatgaggaaaaaaataatcccaggtaagtaacaatacttgttttttgttgttgtttctttccccaattaaaatagaaaagaccctattaagaaaaataatttttaagaaaaaggatttaatagttacagacataatttggagatgaagaaaataaattgtaatttatagaaaagaagcttaaattaaaaagcaaagtaaaattataaaacatttaagtatatattcgggcttttaaaaacaatgatataatctactgcttctgaagaaatacatattgcatcatttactgattgatttttaaaccacattatgaaaagtaaaacttcagataaaatcttaaaaacaaaaagccctcaaaagaatgtcatatatgcttataaatcacatacacaattcagtttcacatgattataatttgcccaataatgcttttacatacattataatacaaatatattaagttcataactttaaaaaatgacacttttaaggtcactgttaaggcaacagtcactcattcagaaagcacaaacactgactatataagaggttaagtatcattttgtcagctaaagctaaacacaaacctgcaaatgaacttagcataatctccctatggggtaggtggttgtcagagtaacttgttacaattcttgtcatcccaggtgacagacagagttgcttaaaatgctttgccaattcaaagtaatcctgtctttagtcctaacccactttgttgctttgattcaagttttgtttttcaaaacgttcatttcaaaagcttaattgtgaaagcgttaagggaaaaccagactcagcatttctctacaccagtactatacataatacataagaaaatgagatgcacttgctatcaaaacctgatattctatgacagcaaattaagtttaaaaaattaagaaatatatctcaaaagtaaccactattaaaaattacaaatgaaacatttgattatgatactacattgtaggaataaagatgggatgagcaaagaggtaaaataacgagtagtaaaaatttatccttctcaaactgttttgtctttactcatttttattttcaaaatcctaatggcaaataaatctacattctccagtgcagaatgtagtttttttgaaaaaaaaaaaaaagagtaacaaaccttatttaagtcagtaagtatgtatttcagtctttctacaaaaatgattctatttctgacaccacagaatctagaaatagaatgggtataactctaagggagagtgtttcttgaaaatacaaaacaaaaagttcaaaagacaagataatcatgcgtgcagttttgaaatggatgagagagaaatcctactaattcagtaatataatcaacgcctatgtaaaataaaggtaaatgaacaggaaacgagaggacaaaaatatgaacattactctcagagattgcatgtatccctttctctcactttgaccagagataccaccagttggtctatggccccaaggtcttcagaggcatctatttgttctctcttttattcttacctctgaagtctaccatgaccagaggacccttcacctcaaaattttaaaatacaaatcagatcacatcattcctatatttaatagtatccagtgacttcccatgacatgtataataaactcttaagctctttatgactgcataaagcctcatatctgggactgtcagatgagttcaactcattcttcctcagggctttgttttgcccttgttttccactctgcctggaatgttctcccacatctccacatggttcactcattctcacatttagacttctcctcttatgtcacctctgcagggaagccacaggatctaaaccccagttactccattaacaactcatcccaccccaaacttaccagattttcttcataatacttatcactacctgaaattttaaatattaatttaattttcaagacagggtcttactctgtcacccaggctggagtgaagtggtgtgatcacagctcactgcagcctcaaccccctaggctcacatgatcctcccatctcggcctcttgagtagctgggactacaagcacgtgccaccacatctagctaacttttaacaatttttttgtagagatgaggtctcactatgttccccagggtggtcttgaactcctgggctcaagtgatcctcctgcctcagcctcccaaagtgctgggattataggcatgggccactacacctggccactaactcaaactataatatttgcttgctagcctattgcctcttcagcactagaatactagaatctaagttctgttggagcaaaggctttgaatataccctacttccaatgcctagaaaaatacctggcacaaagtagcaattttcagaatgactaaatgaatcaatgtatggcaaccttcagtccatatttgatccgcatgatattttaacaaaatttcacatggttgaaaatagttgagaaaacagatattcgcaaaaatattcggatttctgtcttctcaagaaaaactagggtatccagcaaacctggatctgtatgccacatggtaacaattggcatgcactctccattttggtaccattttcacttcatttattattattcactaatgtgatgtgagcattcactcatttactattatccacctagtttccattggtacttgagtttgctaccctggatttaccaaatattagagaatccaatatatgttctgcaacatttatagtccaatgtatccataagaaaaacaagagccagggccagtagcttacactggtaattgctgagctttgggaggccaagatgggaggactgcttgatgccaggcaacatagcaagacctcatctctacaaaaaattaaataattagttgggcgtggtagcatgcacctatagccctagctactcatgaagctgagatgggaacatcactcaagcccaggaatttgatggcacagtaagctatgattgcgccactgcactccagcctgggcaacaatacaacatcctgtctctaaaaaaagaaaaaaaagaaaaatgaggcctagacatgttaaatatttgatacaaaattccttggcaagttagtggcagaaaatggcctatacccaggttttctaacccaaaaatacagagcttccattgtatataccacattgccacatttttaagaaagggttaaatatctgttaaactagaacccaactaactgcttaaaattttcctgcacttgggttaaagaggaaagaggaaaatcaaaagaaaacaaacaaaaaatattttaagctctttgatatgttaggaatatcacacactggtctgaaaattctaccttttgtatctatagagctatataataagacctgttgcccataatagtgaatccactcattgcaaagtcatgatcatacaactaaagatttaatcatattctagactactccatttattaggagaaatgagtatactacagcattgttacaagatttttcatgtactgaaatagttttctgattaaataaaatataccatttatattccattcccttaaacagtatggttattcaaagatctacttgaaacactgcaagtgtcatagtcctttaaaatctgttttattccaatgtcaaaaatattcagtagtaggcggggcacggtggctcacgcctgtaatcccaacattttgggaggccaaggcaggcggatcacgaggtcaggagatggggaccatcctagctaacaaggtaaaaccccgtctcaataaaaaaataaataaataaaattagccaggcgtggttgcgggcgcctgtagtcccagctacttgggagtctgacgcaggtgaatggcatgaacctgggaggcggagcttgcagtgagcctagatcatgccactgcactccagcctgggtgacacagcgagactctgtctcaaaaaaaaaaaaaggaaatgaggtaagctccatgtacctactactcagtaaccttataaaatcataacactttgccatattattctatacatctataagaaagtgataaatgcattacagacagtgttaaaattcacacgcataacgcttcctgatcccattttcctcctctgtcacagccaatcactatcactatccttgtttttaggattatcatctatatgtaagtttttatattattagtacacatatatccataaataacataccacatcactttgtatgttttcaaacctgatataaatggtatcatactgaatgtataatgatatgcttttcaagttaaacatgacaaagtctaatgaagttttaaaacttagagaagaaaaaacagcatgagagaaaattatttaaaattgtcaaaggtgtcaaaaattaaaatcttaccaaaaaactagcctaatcttttaaaaaattaaataaaattccacaattagggtcaaaaaatttgagatttaaaacagaaactagcaatctcttaactaaggaattactagctgaaatttatataataatatttctttaagtgttcattaggaaaaggtgtcagtactgaaaagcagctgaggcctagctaagcaaggggttcatttcttattggaatagtataggcctggtctgaggcttcacttcaaagtctctagagttcaattaaaactggattaggtagaaacagacccttctttgggactttctgttcactgaaactctacatacactgacagcaccttagacagaggtctagccctccaatgaatcagttgccatagaaaccatatcattaccattgctctgcagttatgacctcaactcctgaattgcttgaaatctttactctctttgaatgtttaccaccttgttttattattgttagtattattattagtaaattaagctttcaattgttttaaataatttgtttcaaagctggtttattaaatgttgagacagtgtgttagagaggagagaaaggatttagtattgaatacatagattatatacacacataaatattctatttatttactgtaaaacatcaaacctatcttttttaaaagttttatttaaaaactgtgccttatgaaaaggatatattatttttcccaaataatgcatgtatttcttccttctgtcctacaaatagtatactattaacacataagaaaattgcttcactttgttgcacttattcttagtaaaagtaaggcattttttactttccctttaccagtccatttgtaaaagcttataagtttatccaaataaaactcttttttgttttcttgtcctcatgaaagaacaaaaatagaaaccaacactcactgcccaactatatactcttatttattgaatactagggatttttaaaaagtagatttaaaatagttaaagccaatcctttaagtgaatagaaagggaggttttatttttttaaaaaaaactatccttgatacattttaaatgttttaaaattcctcctgaagggtaaatattaaaaagtgataaaatgttttacctcaaaaaaaagaaatacttacatgagagcctgcacatgtaacatcaataaaaggtattttaaaaattactattcctaaggtttaaaactagcatagcatatccctatgccaaatatttcccaaattctatagtaattttattttttcagacaattccagatttctgaagattttggtgttaagaataaaatcaggtaatatatatcaataacaatatttaaaaattcacaacagaaccatctccaaaccctatcaatacatttaacatcaggaaaaatgttgttagccaaatatacaaaatgtaaactaatcataccattcattaagcaataacacaatggctaagaaagtctagaaaatattcactatatcccattttaatggaacataattacatagtcacaggttaacactttaatatggaaaaactaattatttgaaccacctttaaaataaagacattgaaaaatactttcatatcaattcaccaataaatatatgtgcaaatgttttatgttacaataattgtaatttgaacaaatagcttaaagaattttaatcaagtattttaaagttgcatcactgttattaacatagtttttacattttgctatagttttctctgaaggtagatatcaaagcatagcacgtaatttactcaaataatattgaatcctagttggttcaaggatttacttcatcaccaaccatatgacttttggttttaaaattcaaggatatattctttaagtaaaatttagaggtcttttttgaatttgacaatgacaatgacacacagtcgactctggtggaaaatttaagttgataattttcttactaaatgtatatccatgaacacttagaatgtccccaaacttcaacaaacaacaaaaatgaaagtcatacataaaaaataaaattacctcttaaattaatcatgtgttgttatttaatttttttcatctatacagtatatttcccttctggtttcaagtactatgatgtagtatagtattcatagcatttcatgggtgacaaattcaattaaacatattcattactctaatgttctacttggcagttttagtcagtatgaaaaattaaaaatatataaataaaatgctatgtgacctttgtattgattggactaaaatggctttagcctgggtgtggacgatggggcagttgggaggggcaagaggggagcctacaaacacacacactcttatgttttctcttccaattactgagggagatgataaaaccacagcaaatgatgtatcagctcattttatcttatcgctttggggctaggtgacaatgaagttcatatttcacgggctcccattgaagactgtgaaaattacttgcccttatgacctgaaatttcactagaagacagaaatttctcttctgcaaagtaatgcaatttttcagatgtcaacctttagcccagctttaaaaattaatttcatttatattaaccaatgatattgatattttcacagaacactctttgatacatgaagcactgactggcaaattgatgttgctttagatgggtaaaactattttattttaagctgctgtggcacacagatttatggcaaactgaaattcccatttcataatttaatatttgtgctggagttgatgcacctttaagcccttggcctgtaaataattcagactctttacttggttgttttattttcaatattcctcagcttaaaaataatttgcattctaaatgatgcatcttaaaagccatctcttattcaactagcattaaatatcaatcttaatgagtcaaaagccaaacgtagtaatgaaggagaagaacaaagaaggtatttatttatcttccagctcatttttaattcagtttttaaaatttaaactataccataagtctaaatttttttttgaaagaaggcaagaaaccaaaatgaacccgcaaaaggatattaaggaaccatagcaaggaacatgaatatattttatatctttttcatagcagcacataaggtgaagagctgggtgataaatttgtagagaaggaacaaaatgaacttagatatttatctaaattaaaatagatatttagctttgaaggtaccttttaaaatacaaacaaaaacaaagccacaatgtcaatatcattgtgaacgaggcataaaagggtctcatctgattttagtaaaggagatactgaaattaccttgtatctgtacaaaagaaacatttcaatatacaatttcaatattttagagtaataaaaatgctactaaaagatgtatgatctggtgtctttacaagttacaactttattatctttatccagtaaagagttttgtctaattcaaataatgccttgagaagataatcattaaacaaatacccttctattttataaggaaagtcaagcataaatatgcatataacttatacattcatttatgatcttaaaattagaaaaaggctaagaaagccatttatctaatttaggtagtttctccccaaatggtttaacactgctttggctaaatttctatactcaaaataatttttgcacctttatgccaacaatattcaaattgttttttcttcaaaatatttatatttagttcttccttacatgtacggtatagaaaaaaatcataatataaattttccctttataattttttcatttagattgaaaatattcccaattacttctcaaaaagttgtgacaataacatgctattgttgctgaattaagctataaagtatttctgtcagggccaggcaaagtggattatgcctgtaatcctagcaatttgggaggctgaggcaggaggatcacttgaggccaggaattccagaccagactgggaaatacagcaagatcccatctctacaaaaaataaaattagatgactgaggtggcatgtgcctgtagttccggctactccagaggctgaggtgggaggactgctcgagcccagaaattgtttgaggctgcagtgagctatgactgcaccactgtacttcaggttgggcaacagagacttttttttttttttaagtatttttgtctaatgttccccatattgattctctatagtcataagctttctattccttactagagagttaaaatttaagtcaccactaataaaaaactaactttaaatatattggaatatttcacaataagtactttaaaacaaccaatgggcagaaactctctttcttctcaatgccaattcttccttcatgaactccatctttgatgggtatcaaaagccctccctaaaaaagtgttttacttctcatagaagtaaaaagtaaaacagaggatactagaggttggaaagtgaggtgggaagcaaggaaagtgaggtgggaagcaaggaacatggaaagatttgttaaaagatacaaaattacagttagacagtaataagttctagtgttctataccactgtagaatgactccagtgaacaataacatatagtttcaaacagctagaagtaggatagtgaatgttcccaacatgaagaaaggatgtttgacatgattaatatgctaattaccctgatctgattactatacattatgtgtatacaacatctttatgtaccccatgaatacgtacaactgttgcttaaaattttttaaaaataaaatgaccaaaggtaaagttaaaaaaaaaaaaatccccccttgggctgggcgccggggcttatgtctgtaatcccagcactttgggaggctgaggcgggcaaatattcctgaggtcagtagttcaagaccagcctggccaacatggtgaaaccctgtctctactaaaaatacaaaaaattagctgagtctggtggcgggcgcctgtaatcccagcttactcaggaggctgagacaggagaattccttgaacctgggaggcggaggttgcagtgagctgagatcggactactgcactccagcctgggcagcaagagcgagactctgtctctaaataaataaataaataaataatcccccctctcccagatgtatgaactaaatcttcaagttagagtaatatcagtttactgatagactattctgtgtagcagatacaatatgatttagccactggaagtttctctgttacctaagctacttaaacaaattaaagggaaaacctttgtttatcttgaagaaatttgcttttgttctttgaacacagcaagcaagagaaatgaaaagcaaaatggaaaggaaaaattaggaacatagaacttgatgctaagagcctaaaatccccaggatacatttttcctaatcagagggaaatacttttctacttttttaaaattagtacctgcctcctactaaatattaagcttgtttagttggagtcagttataaatgaatagtacagatttgtattcacttccataatagagcatggaactaaatgctatgctcacatttgccttcagacgtaatcttccaaaaagccattttcttaaaggacctatatgtaatagaacattatgaataaaacttaaataagacttttggggttaacctcatttcattgcgtaactccatattgttgcacaatcctcactagattggagttcatactttaactggagttcttatgacactacatcactagtcttagtcatctttctattcacagtatctagcacaatactgaagagactgactgatggatggagggccaactcagcttcactaagtgtctacaatcaggccagatgtggtggctcacgtctgtaataccagcactttggtaggccaaggtgggagaatcacttgagctcaggagttcaagatcagctgggcaacacagcaaaaccccgtctctgctaaaaaatgcaaaaattagctggaggtggtggtgtgtgcctgtggtcccagatactagggcggctgaggcaggagaatcacttgggcctgggatgcagaaggtgtagtgagccaaggtcgtgccactgtactgggcaatagagcaagaccccatctcaaaaaaaaaaggtatctacaatctaagattctgggaacacatgaacataaacacagcaaaaaacaaaagggggaagaagagtaaaatggaaaactacaacataaaaatttttaaaaatcaaattcaagggtcagaatacttccacttttgatgaagatggagtaacagggcctggatttatcctacctaaacaatatgcaaaatgaacataatatactgaaaagttgttttcaaaatattaaatattaagcaataaaaaacagtgattcctgaaaaacaggaaacaaaattgtgacacctattaatgcccaagcacaccatctggaaagactttgcagggcccagaggaaaatagagaaacgtagttagaacgtaatggtctcctgcagtagagaaaacagagcttgaagtacagggagatcaaggcatcaaaagcttgcagggcagagtagcagatcagagagagctgcaaagcaacagagctccagagatctgcagccttcagctgagtactgaccaagctatgaaagaaaacaatgtgagaccagtgaaagaatcatcctaagaaattacaatgaacagtactcagagctcacacagaatgtaaaaatctcatgattcatggagcactgtagagactactcaaaagggttttgccacagaagtgggggaaagttagctctagacttaatgctgctctagttctccctaaaaatcttaaaaccaagctccagatggatcaaactatttctaagtaacttaactgtatcccagaacaatgtattataaggaatgcaaaaatatccaccacacaactaggcaaaaatcactacaactggcattcaattcataattactgggcctgtaaaagaagcaaaacaacatgacccacatgaggagagaacttaattaaacaaaactctcctagaaatgaccatcaacagaatttttagaaaaagacatcaaggggagccaagatggccaaataggaacagctccagtctacagctcccagtgtgagcaacacagaagacgggtgatttctgcatttccaactgaggtaccgggttcatctcactggggtgtgccagacagtgggtgcaggacagtgggtgcagcgcaccgtgcgtgaggcgaagcagggcaaggcattgccttacccgagaagcgcaaggggtcagggaattccctttcctagtcaaagaaaggggtgacagacggcacctggaaaattgggtcactcccaccctaatactgcgctttcccaacgggcttaaaaaatggcacacaaggagattatatcccgcacctgactcagagggtcctacacccacggagtctcgctcattgctagcacagcagtctgagatcaaactgcaaggtggcagcgaggctgggggaggggtgcccaacattgcccaggcttgattaggtaaacaaagcagccaggaagctcgaactgggtggaggccaccatagctcaaggaggcctgcctgcctctggaggctccacctctgggggcatggcacagacaaacaaaatgacagcagtaacctctgcagacttaaatgtccctgtctgacagctttgaagagagtagtggttctcccagcatgcagattgagatctgagaacaggcagaccgcctcctcaagtgggtccctgacccccgagtagcctaactgggaggcaccccccagtaggggcggactgacacctcacacggccgggtactcccctgagacaaaacttccagaggaacgatcaggcagcagcattggcagttcaccaatatccgctgttctgcagccaccgctgctgacacccacgcaaacagggtctggagtggacttctaccaaaccccaacagtttggtagaactgggtctggagtggactctaccaaactctctgcagctgagagtcctgtctgttagaaggaaaactaacaaacaggaaggacatccacacaaaaaacccatcaggacattaccatcatcaaagaccaaaggtagataaaaccacaaagatggggaaaaaacagagcagaaaaactggaaactctaaaaaatcagagcacctctcctcctccataggaacgcagctcctcacgagcaacggaacaaagctggacggagaatgactttgacgagttgagagaagaaggcttcagatgatcaaactacgctgagctacaggaggaaattcgaaccaatggcaaagaagttaaaaactttgaaaaaaaattagacgaatggataactagaataaccaatgcagagaagtccttaaaggacctgatggagctgaaaaccaaggcacgagaactaggtgatgaatgcacaagcctcagtagccgatgcgatcaactggaagaaagggtatcagtgatggaagacaaaacgaatgacacgaagcaagaagagaagtttagagaaaaaagaataaaaagaaatgaacaaagcctccaagaaatatgggactatgtgaaaagaccaaatctacatctgactggtgtacctgaaagtgatgggcagaatggaaccaagttggaaaacactctgcaggatattatccaggagaacttccccaatctagcaaggcaggccaacattcaaattcaggaaatacagagaacgccacaaagatactcctcgagaagagcaactccaagacccataattttcagattcaccaaagttgaaatgaaggaaaaaaatgttaaatgcagccagagagaaaggtcgggttacccacaaagggaagcccatcagcctaaaggctgatctttcagcagaaactctacaagccagaagagagtgggggccaatattcaacattcttaaagaaaagaattttcaacccagaatttcatatccagccaaactaagcttcataagtgaacaagaaataaaatactttacagacaagcaaatgctgagagattttgtcaccaccaggcctgccctaaaggagctcctgaaggaagcattaaacatggaaaggaacaactggtaccagccactgcaaaaacatgccaaattgtaaagaccatcaaggctaggaagaaactgcatcaactaacgagcaaaatagccagctgacatcataatgacaggatcaaattcacacataacgacattaactttgaatgtaaatgggctacacagactggcaaattggataaagagtcaagacccatcagtgtgctgtattcaggagacccatctcacatgcagagacacacataggctcaaaataaagggatggaggaagatctaccaagcaaatggaaaacaaaaaaaggcaggggttgcaatcctagtctctgagaaaacagactttaaaccaacaaagatcaaaggagacaaagaaggccattacataatggtaaagggatcaattcaacaagaagagctaactatcctaaatatatatgcaaccaatacaggagcacctagattcataaagcaagtccttagtgacctacaaagagacttagactcccacacaacaataataatgggagactttaacaccccactgtcaacattagacagatcaatgagacagaaagttaacaaggatacccaggaactgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcagaccacagtgcaatcaaactagaactcaggattaagaaactcaatcaaaaccgctcaactacatggaaactgaacaacctgctcctgaatgactactgggtacataacgaaatgaaggcagaaataaagatgttctttgacaccaatgagaacaaagacacgacataccagaatctctaggacacattcaaagcagtgtgtagagggaaatttatagcactaaatgcccacaagagaaagcaggaaagatctaaaattcacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagttggttttttgaaaagatcaacaaaattattagaccactagcaagaataacaagaaaagagagaagaatcaaacagacgtaataaaaaatgagaaaggggatatcaccaccgatcccacagaaatacaaactaccatcagagaatactataaacagctctatgcaaataaactagaaaatctagaagacatggataaattcctcgacacatacatcctcccaagattaaaccaggaagaagttgaatctctgaatagaccaataacaggctctgaaattgaggcaataattaatagcttaccaaccaaaaaaagtccaggaccagatggattcacagctgaattctaccagaggtgcaaggaggagctggtatcattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcagtaaaatactggcaaaccaaatccagcagcacatcaaaaagcttatccaccatgatcaagtgggcttcatccctgagatgcaaggctggttcaacatatgcaaatcaataaatgtaatccagaacataaacagaaccaaagacaaaaaccacatgattatctcaatagatgcagaaaaggcctttgacaaaattcaacaacccttcatgctaaaaactctcaataaattaggtattaatgggacatatctcaaaataataagagctatctataacaaacccacagccaatatcatactgaatggacaaaaactggaggcattccctttgaaaactggcacaagacagggatgccctctctcaccactcttattcaacatagtgttggaagttctggccagggcaatccgtcaggagaaagaaagaaagggtattcgattaggaaaagaggaagtcaaactgcccctgtttgcagatgacatgattgtatatctagaaaaccccattgtctcaggccaaaatctccttaagctgataagcaacttcagcaaagtctcaggatataaaatcaatggcaaaaatcacaagcattcttatacacgaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtgggaagaatcaatatcatgaaaatggccatactgcccaaggtaatttatagattcaatgccatccccatcaagctaccaatgactttcttcacagaattggaaaaaactactttaaagttcatatggaatcaaaaaagagcccgcattgccaagtcaatcctaagccaaaagaacaaagctggaggcatcactcttcttgacttcaaactatactacaaggctacagtaaccaaaacagcatggtactggtatcaaaacagagatatagaccaatggaacagaacagagccctcagaaataatgccgcatatctacaactatctgatctttgacaaacctgagaaaaacaagaaatgaggaaaggattccttatataataaatggtgctgggaaaactggctagccatatgtaggaagctgaaactggatcccttccttacaccttatacaaaaattaattcaagatggattaaagacttacatgttagacctaaaaccataaaaaccctagaagaaaacctaggcaataccattcaggacacaggcatgggcaaggacttcatgtctaaaacaccaaaagcaatgttaacaaaagccaaaattgacaaatgggatctaattaaactgaagagcttctgcagagcaaaagaaactaccatcagagtgaacaggcaacctacagaatgggagaaaatttttgcaaccaacccaaatgtccaacaacgacagactgggttaagaaaacgtggcacatacacaccatggaatactatgcagccataaaaaatgatgagttcatgtcctttgtagggacatggatgcaactggaaaccatcattctcagcaaactattgccaaggacaaaaaaccaaacaccgcatgttctcactcataggtgggaattgaaaaataagaacacatggacacaggaaggggaacatcacaaaccggggactgttgtggggtggggggaggggagggatagcattaggagatatacctaatgctaaatgacgagttaatgggtacagcacaccaacatggcacatgtatacatatgtaacaaacctgcaaattgtgcacatgtaccctaaaacttaaaataataaaatttaaaaaaaaagggggggggggggagaaaaagacatcacatgagaccaagcagttttgttttgttttttttgagacagacccttgctctgtcacccaggctggagtgcagtggcgtgatctctgctcactgcaacctctgcctcctgggttcagacgattctcctgcctcagcctcctgagtagctgggactaggactacaggtgcccaccaccatgcctggctaatttttgtatttttagtagaggcggggtttcaccatgttggctaggctggtctcgaactcctgacctcaaatgatccacccaccttggcctcccaaagtgtgggattataggcaggagccaccacgtccagccccaagtagattttagagcaaaacatttaattagggataaagagggtcattttataataatatcatttcatcaagaggctttatttaactatcctaattgtttatgatctgaataacagagcttcaaaacacaagaagcaaaaactgagagaactgaaagaagaaacacatgaacccacaatataaacatttcaacattcctctgtaattaataaaacaagaagattgaaaaatcaataaagatacaaaggagttgaacaagaccatcaaccaacagaacctaactgacatttatagaacagtccaaccccagagcaaggttacgaaaagcatattttgggctaaaattcaagttgcaataaatttaagactcaaatcagataaagtatattctctgactacaatagaagtaaattaaaaatcagtaacaatagattgtttgcacagcatggtgactatagttaatggtaatgtactgtttatttcaaaattgctaaaagagattttaaacattcttaccacaagatataagtatgtgagttaatgaatatattaattagccagattttatcattccacaaaatatacatattattaaaacatcacacagtaccctatatataccattattatttttcaattaataagaaaatttaaaaaaagctatctggaaaaggccccaaatttgaaaattaaatagtacacatctaaataacctatgagtaagagaaaaaaacgaaaaggaaattagcaagtatttaaaattggatgaaaatgaaaacacaattttaaaaaattctagaatacagctaaagcagtacttagagggaaatttacagcactaaatgcatatattaatgtgaaagaaagatctcttttcagtgattttgacatcccctttaggaaaaaagaaaaataagagcaagttaaacccagattaagcagagaaaggaaataataaaaatcaaaagaatagaaaaccaaaaaaaaaaaagagagaaatatcactaaaacctaaagctgtttttgtgttttgttttgtttttttaaaaaaagatcaataaaattgataaacctctgaccagagattagggaaaaaaaatagatgtaaatcacgaatatcaggaattataacaggaattaccaatattaggagagaagagacatcaaaacagatttttagacattaaaaggataaggggatatcataaacaaatagtttggactactttgatgcgatgaacagatctcttgaaagacacaaacttggccaggtcctgtggctcacgcctgtaatcccagaactttgggagacagaagcaggcagattacttgaagtctggagttcgagaccagcctggccaacatggtgaaaccgcatctctactaaaaatacaaaaacagccaagtgtggtggcacatgcctgtaatcccagggacttgggaggctgaggcaggagaattgcttgaaaccaggagggaggtggaggttgcagtgagccgagatcacgccactgccctccagcctgggcggcagagtgagactccatctcaaaaaaaaagagaaagatacaaactaccaaacccctttcaagaagaaatagattgcataaataatacaatatctaataaagaagttaaatttgtagtttaaatcttcccaaaaagtaaactccaggctcagcagactacactggtaaattctaccaaatatttaaggaagaaactctatacaaacttgtccagaatattaaagaggaaagaatacgtgccaactcgttctatgaggtcagcattatccagatgtcaaaaccagacaaacacagtataagtaaaaaggcagtctgcacttaaatatttgtaaaatttctctgtcttgagacttactgtggataccctacaaaataaatatattaaatgtcttctcatactaccttcccactcttgtaccttcacaaattgtcactcaatgcacccatctttctctcggatttctcaaaaacatctacgcagtttccttttgtagtacattccaacttgacttcctttggatttcaacagagtggaattcttagccttcttagtttacactgagtgatttcatcccgaatcactgcttctattgttgccaaagcacgctggggtgtgagatgtagagctaagatattagaggtcagttttagacccctatatccaatcacctataaatagctccaccatatgccctctaaactctcaaattcttttattttttattattttatttatttacttttcattattttttgagacagagtctcactctgtcgcccaagctggagtgcagtggcgtgatcttggctcactgcaacctccgcctcccgggttcaagcgattctcctgcctcagcctcctgaatagctgggactacaggcacgtgccaccatgcctggctaatttttttgtatttttagtagagacagggtttcaccatgttggctaggctggtctcaaattcctgacctcaggtcatcctccggccttggcctcccaaagttctgggattacaggcgtgagcctccatgcctggcctaacctctcaaattcaacacatccaaaaacgaactcactaccacccctcaacagctgtcattagtccaattgagactatttcagttagcagagccataaacaccatgtaagccaaacaaaaacttagttatgctaaatactacatctcactccttttgaccctcactcacctctcaatgaactacttcacttgactctatctcccttctgcttttagtcatatagggtaaaacctactttagaagaggttcttatcatcttttaccattttcatagacatatcttatattctaaacatgtcatacaacataacactccttcaatcacgccatgctgcttcatgcttaagcatctcccagtgtgatggtcttcctaactgcaatgcagcttctttcaacgtgcaccaccaaggaggtggtggcagtggttgtattaaagtagtaccagacagtaatagcggtagcagcaacaaacacaacttacttagatctcattgtatcccaggatctatgctaagtgattcaattcagttatttcagctaactctcaaaatggcactgtgaaatcgatgtcattttcaccattttataaattaacaaacagtctttgagaggttagatgacgcagtcaaaatcacataactagtaagtagtgtagccaagtctatcagacttctgacattatgctctgagccactatataatactcccaccacagagaacttctcatccttaaaggccaagccaagattttgcaaaagctctgacttctcaaacagatgtgctaccacaggcctcttacaaattgtaaatgtctccctcactagacaattactgaaggcagatactaaacagtacttattttagtaattccagtgctactggtacatcacagaactcaataaatgtatacccaatgaattaatgatgagattaacaatttcagttgaaacagattcctcatcttccactccatgtttctataattagtttcaaaactgaacagaaaagagagatctttaggctttttaaaatagcgaactgtgtatttcagcccctggtaagggcattggggaggccataatcaaggttagccaaatttgttgtatctggagaaagtggttcaaatgacctttcataactactaaggaactggaaacttatgatttagatcatttaaaaggaacttattataagaattaaaaagtgagtgttatgaactgaatgtgtctttccaaaatatgttgaaatcctaacttccaacgtgatggcaacaggaggtgatttggactttgggaggtgaacaagtacttagaggagagccctcatgaatgggattataataagagactccagaaagctctctagccctctttccaccaggtaaggatagaatcaggagtcagcagtctagggctccacaccagaatctaccatgctggcatcctaatctcagactttcagcctccagaactgtgagaaataaatttctgttgtttataagccacccagtctatggtactttgttatagcagcccaaacaaagacagtgctttttgagaaaaaaaaaaaaaaaaaaaaaagatgaagagtccttgttctgcagtgaattattagaacctaaaagaaacatgtttctgaacaccttcacctccccccaaaaaagggaacaggtaataaaaatatgcaatgtagatttgctatattatgtaagaatattcaattctgctttagaagacaagaaaacaaatgtgatagatgaacacaaaagaaacattaaacattaatagtaacataatagcttccaagatgtaggcaaaaagtcataggctatgttaagtataggtaaggaagtaagtggcttatgagagacagacaaaattcaaatgatgttaaatacgtacagtcaatttaaagtttgaaatcagcaagacctgtcaaagacagaatacattgaatgtatgatggcacacaaaaaaagtgctatttacagatggatggaaagaccacctcaaggtataatcatactacctctgtgctgggtctctcatatttctgcagatcttagaggaaagtagtaattgccatcttatatgacacactgttttcaaggatgtttgcataattaatagccttggaagagacagtatctcagtttacagcaatgggcaggtttgtttactgtccagtataagaaaggtaatgatgctttataaggcagaggccagatcttactgcccattgtaaaaattttaggttctctacagttgaggttgcttaactgggatgtaaactcactgggaacacagcatccacctgggtcccacctgggtcctcattgggaacacagcacccacctgggtctgttcatgatgccctaataaaatactgcagactaggtggcttaaacaacaggtgtgatttcttggagttctggaggctgggaagtccaagatcaagttgccagccagtttggttcctgctgagggctctcctcctggcttgcagatgacttcctgctccctgtcccctcacatagtggagacagagaatttctctttcatcgtcttcttataaggccaaagtcctatcagattggggccgcatccttatgacctcatttactcttcattacctcctaaagagtctatctccagattcagtcacactgggggttacagcttcaacatataaattttggggaaatacacatcagtccatagcatctccaacaagtcactccatgaaacttggggatgcgagggaaatagacactaacaagatgcttactctgcttgtgctgtaagtctttgtccctaacctttgtcctatgtcttctgccaacatctaagaaactgtggcaagataaattgttagcttgcatttcagacctttcatagtttttttgttgttgttttgttttgtttgtttttgagatggagtttcactcttgtcacccaggctggagtgcaatggcatgatcctggctcactgcaacctccgcctcccgagttcaagtgattctcctgcctcagcctcccaagtagctgggattacaggcatgtgccaccacgcccagctaattttgtatttttagtagagacggggtttcaccatgttggccaggctggtcatgaactcctgacctcaggtgatccacccgccttggcctccttaagtgttgggattacaggtgtgagccaccacatgccgggcccctttcatagttcctgacaacctggatgatatctatgccggctttaaattgcccacccattgataatacccagtatagccccactctggcccctgtggttttatctgcacaagaaatgcagaaaaaaacttgtaaaactattcagcaggttaattggttggctccagctatgaccagggatagctgctgctgtgtgtctctaatagagctggtgtgtttcattggaccggaacactttccttctgtggtctcccttgtactcaaacctcaattctggcacttgtaacatcaaagaaaggcatacgaggcagaaaaagagacaggacatataaatgttacatgaaccaggactcaagaactctgatctttctacctgcttgcattcgatccgaagtatattaacttatcccaactctcttccatttcttcttattgcgtatgttaaattgatttaatgaatcatctgctttgagaagcttatttgatctgtgagcccttctgttctgtgaaatctgggacgacttgcctggtagtgtactaggaggcaacattgcattaggtaatttcccacagaacaggttcatagctaacctttatctcgccttaaactaccgttgaaaaaaattattctaggccactggggaaaaaataggaagctccataattcatttattaagccagcataatgttaatgctgaaaacttaaaaagagataaagagactatcaaaaaggaaaataatagagcatttttatcactgaataaagatacaacactcttaagtaatctgtaagcaaacagaatccagcaatgtctaatgagaacaatataacattaccaaggagggtattttcttggattgcaagagtggttcaataccaggaaatccacaacaggagatctactccttatatcaacaaattaaaaggaaaacattgcatcatcatttactagatgctgaaaagcatttgatcaaattcaggaaccaccactaaagaaaaaaagttagtaaaacaggagtggaaaatattacgtaaaataaagactttttaccagaaaccaacaacaaatattagctatgtgatctggggtcagtcatgtaggcttctcacctcagatgcttgtcttaaattaattagtgtaggtacagctagtaaaacagggcctggcacatcataagcactatgcatgggttagcaattattattacaataataattatcaccagtcaaattgcaaaagttgtaataaatgaaataataaaatgtaaaacctggtataaacattgaaaagaaagatgaaaatgcatttgaaatatccaaagtactccaaatgattaacggaaatatatataagataaacatgggaactattaatatttgttctccattttagcatttgacacaaatattgaaattagaaaaaaatttcattcataattgcaagaaaaacattacacacttaggaataattttaacaagaaaggcagagagggaccatgggacaaaaaatataaaacaattattagaggaacacaaagtacaatctgaacacccaaaaaacttttataatagtaagaaaataccattaaaatgtaaatttaccaaaaaccaatatgtatatgagttttataaattataattaaagtgacaataggacttttttaaaggcttcataaaattatttaatgtttacaaactatataccagaaaatagtcaataaaaggatgaaaacaaagactagtaaggagtattctaccttaaacaatatgcaaatggcataaaaacaaatatatatttttttaaaacattagactgtaattcagtctgacattttctattctcttttttttttttttttttttttttttgctaagtacctgttgtgatgcacaaagctgatagcacagcttaatgtggaatgatcaacacatatgcaaagcacctagactgtacagtggcttgcacacagttacctttctattgttcttcccatgtgactacatatataatctaaaggccaagagaatttttaaaccataattggaactcagaaagtactaaaaaatatttatacctataactttgtaaaattgtaaaattaatggcaaaaatatgactgataaagtcaaatagtgaaagatctgaaaaagctatttcatgataaagggttactataatatacaatacttataaaataaaaaatgaatagaaaatggataaagaatataaaaggaatttcacagaattcaaatgtccagcattttaaaaatgctgaagtttattagtagtactaaaaaagacattaaaataatttataccccagaaacaataaaaaaattaagagttataatacattttgctgacaagagtgcagacaaaagtgtatattgttggtagaagcatgaaatgtaaaatccctttggaaagtaatccaaaattatttatcaaaaataaaaatatgtatggcctttgacccaacaagcttttggataacaaatagaaataatagttttattacatcaacatgtagggatggttattcccacatttttcatagtgacaaaaaaatgaaaataagactttgaaatccaatgcaaatcactgggaaaatggtggtatatttatgatgtatcttcttcagtcatttaaaagaatgaattaaagtcacagagttgacttggctggatatccacaatcaatatattatggagtgagataaacaaacataccaagttgtatatattatatgactttatttttgtaaatcaatgacactcactccctacaacatacataagtttatatgaaaatgaagaaaaacatgagaagattacgtactaggttgcaaatatatgttaaggtgttgccaggcacagcggctcacacttgcaatcccaacactttaggaggccaagacaggaagactgcttgagcccaggagttcgagaccagcctaggcaacacagggactctgtctctacaaaaaaatacaaaaattagccaggcatggtggcatgcagccatagtcccagctactcaggaggctaaggcaggaggatcaactgagcctgggaagtcgaagctgcagtaagccatgatcatgccatcacactccagcctgggcaacagaacaaaaccctgtatcaaaaaaataaataaatagaaggtgttctgggggatagatgatgggggcaagaggagaaagccaagacaaagaaaaacaggatgcataaaagtaaaatgcacatgctaacaaaaaacaagcaatgagtagattatatttataataagctgcgggtatattcacaaacatataaaatctgaatgatagcaggtatgacattatttctaaatttttttctatgtcatattaatagtatttgtataaagtagaattcccttatccactcagaggtatgtttcaagaccccttaggggacatctgacaccacagacagtaccaaactcaattgtcatcagttggaacatggttttcttcagactttccgcccacaaatgcaatgctttttccaccttaactaagcacttattatgcactgtgctggtaacttttgcagtttgaagtatgacagcaaaactagcacaaatttcttattccctcttcacaattttatagataaagatgcattcttactatggatcttagcaacctcaacatacgctatttcttctttcagttcgagaactttcaccatttcacttcgaggaatcattttacagcttctctttagcatatctcaattgccaacatcactacttttgaactttgggacgattagtaagtaaaataagggttacttgaacacaagaactgtgttaccacattagtggatctgataacctaagcaactaacagcaggtagtgtagacagtgtggatatgctagacaaaggaaagatccatgtcccaggcaggaaggtgcaagatttcatcatgctactcagaatggtgcacaatataaaacataaattgtttattttgggaattttttatttacaattttcagtctacgattcaccactgtaactaaaactatggaaagcaaaaccatggataaggggaggctactgtatggtcatgtaggatgaaagtcaacttatctttctttcctttcttttagtttccagagctcaacctgcttacctttttttccctactttaacgtttgcaaaattctttctataggtttttgagaattcttcgcctacaaccagcctcccttccttctcattgtccttaaaaataagaatacaaaccctttgaattttaaatgttttactcttgttttctatcaggcaccaaatattcaggtgactgatagaatgattcacagacctttgtgagtcattaagtgtgaaacatgattcagaagtagcaactggaaacaaacacagtcctctgttaacatctcagagttcaccaaacttttttcttacccatctctgatctccataggcctaatgtaacaacaagagtagaatactaattttctggggtactgtgggtttgtttgcttttttttcctgaggaccggtatccttaaatgcctatctctgtgacctctgccacaaacattaatagtcccacatttgttaatgcatttttatgttgatacaaatatagtcctttcctagataattttttttcctttggtttattttacttcattcataattcatatcaaaatagcaatatttaaatgagacaagtcaattccttataatacattcttccattttcaaagccttgcacatttaagaattaaaataagagaaaacctttagaagtttaaatccattattctttttttttacttaaaattttattaaggtatagaaaatacttggtaaaatacaaagataacaggtgtggaacttgatgacttctaataaattcagacacctatgtaatcaccatcctattataatataatatttccatcatcccagaaaggttgctcacatctcttcactgtcaacatctcctgtaaacattcactgttctcatttctttcatctctgattagttttgcctaatctacgcatgatacacatggaatcgtacatcatgtatccttttgtttatggcttctttcactcaccgtaaagtttttgaggttgttccaagttgttctgtgtattgataattcatttctttttattactgagtagtattgcattgtataaatgtaacatgattggtgtatctacccttcatttaacattcaagtagtttactaagaataaagttgatgtaaacatttgtgtactagtctttttgtgaaccttgtgttttcagtcctcttggacaaatatttaggagtgacactgctgtttcataggataggtggtatgtttaagttttgagaaactgccagaacagttttcaaaacagttgcactattttacactcccatctgcaattgataggagttccagttcctacacatcctagctaacatttggtgttgtcagtcttactaattttagctatcctaacgtgtagtagtgtctcctggtggtttttcaagacaacaaattgtgctgaacattttttcaggtgcttattggccactcacctgccttcctttatcaagtccctaatcaaatcttttgtccatttgttttattgagttatctttttattattgatttgctaatatttagtagacacaagttttgttagataaatacatggaagatattttctcccagtttgaggcttgcctaatcattttgttaataatctaatatcattgaggagatataattttctagaagtctcttgttcttcaatggtaaatgggtcttgaaaagacatcttttgcaaatatattttttaaaggcagcttgtcaatttcttgaaatgacctactgggaatctgaatgggattgagttgaattgatagataaatttggggagaaatgacatctttataatactgagtcttatcatcaaagaacttgtcatatctttcaatttatttaggttttatttttttttccttaggaatattttgtagttttcagtgggcttacagatatttcaacaaattattcctaagtattttatgtttattgaatattattgtaaatgatattaaattcatatttttgaattgttcatagaaaaaacaatttttatgcccatcaatggtagatcagataaagaaaatgtggtacatatacaccatggaatactatgcagccataagaagaatgagatcatattctttgcagcaacatggatacagctagaggtcattgtcctaagcaaactaacgcagaaacagaaagccaaataccacacattctcacttatttgtgacagccaaccattgagtactcatggacacaaagaagggaacaagagacactggggcctacttgaggttgaagggtaggcgagggtacctatgtacctattgggtaactatgctatataatagtataatagtatacctattgtatactatcttgtacttgggtgacataataatatgtacaccaacctatattgtgttttagctatgtattcattttcttaaaaacaatagagacctaattaggttatttatttttaattaaataagctttagaagtttctgtcttcccagtaatttgttcatttaatctaaattgtccaatttattattttcatggctataacatgtataatgttcttttattccaatattggtagttcataccttctctgttttttattaatctgattagatgtttatcaatcttatcaaactttttaaaaaacagcttttggtttcactggatttctagttttttaaagttgatttttttccttttacctttattatatccttccttatgtttgagtttaatttgctcttcttctgacttcttaatgatgagcctcagatatttgattttaaacttttctgttgttctctatattgttatttataaagatataaatttcacagttataggttttcctctaggtactattttgtccatatcccactaattttgatatattatcttttcttttcacttttattgtggagattgggtttcactgtgttgcctggtctggtcttgaactcctggcctcaactcatcttcacacctcagcctcccacagtgctgggattacaagcatgagccagggtacccagcctctattttcattatgactgttaaatacttcctaatgtccctaatggttgcctaaccctatttaagaatatgttgcataatttgaaatatttgggatttcccagatatcttcattactttgatttctagttcaactgaattatgaataaagaatacaatctctgttatttaaattctattaaattagtgcactccttttataaccaaacaaatggtcttcacagtaaatattgcacttgcatttataaggatgaggaattctggagttaaaggtgatgtatcaatctcaattaggttaaatttgttgatagtgttcatgaattctacataattactgacaatacctattgttctatcagttactgatagaaaaattttgaaatctcaaatataaccatgaatttaaatattttcccttcagtttgcttcacatttaaaatctctattatttgatggtatattaattattactgctgtaacaaattaccacaaacttagtggcttacataacacaaaattattatcctataattctggaggacagaaataaaaaatgttccttaatgggctaaaaccaaacctgagttcttttcggggccccaaggatggtgtcatctataagaaacaggcttccaccagacacaaaacctgccagtgcctcaatcttggtcttttcaggctccagaacagtaagaaaataaatttctattgtttacaaattacccagacttaggtattaatattttgttagaggagcacaaattcactaaaagagaaattgttgtcaagagtagaatattgctacaacatatatctaaaaatttaaagcagttttggaactgggtaatgtgacaatattagtatgaatagaaggaagtcagatgctattcatcaaagcaatgcaagaataactccccaaagcatttcagagatctttgagtctgccacacctattacatgcccagagtgccagggcctgagggtagatctttttcaaaggaggggcccacaacaccagaggggctcaaggcacccgtggtaacttggggctcaccaaccagcacagctcaagtctccgcttcccgcattccagtacagtgctctttggccaccccagctatagctgaggaagggccaggtgcagttcaggccacctctctggaggacataagtgataagcctcagtagcatccatgtggtgctaattctgcaggcccacagagtgcaatagctgtggaggcatgacttctccacctagattttaaagaatccttccaagagtcccatggccaaggcagaaaactgctacagaagtggggccactgaatagagcccccactagggcaatgcctagtagagccatggggttgggaccaccaaagacagcacccactagagcaatgtctagtggagttgtgggacctgtcccacagttgtattttgaaggcggtaacttgtttgatttcacaggttcacaactgaaaggcaacttgctaaggctaaaacacaactttcagtctcactcagtctgacttggatggcatctacatgatattctggacgttaaacttttgagctagaaggagttaagacttttggtgctattgtggtagaataaatgtgttttgcatgtgaggttgacatgtattttgcggtgggaatgctatagtctgaatttcccccaaaattcatgtggtgaaacttaatctctattgtattgggcagtgtggtctttggaggtgatcaagtcatgagggctctgcccttatgaatgggatggataactttataaaagggctgaaggttgaaggggccactatcttaccctttctccatgggaggacacagcagcaaggtgccacgatggaagcagagagcagccctcaccagacacaaatggtactgacttcaccgtggaattcccagacaccagaactataataaatttctgttcttcataagttacccaatctcaggtattttgctataccagcacaaacagactaaggcaggtgagaaatgctctagttgacatatcctatgaggaattatatgagatccagatgatatcactagtgatggtaacttcatcacttgattaaggtagaattagccagattttaccaccgtcaagttaccataattcacttcgcatactcttttctatggaaatgtgtcactgaatctagactatcctcagagggaggtgggaagagtaggaattaagttccagctcctagaatgggaagaatctatctatctacccatccatccatccatctatacacaaatacatactagattttaaagttgtacaatctctgtcacttctgggactccactatttaatgatgtttctcctggattagaaccatattttcctgcttctttgcatgtctagtcattttgtgtgttagacattatggactaacaattattttatctacatgttgttgtcttactttagagaataatgaagttttgctctggcagatgggtaatttaattgtgaatcagatggttccttttcaaggttgttttaagctttgttaagacaagtacagagtactatatattatctaaggatacaggagagtacttatagtctcctacaagcacttcttatacatggtcataaaatagaataattggggcaggatgggaacagcagaaattaattttttcttatagttacatcactaacaatccatactaccttcctgacagtacttttcacctaggcaaatgattgtactccataatttctcacacaaaaattaatctacaggcttcttgcaatgtttatttcaccataattttaccttaataaatgtgaacagaagagtggagacagggtaatatagccaggctaatttgaatcctggactttccaagggataaaccaaaaccaatgggcacaaaccctgatttcactgtgttctacccaatagaaaataaaccagcccaagcataaagcagcccaagcatcattcaggaattttatacagttatctatcatgggatctttgcttcttaaactttattatatttactaatggctttcacagtctgtaggcatatttttcactgataatgaaatacagtagaaaatatcctgaggaaaaaatatttaagctttaaactcaggctacaggtagattgtcccttcaacttacaaatattgtgtattgtgaaatactgcctgtaaactagcaattagtcccactgaaatttaaaaatattaattagatgccaaggttttctcataaattactatttgattcaaaaagtgactgaatcatttaataattctgaattctaatctcgcaaaggccaaacatcctcttagcttcttcccatctcaactccaaagcctgacagaagtaatcatttttatagaggttaacaataattcaaaatttctaagtaaagagtgacctatatatatcttgatatttgtttggaaagtttgggaactctttaatcaattgtccaattacaaaggtctaattctactaagagcaaatgttaaaatagatttcaattctatatgtactgaaaacagacttacagacaataatatttttctatttatgtcttatatgaagtattatcagctatggagtgagcatcagaaggcattgtgtatagtctgcatatttaaaaaaaactgaagaaaatattattttatgctgttcctatgcagtcaatgacatgctctggcttttttttttctactaagagaacacattttgatttcagtgtttttccattatgttcttttttttcatagcccaaaagattcattactttgataaccatttatcagggactcaagttcaatctataatacctattgaaatagcaaataattcagcctcagtgtctgtgtgtgggaaaatgggctgtgtgctagataaacggcctacctgcctctgacacagattaggtcatcattcaaactaaccacagatctctagaacaaatacaaggaactacaggttcactttagctgatgtttctgttttagaaacagtcttccttttagagagttacaatatcatcaaagtatcatggcacaggcttgaaaaaccagcatccaggaacgtaaggatagaaatatttcacaatttttacaaaacaccaattatgcaacacatacttatatctgatttctcttttacactagggaatcttataaaacccctgctatttccatctgaatgaaattatataactatattatgctaggttgtaggcaaggaaagccgttacagacatacatctctttccatatacaaataagctctattttattcctctcaaatttctaatctcttcaatcttgctattagaagaaagaagtaaacattatttaaagaaggaaaccagttggctaccgagaccaatcctcacagggtgtaattaccttggtaaattcagcaaaatccagtttacattaattttacagattcagaaataaagtgttattacaaaggaagattcatttgtgaggaatatatttcttttaaccaattatacaaaatagaataaatgacttttaagatctacagaaagcaacattgccaatgaggagactagacacagagtacattccttttgtacagagaaaaaagaaaggaagaaaagaaggccaactaaattcagaatgacagcttactgatttaaaatgagaaattataatggctgttttctggttaaccatgggagagtaaccttacatttttatctactcccttgccctatggcagactttgaaggttacatcccttaacctccatttccaaacctatgtttccttgcattcttctgtaacagatgtttcacctcctctataatatgctcatttgcagttacagattgtaaaaacagtcttacttaatgagatatacagaaaaatttgataagggggattgtgggacaagcatcagtttctcaataaaaagatggataaatatgttatagccattctctcttcactttctccctcctatttaaactttttattacgaaaattttcagaccttcacaaaaatagactagtataatgaaacctttatattaatctatgaaacaatttcaataattatgccagatttgtatcatctatttcccttgcgacttctttccttttggaatattttaaagtaaatcacaggcatcataacatttcatccataatttcttcagtatggattcctaacagatgaagacttctatttttaattaacataaacatgatgccattatcatgtataacaaaataaacaatttattaaaattatctatgtgtaaaaatcctgattgtctcaaaaacatatttttatatttaactgtttccaaacaataatcacagaagatctatatatcacaattcgttgatacgcttttcaagtttttaatcaatgagagaatctctctcttcttcttttcttctactttttttttttttaaagaaactgggttatttaatctatagaatttaccatattctgtgcctcgctgattatttcttcatggtatcatttaatttgtttttgtatccactattcttggaatcagcaatttctccaaaatgagatgcaagcgtctcatgaaatctgctcagtgatttccaagaacggttttgctttctcaatatagaaacttttcaaccatacttttctttctagattatttaaacatcgaatccgagatacctacatctctgccagagggctctgtacctgagggaagtactggctgaaccaaggacataattttaaaattctgaaggaagtgatggtcaacctgaagttctatacctaatcaaactatcaaccaaacttgagggcagactaaagattatttcagatattaggcatttattaaaggatatgtacttcttaggcatttattaaaggatgagcattaccaaacaagggaccaataagacaaagaaaaggaagaatgagatctaagaaataaagaatccaatttacaacataaatcctaaaatgacagctatgggctatgtatattaggcaaacaatctgagaggttggagcagaagaatggatgataactaaaatatactggaaactgcttatttttttctcagcactatcctgctcttctaagctctatcttgaataatgagaactgaaaacttataaactatgtttcctacacttcttgccaggaggtttttcacttagagcccacaatgaaagaatttgtacaatatttagatggcagaagaaaatgagaagccttgttctccagggacaactgagggcagatgcagtggattccaggtgccaaagacaactgacataagtagctgtggttcacctgcaattcctgtactatcacatttcttgaaatccagcaatgatttcccattggttctgttagtctgtaattttaggcattaattcctttctttttaaactatgtaatgtagtttctattttccttacctaacctcaagtgattcaggaattctttaggtaaaaatatagaagtaatggatcatctgatgcttgaatgatgaccattatttatatactcactgtactataaatatcaacttctgattttatttagattgtggtatacctatatttggaagatagggatagggaaaaatgcgtgtgagaaatatgatgataaagaatgatacgttgtaatcccagcactttggcaggctgaggcaggtggatcacgaggtcaggagatcgagaccatcctggcaaacacagtggaaccctgtctctactaaaaatacaaaaaaaattagccaggcgtggtggtgggcgcctgtagtcttagctactcgggatgctgaggcaggagaatggcgtgaacccgggaggtggagcttgcagtgagccgagatcacgccactgcactccagcctgggggacagagcaagacttcatctcaaaaaaaaaaaaaaagtgatactttcttaatttccataaaagaaagtctatatacagtttaaaggtcttaagtttttttaaatagcagcataagcccaccccctctccctttttttattttaggcagtaaggttgtcttaggagagtgagtcaaggaacgaggtagaggattgattttaggtaataaagagcttttcagcatcatcgattttttaggtagataatatcttactttgttaaaaaggaatttttaaaaggggttagcaaagaaaaacaaaataagaaacagacaaagttttaaaacaaacataaaagatgcttgtgaaataactgggaaaatggctgcaaatacagttgcaaaataatgacctgagtcctctgtgacattactccttctatatatatttatatgagatgctaaattacaataaaatgtgtgcttgtttttcatttggtatgcatagaaccaaatgaaggaagttgagcaaaataatttaaatttgtaatatacttagctatgatagcctaaaacatttttctctacatgagatcatacatgtcaccaggacttatgggtttaaaagatttcctcttcctcagaaagaacatatattttcatacagcaaaatcattagcagtgactctgtttatggatcctagaatcgaccagtttcccaaataactggtttattcgcatatgcaggtctgtgtgtctatcaaaacaggttatagattaaatctaactcatctggaagccactctttacctttacggtgagtatgcatgttcctctcaaatccattttgtgaggatctattaattaaatttccaggtatccaagtattttgttaattaggagtggtaacaggagtggggatgtcactgggttcccatgtaaaacaaacaatattagcttatattaaaagcaataatctggccaggtgtggtggctcacatctgtaatcccatcactttgggaggccaaggcgggtggatcacgaggtcaggagttcaagatcagcctgaccaacatggtgaaactccatttctactaagaatacaaaaattagctaggcatggtggtgcgtgcctgtaattccagctacttgggaggctgaggcaggagaattgcttgaaccaggacccaggtagcggaggttgcagtgagccgagatcatgccactgcactccagcctgggctacagagcgagactccatctcaaaaaaaaaaagaaaaaaaaaataataaccagcttaagacaaagtagactgtaacaatcagtacactcttttctctactttttcttatggaaaattcgaaacatacaaataaagtagagagaatataataaattcccatgtagccatcacctagactcaataatttttttattctgttgatcttcttctatctatttcgcattatacttttctttctagagtatttaaaaactagtctcagatatcatgttatctcataatccttgcattccaaaatgtagactaagccatccttgactattttggcaggaattaatatttgaatagatatttaaatcttttgaaatttaatatgtgaatcaattgctctggcataagaagaaatacatattaggtgttgtcatatatactcttcatggttcatacaaattcagaaaaccatttaagaaaagaactgtccaacctcaggtgtgaaccataaagctctttcagggcatctattctctaagaagatacaaaagtgctaaggaagcagaaaagtatagagaaaaaaaaagtgatctaggaaaagaatcatcaagggagtatagaaaatctgaacttagagataaacactcagatactctggatgcctaaaaataagactatcatagtagacattgttagggctctcctcatatcccttggcaatttcaacaatctcctgtagacttccatctggcagtatctacacatccatgtgcctgagggagtactggttagacttggaataattttctgaagttggtgtataaataccacagctccctcaactctctcagttgggataattatgtgttatattttgcactgtttccaaaagttatcctgtaggattaaattcatctggcagctggcttataaggagcccatcattgtttcccctttccctgttccattttcccacctccctactagtgtcaccagctagtgtcaactacttgcactggaattcctgtttcagcatctcaacctggggaaacctgacacaattactaaacaagattcctttcttgttcttttagatgagcaaaaaaggaaaagaaagaccttgtattaggtactttacaaaaattaccttagtaaacccttataatgataatgtgaagtaagaattatacacatagggaagctcagaagttgtgtctgtgatctcaccactgggatctgaattcagaaataaagactaggaaaagcaccagcgacacgaattcagtaaacctgaatttccatatgccccaactcccaagccaattttacccagtgttatttcctcaaagcactgtagtatttgaaattatcttgtatatccatttgtttacttattgtctctctctcccacccactttagaatggaaggtacataagatcaaggacttttgtcctcattggcatatctccagagccatgggtacatttagacacaaattaatattttctaaatgaataattcagaatgattcttaaaatcaaaatattttggcttatattttgtaactcatctttcccagattttttgcaactcaatcccactttgctgattttccagaaacaccatgtttccttgccattccagtcacattcctccctccaggcctttccatttactgttccctctgcctagaatgttcttttcattagacagtcctcatggcttcttccctcacttcattcagatctcttttattgaagagacattattgctttcctttgtccttagtaattatcaccatatgacatacgtgtttatttccatgtctatccccactagactataagctcaacaagaggagaagattgtccacatttcttcactggtatattctcaacacttagaataaattttctagcatgtaacaggcactcaacaaattttgatgaatgagtggataggcacaatataaatttaaaatgtcatgatatcaacaacctccataaaattattttggttttctgaaataatcttcaaaagtaccaatacaaaatatgaaactgaaaagacccagttaaagttaagtggcactccatgcttaactgtaactgatgtccaaacagttggattctcctaattaaaataagacacaggacatggaatcaaaagacactttccagatctcaaatgtaagaaatcccagctactgtgctagacctctaccatgcgtatcatttaaatataaatgaaaacttcacacacatttgattaaatgtcctcttgttagttttagctcagttttgcagctgcaactgttaattttcaacagtttagtgaaaactgaagaataaagcccacttttcaaatggcatgttcttacagatcgtatagaggactgtcattctcatctcccaattggagcttgattgattactccttttccttatgttcattaatctcgtcaccttatcttttataccacttcattttagcagaaaggtaataataaaaccctcatccattatccttgtactcatctagtcaagcggaaatggttaataacatgctacaaattgaacttcaatcacttcattttctcctttgttgaatacacattaaaatatattccaaaagtgcaatctgttttacaggagaatttgtgttatattgctacagacaactaaaattaagtgtttctcagtttggttattaaatatatccaagtgctcttttaccaataatactaaaacattaactcattttattagggtataataatacaagagccttatctcttagaacacaaagacatctagactacctaatagtatgtgttatatgatagggtcatttatctttaaaaaaaaataccagtgataatttatgaattggtatattattacaaatgaaattgctatttttaaaagttaatttgtttacatgcaaccttatcttgaaatgcaagccctattagtgaaaaagtctataactgtcatataaaacagaaagagaagaatgggcatatacataaaatagactcaatgatttaagattttaaaagtataatcactgaaagaaattaaatttaatatgtaattagactagagttttcaaaagaaaaaagaaaaaatgacttctgaaattacaaaagatttttatgtacatcacaacaattgttgaactgatttctaatagtcttaaaaatactgagaggaaaaaaactatccttttgggaaaaaagaattttctactaatgtgggtaagtgtcttctatctatttataaatggacatgctcaccaactaactaaaaactagacctacagcaaatgttgaaaaacttaaccagataatcaaggcttattgtctattatctttctaccatcctgaaaaaaatgttcttctgaatctagataacaatgttagcaactgacaatatcaatatttgagcacccgaactctactacttaataaacccatctttttttgtttgtttgttttttaatttttttgagacagggtctcagtcacccaggctgcagggcagtggcaagatcactgctcatcacagcctcaacttcctgggctcaagcaatcctcccatcttagcctctcaggtaactagtcacatgtcaccacatctggctaattttttaattttttttaagagacagggtttcaccatattgcccaggctgttctctaactcctgagctcaagcaatctgtctccttgggctcccaaaggctgggattacagatgtgagccatcatgcccagccaaaacccatttttttttaattattgggaaagatacatatatatatctatttgcttacactgctgctgttgttgtttgaagggcatgtgtgtcagctatcaatttatcacctcttagttccatatttacccttcattatctgctctgaagtaatgaacctggatactttaagtatttctcctttgtagtagcatgacgttgttgagctttttcaacagacagccctggagggacgctgcaggatgaaagcagcttctttccccccattccagtgtgctcaactcatcgggcttccttccactcagacattagctaatgagtattaatactgagtgcctgaaatgatattttggcaagtttgcctgacctaagagtcatagagatcacagtggctgataagtcaatctccattccaccaccttctgttttatggcagaatgtgccataaaacaaccctacggccatcccatttggctcagtcatgaagatgctggattctatgatccacagacccacatcaagtatctctaccccagtccttgtcttttcctgttgttcaggatgaataccatatgtatttgccctgcctttctcagaagcaacaaaggatgaatgattaaaatgctgcttttaaaaagtgcattcctttttatccattaaattgtttcactataaaatatacacatagataatatataataattacaatgttatattttataagatcatttagtcaaggccttggtttttccagaatatagaacagtagtataccaaatgtatacattattgttcacatttaagactttttagttgtatacatatgtaactaacctgcacattgtgcacatgtaccctaaaacttgaagtataataataataataataataataataataataataattttttttaaaaaaacactttttagtacatcatccagtattcctaatatacaaagctaccctcctttttgcatgatttacacgttttgctttagtggaaagtttttaagatacttgtcatgttaggcatgaattacctgtcatagttacattatgttctccacaaataatccttcttttctgtaaactgtacaaaacaaaacaatattacaaaaacaatagcctaaacgtttttagatacttttttcctacaaaaagctgtaagaacatgctactaagtttatattacatatattacatagttccttttaaggagacaggaagaattaacatttaatattatttagcatgtgaaaattggaaaggaatcaatcaataagcctatgtatgcaacaatttttgtttcaccctctaaacattcttaaactatatcagatgccattgtctataaaaaatgaatttatcaatttaatgaggatttaggcagattagttgcttaatgagaactccagctaatgtgacagaggttttgtttcagtgctgacaaaatcagtgtgataaaactgtgattaaactgatgagagtacatttctttttaaaatcattatttcacataattaatgttaaacagcaatatataatcatttaaaaatattgtttataccttttatattttaatgtttttatatttagacataatagtttcaatattttacaatcctgagccttctcctcttacctttatctattgtgtattattttgttttgttttttagagatagtgtctttctctgctgcccaggctagaggggagtggtgcaagccttgctcactgaagcctcgaactctggggctcaagtgatactcccacctcagactcctaagtagccagaactacaggcccatgccactatgcttggctaatttttttctttattttttgtaaagatggggtctcactatgttgcctaggctggtccctaattcctggactcaagtggttctcccactttggcctcccaaagcactgggattacaggcacaagccatggcagtcaacctactattctgtttaattgtttcactcatttttcttgattttctctccttctttgttctctttctatatttacacaaatacataatatcaccatttaaataaatgcaaattacaattcacgcaagaacagtaattcccaatatattggctaaaagaaaactctattatcaaaagctttctccttagctgggtaatgctttggttcatagattagagaactatctaccttaaaacaaagactttttaaaattgaagatagaaaacatctgtaaacattctacattttcctatgttgtttcctaaataacctaaaaggtcaataagaaagagatattttgtactataaaatactttcgttcttaagacaagggtgctgtggcccatacatttgctagtattcctcttactgactctcagaggtggtgtagttaagaacagaacttcgacatgactaatgggggtcagcagatattacgtgtctcctcatatgttccaatatgaggcatacatcatcaactatagttcacctaaaaatatttaccttaatataaccaagcctttacatttaacttccagcttaaaggattacaaagtatcttttacaatataaataactactataagcaagtaaatagataagtgcagaggtaggacactctacagaacaaatgcactggtctcctcaacaagccagtgttatgagtaaagaattgctctgaaatgaaaaaaagacttaacagacagaacaaccagatacaatgaggattcccagattaaattccactttgggcaaaaaagttacaagggatatttttggagaaagaggacacatttaaatattgattaggtatgagataatattaaggactattattaataatttcattagataatattgttactttggtctttgtaggaaaacatattgttttaaagacatagaaaagtatttaggaatggactgttgggtaccaatttattttaaaacccttcagcatttcacttgtggtagtgactgaatttcaattgcggtcgattttggggcacaaaggtggcttctggtgctggtaacattctgtttcctattctagttgctggttttatcattctgtccactctgcaaaaagttagtgtgttgtacaattatgtgcagttttcagtatatgatgtatttccatgaacagtataaaacaaactaatcagcgttaaaaaatgtttacatgaattaattttaaaatgcaacagctctggattaaattgtttggttttcaattttggctctaagcctaatcaagaacacaatcccatttataatagacacacacacacataaacaaatgaggtgaaaggtctccacaaagagaacaacataacattgtgaaaagaaatcagagatcacacaaacaaatggaacaacattccgttctcatgaattggaggaattaatatcattaaaatggccatactacccaaagcaatttacacattcaacactatttctctcaaactaccaatgtcatttttcacagaattagaaataactattctaaaatcatatggaagcaaaaaagaggctgaatagccaaaacaatcctaagcaaaaagaacaaagctggaggtttcacattacctgacttcaaactatactataagactacaataaccaaaacagcatgatactggtacaaaaacagacacatagaccaatggaacagaatagacaattcagaaataaagctgcacacctacaacaaaagttttaaaaagttgacaaagataagcaatggcgaaaggactgcctatttaataaatagtgccggtataactgggtatccatacacaaaaaatgaaactggaccactgcctttcaaaatatacaaaaattaactcaagatagatgaaagatttcaaggtaagacctcaagctataaaaatcctaaaagaaaacctaggaagtaccattctggacattggccttggcaaagaacttacaaccaagtcctcaaaagcaattgcaacagcaatgtcaacaaaaaatgacaattgagatctaattaaaataaagagcttctgcacaccaaaagaaactatcaaccaagtaaacagacaacccatggaatgggagaaaatatttgcgaactatgcatctgacaaaggcctaatatccagaatctataggaaacttcattcaacaagcaaaacccaaagaaccccattaaaaagtgaacaaaggaccgggcacagtggcttacacctgtaatcccagcactttgggaggctaaggcaggtggatcacttgaggtcagcagttgctcaggaccagcctgaacaacatggtgagaccaccatctctactaaaaatacaaaaattagccaggcatggtggtgcacgcccgtagtcccagctatttgggaggctgaggcatgaaaattgcttgaacccaggagggggaggttgcagtgagccaagatcacaccactgcactgcagcctgggtgacagagcgagactctgtctcaaaaaaaaaagcgaacaaaagacattgaacagaagcttctcaaatgtgtccaatgtgcaaccaacaaatatattaaaaagtgctcaacatcactaatcatcagagaaattcaattcaaaaccacaatgagataccatctcacactagtcagaatggctattattaaaaaggcaaacaaataacaggtgctggtgaggctgcagacaaaagagaacttttatacactgttggtggaaatgtaaattcgttcagccactgtggaaagcagtttggagatttctcaaagaactgaaaacagaactaccatttgacccagcaatcccattgctggatatatactctaaagaaaataaatcattctaccaaaaagacacatgcactggtatgtttattgcagtactattcacaatagcaaagacaaggaatcaacctagatgcccagcaacagtggggttgataaaggaaatatggtacatatagatcatggaaaactgcacagccataacaaagaataaaatcatgtcctttgcagcaacgtgcatgcagctggaagccatcatcctgagtgaattaatgcaggaacagaaaaccaaataccacatgttctcattcataaatgggagttaaacactgggtacatatggacatacagatgggaacaagagagattagagactactaaaggggggagatggggaggggtaaaaggggtgaaaaactatctactggccaggcgcacacctgtaatccaatcccaacactttgggaggctgaggcagaatgattgcttgagcccaggctcagtgagccaagatcatgtcactgcactctagccggattacagagtgaggccctgtctcaaaaaaaaaaaaaaaacaaaaaactacctattgggtattatgctcactacctaggtgacaggatcattcctaccccaaacctcagtgttattcaatattcccatgtaacaaacctgcacatgtagcctctgaatctaaaagttaagggttttaaaaacctttaactttttttttttgttagacagagtctcattcttgtcacccaggctggagtgcagtggcatgatctcagttcactgcaacctctgcctcctgggttcaagcaattctcctgcttcaggctcccgagtagctgggactatgggcacgcaccaccatgcccggctaatttttgtatttttagtaaagatggggtttcatcatgttgttcaggatggtctcaatctcttgacgtcgtgatccgcccgctgcggcctcccaaagtgctgggattacaggcataagccacagtgcccagcagtttgtttaaattgaggctgtaccatgaactgggtaagttattaacagccctgcacctcaatttcttcatctgaaaaatgttagccataaaaaattttttaccccaatttctaaactaggctattctaaggtattttcttctttcacttgccattttttgtgtgtttatattactttccttattcagtccaaaatagatttccaatgccctatctctaaaagttggaaacattctgaaataaatctaaacaagagttttcaattgaaattaataccagtagtcttataaagtcgaaaggagattcacagtatcaacatagtcttaagcgcatcttaaacaatatatctgctctgaatagttacctggaagtggcagtgattgtatggcctcactagaatccaacgtaacatataccagaatattatacattaattgacctgaacactactcagtgtgctaagtgatctggagaacagtaactgagatacatatacatctagaagttcacaaagggaagtagaaaaggtgttgccgagaagactattcaagattactttgtcagtactgaaactgtatattttatcagaaataaaattctaggaatatcttttagagtatcagttcgttaaacatcagtaaaggaataaaaacatttatgtactcacaaatatcgtattaatatttgaaagttttttaatgtttagtattttattttttaatttttatgtatttatgtcatttgaagtatactgaatagcttttaaattaaatcatagctaacttactttccgttatatgtcttgctacttaataaagaatatcacaaaatacctaggttttacggacattttaataatataaactgaccattatttttgcattctcgaaaacagaccataatactcttaggtagtatgctgaacatttgggatgggtttttatgggtgttgttgttgttgttgggagacggagtctcactctgtcacccaggctgaagtgcagtggcgcgatctcggctcactgcagcctcctaggttcaagcgattcaagtagctggctacagatgtgcgtcaccacacccggctaatttttgtatttttagcagagacggggtttcaccatgttggccaggctggtcttgaactcctgacctcatgtgatccgcctgcctcagcctctcaaagtgctgggtatacaggcatgagccaccagcgcccagccaacattttgaaaaacaataaaaatgaagattttaaggcatgctattgttttacaaaatagcctggcttaattttgtagttgtaaagtaactcaacaaaaagcaattgtaagaatgtttataatacattccttaataacaatagcaacttatactttcttaaaagtgtttttcctttataactttcaaaatgttactattacacaactcagtgatatacatgtgtcatataagttggtgcaattatctagcagaaatacagccacagaagctaagaagggccctgtgtcagcaaaatcaactttaaagaacatcttgcttagaaactagagagcataaactcaaaatttaaagctatttttgttgctgtaaatttttaaccatatagatgcaccattaaacagcaaaacttttctgattttcaggatgaattttataatgctaatatagagcagcggaaatcataaccattactgtcctcaaaaaatggtggctttatcagttctaggaaaatttacatatgagtaacagaaaacctaactaaaaaatgttgtaggcagcttagattcctttcttctcaaataacaaaggtaaacgaaagttagccagttactggatttagtcagttcaatggctcaaatagtataaaggctcggggttctattattttcttggcttgttccacgtattatgtttaagttccagggaggaagaagggaaaggagaaggataaagaccaaagagcatgactgagctgagtcagctccacctataaaaaggtttcccagaactccaacccagcttctacttatctcttgctggcaaaaaatatacctaatgatcagtcctagcttcaaggaaagctggaaaaactgggacaggagaaggaggttaagctggaacattggttcctttcaaaattcacagtcctatcagttttcttaaaatatatttctgaaactactgccatccaaactacttcatatataacagttcttaagaacatgccaaatatagacatttctcctctttgaaaaaacacctaaggaaggaaaatattaaaaaatagaataaatgattttttaaaaggtatcaatttcagaagtttaaatacatttttatagtgtctagtaccgttttatgctattttaatgattcaactatatactatctacagaagactcactttataattcatttatttttagagacagggtcttgctctgtcattcaggctggagtgcagtggatgcttccttgaacctcatagctcgctgcagccttgaactcctgggctcaagtgatcatcctgcctcaggcagcaataggtgcacactatcacacctggctaatttaaaaaaaatttttttttgtagaggcagtgtctcggtatgttgcccaacctggtcttgagctggtctcaagcaatccacctgcctcgggagactccatttagatttaaagacagaaataccttgaaagtaaataaatggaaaaatacttacaatatttactgcatatattgcatactaatatgtaaaattaagcaataaagcatatgttatgtctgaatcatgcattgcattttagaatagtattttaaaatttatagtacttattaaccagctttttacttttgaaatcaatctcaaacaaaaatgggttcattgcctcacaagtgtctctaaaccttgctcctcccctatcctctggtttcctgcaggcaggcagtataaccaatgggtaagagcatgaattctggaattggactacctgggttcaaaactagctctagcaatgctgggcaaactaattaatttctcttagctcattcagctataaaacagaaataataattgtaagaattaaatgagttaatgtatataaaacttacagcatatcacacattaaaagtgtcatttcttgttattgttatgaccttttccttcatttgtgatacatgtattaagcacttaccatataccagacattgtgctaaatattagaaatttgggtatttgggttatgaccaaatcagacataaactctgtcttgcacatatcaaaaatattaaacatgattttaccacctttttattactataaaaagtgaatactgaatttgttttctgcagctaacgagaagaaatcaataaaggaaagttaatataaacacaaagcaatgaaaatatttataaggcattgatgatgctagccagttcctgcttcctgtaacacctagctatgaatgttcttaaaagacaaatccagaatcgaaaaacaaactcaatgatttaaaatcacccaatcttcagaatttctattccatataattatgaatctgataatgacacatccataatcatacaaaaaaattttaaggtttcatagcaaacttcaagaaaattttagatagtctggtggtactaaaaaattagaccaaaataattttataatgaggcttaacattaaaatacaaaaatgcaaataaattgccatctttattaccaaaaacataagtgtcccaaaattcaccagtcccccacaaaaaactagaacacatatttattaactcaaggggctttgctaattatgtaaatgtctatcttttctacatgtaatttcattcaaacttcctctctttcccccaattaacgatcctgccaaatgttgggacttgaaaaggccacagctttatacacaattaacagtcaaattctaacacaaattacatgtcattcttatctctgtatacacattgaactcctatatcttgttgccaagagggagcttgcactagggaatacatcctgaatttgtttaatgtccaggaataacatttcacacttagaaaggagatactatccactgccagctatgtgaactgaaatttgccatgtcctatccttttcattttgttcaaataggtagtttagaaaatgagtaactatccacttatctgttttaaccaaatattttcttgacgcagaagaggcaatcatgatctttggttttctttagacactttttaggatgattacagaaacttttatgaatggtaaacttattttctgaatagaaattggggaactatcatttgacacataatctcactaccagaaaaaatatttgcaattggatcaatcccagaaaattagatttacatatatggtcattatatttatgattgcttcccgagaaaaggtttcaacagcagcaacactagaaataaccaatttcttattcagtaagtatatgagacaatcatcacatcaaaatagtcagacatgtcccaatcttttgaagtatagcattttattaccaaagtacctcaacaaataccagtcatttacatactaaaagggcaactaaaatatattttatatatattaatatgtacatgttatgacctaaagttatgaaagcttgtaaaacacagcacttttagaatacaaacatccccaaattaaacttttaaagaaacaaatctgattgggtttagttactagcttactgctcttcagtagtctccactgtccttagaatagtatcaactggcatttgtctacctgtccagctttgcctcctacaatctgcttactaaaccctcagctccaaacataattcttcctttctttttttttttttctttcaagacagagtctcaatctgttgcccagactggagtgcagtggtacgatctcggctcactgcaacctcctcctcctgggttccagtgattctcatgcctcagtctcctgagtagctgagattacaggtgcatgccaccatgcccagctaatttttgtatttttagtagtgacggagttttgccatgttggccaggctggtctcaaacccctgacctccagtgatacacccaccttggcctcccataccataattctttctattcctccatctcaacaaactatctctttaaactgacatttaccctaagcctggaatacaataaccgctcatctttcagttcacacttcaaatgtcgtttcctcaatgaagccttcctttaattcccttctcctatccctgacccccaaatagattcagtgcccagatatacatttccatgctactccacacttccttgccacagcaatttctacagtatattgaagcttgttgttcaccccctgttggcatgtaagctctgtaacattaagaaaaaccatgtttgtcttgctcactattgaattcccaaggtctaaacatatgggcctgaccctcacaccctcatttgatttctaaaattgggcttacatatatcaaattaaggcagggctcatatgcattgcaacattcagttaaaatactctcttccatcgttataaattccttcatatgaatataaaatgttctgataaccaaaacaaacaagaaaaagtgaaaaaattgcaatttgtttctacactgccttcagtttcatgtggtgaatctggagtcagaaccctagatttgacttcagattgtatcgcctgttacctatatgatgatgtgaagtgcttaacatcacaaagcctcatattcctcttctgtaaaatagaaaatattaatgcttgtcccacaaaccttaaagagctgggatctattaataaaattatgctcatgaaagcctttaaaaacgatgaagcatttcataataaaatgaattaacatctttgttattaataccataatcaaggtaatctcagttaaaaataatgcatacaaattatttcagaaaaactttggcatatatatgagctagaatgtactagttaaaataaatacaaaagtttaacctcaaaagaagattacaaatcaattgtaaaatacattccaatattctaagatattgttgctacaatctcagaaaattttactcctgaaatttcatatccttcgtgatatctgaaacctatcagttaaattcattattaattcttttattttacttattgcactttagaatcccatccagggaatctgttattattctgagaccacaatcataattctttttaaaataaaaatgtgaacattaagcttaaaaaaaataattcgcaacttaactctgtggtaaacaggtgaacaaaacaacaattatataatatctaaaaccattttatgctttaaaaataggtttatatgtactgaatactggctaagataggaaatatttgatttcaaatttgttaagaatttaaagacataaaaagttagattagaagttatcttaaaacaacaataaggtagtcattaaaaacatgatcaaacaagaaaacaatttcttttaactcatgctaggaaagttattcaatattctattacttattagagtaaaaataatcttggtctttgatttttgagtgttaaaaaaccaaacttttccaaaattcaacttctgatgcaacagctaattcagaaaagaaaaagtttttttttttctttttcctatccatttgggctacatgattctaaaattacaggtatagtcacaaagagcatatgcttcccccaaagctctgaaggcatgtaagaaactactgtagttaaagcttgaacaagcaagtcttttttaatccacatttttcatatagaagaaagatttgtgtattttgcaaaagtaatgctattgcgatattacgactttgaactaaagctctaaaatcatactattcaactaaaggtttctttagcaatattaacatggccacgctgcacatgttacttttagcttctttgtgtacaacaaactgcattcaattggtgaacaaatacaatgtttagtatcatatttaaaaccactattcaaaccttttcttaatgctgttatcagttttccttttgcaacaattttgtgtataaaaataaaagcactggatttttattagcgctgccccttctttgttttgctccactctgcaaagcccttttgggacactaagcctgcatttaccataatacggattaaactttctttgtcccattgcacaaggtttgttagcaggttagtctttttacacttttcacaggctgcctgcagcttaccctttaggcctcactcaaaatacttctgtggatttacaaaaataccagagtggtcttggggttaattggaagataagtgcagtctttaacatagagactcattaaacatttagccttaccacaatccactatccttgaaagagaaaagttctagagacactttaggaataataacacagtaaaattgttttaaaaaatgacgattagttgtttcacagacttggaaaaacttcatttaactaccccaaaggtgatatagtagaacaaagcaatgtccctggtcagctctctacattggttttaatatgcattgatcatagaggaaaattgaacagattttctaaggaactaaaaggcaaaatcttccaaccttctgttgggaaatttaaagtaaaaactcaactgatgggttatgacagataatatttatttgtaaacaaaacatatttaattctaacagtttaactttgttgatttaaattttacccaagtaaatcacatcaaacatgtctattagagccaaatgaaaaatttataaaattcacccaaaaaacttagaaagtatttaaaaatttaagttccttctttaatttctaaaatacatacatatacacaaatatacacacttaaaatgaaatctgaaacctactcattggtattaggttattttttagaattatgcaagcagattgttaaacagattaacttttccatccccttacctccttccaacactattactcccacacaaaaaggaaaaaagaaaaagaaaaatgcgacaaaacacacagacacttgaagtaaaggattagacatatttgcccaagatgcagataacaaaagcaaaagtgaagaaaattgaagagacagccaaacttcagcaacaaaatggttaaagaatctgaagtattgttcccgttattcttaaagtctgctatattgtagacagcgcaaacatcagacaagttaagattactgaccattatctccttaattttctccgctttccctcacattccctcttgctatctgggcaccatttttctaaagctttatttctggtaagaagtaaactttccctaatccatctattatggaacctttaattggattgggagcagggtggtgtataaaatagcccctattcactcaaaaggactgtagttttagagacttaaaggagaaaggtattgtgaaacaaaatcctcagggaatcaaggattaaaatgtggctctcctaaattcatcaactccaggacacaaatgaattgcttccttaaacaggtaactttccaaatacatggcatagcaaaactgaaattaaaattataattttactttaaggaaaataatgcatttacactaataatttttcgctttataaatgacttttacttgctgtttcttcaactcagaattacaatgccagggaacaaatggaatgccttaaacatatttatttatattttctctacatacatattttccctgtaaagtaaggagaaaagcaaaagaatatgctttaatcaattaagtcctgtacgttatatttgtgcagccttaaagcagcaagcactgccataatacaaacatttttttcaaagtaaaaatacatttcgttcttatcagatagtgtcagatacataataatcagcagtcactcttcttccctcaatcagttatcctctctgttttcttcataaacatccccaaaccactctttgttaggctgtagtacttttgtcttctgtcccgccacagtgcacacccaactatttgggatgtcttcaacagtaagatgaggatacagctcatactcagttattctcttactgaattaaatatatttaaagtgccaaacctgctatctaaagtaaaatgaaatccagaatgtatctaccaactctaaattaatctcgcaaatgtctacatactctaccaaaacaataggaaactgaggaagagaaatgttaggagagttcaagattctaatgtaacacttaactctgcatagtttactagtctatattaaaatataaaaatacatcaatattagttatttacctaatggtgctgttaaaaacagatttaaaaaaaaatttaagaaatgcaattaattttaagaaaaccctcaaagtatcccctctgttttggaacctgtatcacaactcaataagtgctacttattattgattgaacccttactaattgtctgacattgtgctaactgctattacatgaattatctcattttattctctcaacaattgtatgaggtagttgctattacctgtttttccacaaatgaggaagctaagtttttaaaatttcaattaaattgtccaaggttacatagctgcaaagaaaataagctctgtgaaagcttttcattactatattataaatgtttagtataagaaagcaggctcatttgccaaagtcaatctgccaaaaaataaatgtgcctaaattatcaaaatcacctatgttccaaccgtaaatatttaaagaatattcttcttgaatgtattaaatctataactatattcttctaatgaatatattctaagatatatttaatactttttaagcaacattttaagaaccactgtttttcaaaactaaagtcatcatagggtagctctgtcctattaccaatataactaaaattttaatgtttcatatgacattttttagttcgtactgatttctatttgtatattttttctatttttctaacattctgtcatgtagaataattgttgctttattttattttattttattttatttttttatttttttttagatggagtctcgctctgttgcctatgctgcagtgcagtggcactatctcggctcactgcaagctccgcctcccgggttcacaccattctcctgcctcagcctcccgagtagctgggactacaggtgcccgtcaccacgcccggctaattttttgtatttttagtagagacagggtttcaccgtgttagccaggatggtctcgaactcctgacctcatgatctgcccgcctcggcctcccaaaatgctgggattacaggcatgagccactgcacccagcctcatttgtcacttttacctatttataaagtattatatcagttgagaattattttaatacttttcaaagtgtatgaagtcttatttgaacagttttcatcttgttttcataacaaccttggagggaacctccatttgtctgtcccaaatcactacagttgaagctgaagaaagcttttttagaggaaagatggaaaagaaagcaaatattccagggagagattctgattcctgaaagtattaggaatgagtatcagggttgagtactaaatggcactatcagagaaagaagatgagggaactacgaatcctggccataggtttcatagtctcttaggccacacctcttaggctcttttaacccatacaacacatagtgtgtaaataaaaaaatacaaactagtttagggtaattttaatatagcagagaattcattttctgtaaatttagctcattagttttagcaaattcctagcacaatggcatgcatatttagtagggcattaaaaatatgtgtggaatggatatattaaaattttatgtaaagtaaaactttaaacactgtattttgatttcaaaaataatctttaattggtcagttaaagtattttaaataaatatatttttaaagataacatgaacatgcatgctccactttaggggtagctaaaacaacaccccaaaacaacctcatactaaaggattattgaattttacatttaaaaaagagcaactatagggaaagaaccaaaaatggatctaggaaaattacaaaatacagcaagtatcttaaaaatgatttaattattaaagcatatttagaatacaaatgagtatttactattttgagagcccattaaaattaagatacccaactattctttttctctgatgccattttactaatagctaagtgtgtatataaatatctcagtcactggtatgtaaatgtcataataaagtgtaatgtatttcatcacattctatctgcacttatgcttccttatgacttcagctaagtttctacacacagtggtttagttttaaatggttgtccccaaaatatgatgagttagaaattatcttgcatttgtgtgctcattcataataaatcactgtttttaggcctcaaataacatcaggtctctatttgctgcttagtaagaggcaactaacatttcacggaaaatagttctttaactaaaagattatatcagggcttcctcatataagattactcaaattttgtataacattggatctctgttgtgttataaaatatttggtacaaaacaaactgctatggtttgaccatatcccccaaagttcatgtgttggaaactgaatccccattttaacagtgttgagaggtggggcctttgggagtgactgggttatgagggctctgccttcataaatggattaatgtgattattgctagggagtgttaattatcacaagagtgagttcctcataaaagaatggagcttagacccctcttgctctctctgtctcacatgctcacttggtcttctgccctgggatgactctcaccaggtactggcaccatgctcttagatttcctgcctccaaaagcatgagccaaataaattctattctttataaattactagtctctggtattctgtaatagcagcagagaatggattaaaaaactaatgaaatgaatatgtaaattagcatataaatatatcaacttgtgtatggataaacatattcaacgacagctacataaaaaagactaaaaagcaggagtggtggctcacacctgtaatcttagcattttgggaggctgaggtaggtagatcacttgagcccaagagtctgagaccagcctgggcaacatagtgaaatcctgtctctacaaaaaacacaaaaattagccaggagtggtggaacatgcctgtagtcccagctactcaggggaggatcactaaaaccagagaggtcaaggctgcagtaagccatgatcatgtcactgcactccagcctgggtgacagagcaagaccctgtctcaaaaaataaaaaaaaaagcaaaaagcttaggaatacaccctgattgaaatatatgatactcataagttatacatgagagagccattttaaaccactaatgaaaatgactgttaagtcccatagaaaagtctattaaaatatatgtatgtgtatatatattttttacacacacacggatatacatataatttcttacatcatacttaccctttagaatagcagtcctcaatcattttggcaccagaaactgatttcgtggaagacaatttttccacagaccaaagtggggtggggggtaggaggtatgattttaggatgaaactcttccgactcagatcgtctgacattagagtctcataaggagcacgcaacctagttccctcatatgcacagtacacaataaggttcgcacccctatgaaaatctaatgccacagctgatctgacaggaggcagagctcaggtggtaatactccctcacctggcactcctctcctgctatgtggcccagttcctgacagggaaactgggtagggaacccctgccttagaagacagaatacaaaaatacagtttatgccaagatccaaaaaatagtcaagtcagaaagttaagaatattatacttttcataccaataaccatatcctgtacaattctcctgtacaggagtgtatcttgtacaatttctcaaaagaagacatttatgcagccaaaagacacatgaaaaaatgctcaccatcactggccatcagggaaatgcaaatcaaaaccacaatgagataccatctcacaccagttagaatggcaatcattaaaaagtcaggaaacaacaggtgttggagaggatgtggagaaacaggaacacttttacactgttggtgggagtgtgaactagttcaaccactgtggaagacagggtggtgattcctcaaggatctagaactagaaataccatttgacccagccatcccattactgggtatataaccaaaggattataaatcatgctgatataaagacacatgcacacgtatgtttactgcggcactactcacaatagtaaagacttggaaccaacccaaatgtccatcaatgatagactggattaaaaaaatgtggcagctgggcatggtggctcaagcctgtaatcccagcactttgggaggctgaggcgggcagatcacgaggtcaggagatcgagaccatcctggatagcacggtgaaaccccgtctctactaaaaatacaaaaaaatagcctggcatggtggcaggcgcctgtagtctcagctacttgggaggctgaggcaggagaatggcatgaacccgggaaacggagcttgcagtgagccgagatcatgccactgcactccagcctgggcgacagagcgaggctctgtctcaaaaaaaaaaagaaaaaaagaaaaaaaagaaaatgtggcacatatacactatggaatattatgcagtcataaaaaaggatgagttcatgtcatttgtagggacatggatgaagctggaaaccatcattctcagcaaactatcgcaaggacagaaaaccaaacactgcatgttctcactcataggtgggaattgaacaatgagaacacttggacacagggaggggaacatcacacaccagggcctgtcgtggggtggggggaagggagagggatagcattaggagatatacctaatgtaaatgacgagttactgggtgcagcacaccaacatggcacatgtgtacatatgtaacaaacctgcatgttgtgcacatgtaccctagaacttaaagtacaaaaagaaaaaaaaaataacactccctcacctggcactcctctcctgctgtgcagcccagttcctaacagggaaactgggttgggaacccttgccttagaagacagaatacaaaaatacaatttatgccaagatccaaaaaattgtcaagtcagaaagttaagaatatcatacttttcataccaataaccatatcctgtacaattacacacagacagatggggggtagaaggagtcaaatcccacttctgacaccagattgtgtcaacctaaaaatagacactagagaaatttgtctccaaatatgttgagtttgtttgggaatgacaaatgaggattatgacatagaatggcaagccaccggtgcatctggtgagagaagggtaaagggaagcttttattagcccaaagagattcaagtaaactacttagaaacagagttcactggttccagaggcttaaagtcagagttatcatcagttcattggtgaagctgctattactggtcaagggttcatttaagagcatcttctctgaattgctatagttctaaaggatgtctagtgataaaccttgccaaaactagtgagaaaccttgctaaagcaggagatacatgcaggacatgaaggagtttcttgtgggatttctagaaagtccttggaaatcattcttatctcagatatataagcaagagcctcctctcctttctgccttcctgtaccaattttgccagggtctgacaaaattgatttcatccccatatctgtaactttcacaggggaaagaggggtaagatagttaaattaaacagagtccctcaaaaatcacccttcctttcttccccttaatttcaaagagccaatttactttacatgttggatactgcgctggagcaagaaggtaaaaccaggaagtaggatcagagagacaagagttactaagccaggacagaaatcagaaaccaaaatgtaataatctgctagagaattaggccataaggaatatctgttattttgcttattatctgtaagaagaaataaaattatagcacagtgatgaaagcacagtgaagagaaaccctaaaatgtttttagtaaaagaatgataaatgaaaattgacaataaagaatcaatcacaactaaagtatagaaagatgctaatatttctttattttacaagcttcatcaatatatattagtaaatataataataatcaaaagggcttttatagactcctttctgacctcatttctgcttactttttccaaaataatcttaaattcttcaacaaaacattctattaccaaggaggcttttcaggaatgttatctttagtataaggtattactaatccttcttaatgatgttctatgccacttataaaaaactcattaggatggcaaacaaaacagccttttgttacattaaactcagtgtttaaggaaaatagttacatattcattcattcaaaaaataagtattttttggaaagcctagagatacagaaatcaacaacaaaaagctgggggaaggaaggatacgatagttgtaagggttagataactactataaatctgtttcaatatgtacctttagcagtaatatttatagaaaataagattcaaaggcccttaaaatatctagggttactctttaaacaaggggaggaaggaatctgaaaacaggtgactccaatatcaattctttccatcaactctaggtcttgtggtgaacacttcagttgtttaattgtataaagaaatgctatcacccacacacatataatactacaatgctactacctatcctcaaattgtatattctactatttacttaaaacacagtagaccttaagactattctgttcaacccataacaattcaaatctacaatcaagttttagtaaagacagcatacttgcagctaatctatattcataaacgacactactatgctagctcatcaagtataaagaattaaaaacaattatatcttacaatacaaacagaattggctgggtgcacgcctgtaatcccagcactttgggaggccaaggtgggcggatcacaaggtcaagagatcgagaccatcctggccaacatggtgaaacgccatctctactaaaaatacaaaaaaattagctgggcatggtggcgcacgcctgtagtctcagctacttgggaggctaaggcaggagaatcacttgaacccagcaggcagagcttgcagtgagccaagatcgcaccactgcactccagcctgggtaacagagtgagactctgtcttataaaaacacacacacacacacacacacacacacacaaacaaatagaatctaaaaatattctctttttttgagacagggtcttcctttgtcacccaggctggtgtgcagtggtgcaatcgcggctcactgcagccttaatctcctgggtccagccaatcctcccaagtcagtagcccaagtagctacacagcaggagcacaccactatgcctggttaattctgttcattttttatagagatgagatactgttatgttgtctgggatggtcactaattcttgggttcaagagatcctcatgcctcaatctcccaaagtgctgggactacaggtatgagccactgtgctcagcctagaatctaaaaatattctagcaaaatatataaaaaataaataaaataaaaattttatgggacctgaaaaatgaatatggagaagccaaataaacatgctctccaatagcttttaatacagttaacacttatttttatacatttgttctaaatattcaaaaaactaaatttaaaaactatctgatggatggtaatcaaaaacatttttgtttgaaaacaaatcatattttaaacagcaactatgtttgaagtttaatatattcaaacatttgattatatggttaatgtctaaagctctacgaggaaccaaatcagagctattcttacttattgctgtaatctcagcatcctacatagttggcatactggcagataatcaaaagtgtttgtgaaatgaataattatatacatagttacacagaatgtgaataccttattagcctatttacttatttattttagtgccataactccaatctctttacttaaaagctcattgattgcttctgcattaaatgtgaaccttctaacattacaattttccctatgaaataagcataatattacttataaattatacaaatactgtgaaaatgcagattgacatattatatagtttggattttgaaaagacatctttatgcatgcacaaatgcaatttgtcattaaatttacaaatgttgtggtgtataaattggatacttcttcctaaatgtcttgcaatgttttaatatcaatgtgacagcaaaatctgcaatcaaaacaaggcctacaaggaaaatgcaacctttttaaaaatatgtagctgaataacaagatgtcgcaaaaatagggctgccacaattaccaaagaaagataattaaaaggacgtttgttatgtgctgtgtttcacccggtacccacatcttggtttctaatagcattcttcactgaaaagaattaaggctctccaaagtaatagctgattctagagctgcagaagggaagctacaagatgagccttgagcctcttgccatgtcagaaagtcagaaagtgctcaagaaaatgaaggggtaagtaaaaaaaacataagaacaagcttgaaaggcttcccactggcccaatctggaagaatttgagcattaaagtaattatgaccaccagtgaattattaaccattgaaaataagaaaaattcatgagtccatagcaataatagatggataaatacatggggaatgcagaagtgtataaagttaaggcataatgtcaactgataaagatggaagaagacgcgatatgggaaaataatcattttataaccatcatcactgtagagattaatacagggaagaactgttaagcggactccatatttcattcagatttcatcagtttttctctcaagcttttttttttttttcttgtcccaagatcccatccaagacaccacattatatttagtcttgatgtctccttaggcttctctggattttaatggtttttaagacttttcgtggttttgatgacctttgacagctttaaagagtactgaccagggcatttgtagaattcccctcaatttggatttgtctgatgttctcatggttagaatggggttacaggttttaggaaggaagtccacagaggtatagtgccatccgcatcacatcatatcatatcatagctacatgctatcaacgtgttttgtcactgatattagccttaattacctggttgaagtagcatttctcaggggtttccactgtatagttattttagttatttcctgctgctctgttccatactgtaccctttgtttttttgtttgttttgagacagtctcactctgtcacccaggctggagtgtagtggcgcaatcttggctcactgcaacctccacctcccaggttcaagtgattctcatgtctcagcaccctgagtagctggaattacaggcacataccaccataaccagctaatttttgttatttttagtagagatgggtttttgccacattggccaggctggtctccaactcctaacctcaaatgatccacctgccttggcctcccaaagtgctagaattacagacatgagccacagcgcccggccccatattgcactctttggaagcaagccactaagcagagcccacacttagcaggtggggagtaatggtccatttcttttggggggagtatctacataaattatttagactccttctataagggagatttaactcttctctcccctactaatttatttagctatttatttcagtatggactcctatttacttcatactttaggttataaaccaaaactaagttatttattttgttgttcaaattattttgactttgactattgagagctctttcatttggctcttgtgtccctttgacctaatcccattattctattcttcggacacttatgtatgttctggcactataatatgctccaggctcatcttgtgtagtgttggcctcagcaacagattcaaccatttctctggggagtcctgggttccttttattggagcatggtattagaaactaagacctgggcattgagtattctcattgctactggagtgtcattacttctagacaccctggtgaacaaagctaataaatgtatgcatatataccaatccatgtatacacacctattctttatttttctatgtatccatttgtatttatattaagctaaatatgatttaagactctgactctaatctagtaccacatgatttattctagccttcagggaggcaattttgatgagaagcaggatattcgcatggtatcattaaaggctgcttaataattacaaaggaaaaaataatacatagactagcaatatcagacaacatactgactggctgatcaaaatatcaccattgaagggcaggtagacatcctgtgcctctgtaagtgaaactctcagacagacatatcacttacatagtataacaactagacgtataacctgaatccaatcataaggaaacatcgcacaaatccaaatgaagactattctgttaaaaaaaggagagaactacattcttcaaaattggcaatgtcaagaaagacaaagatagcctgaagaattgtttcagatttagtcagactaaagaaatatctaattctaaactagattatctactagaagttaaaaatattggcagggcatggtggctcatgcctgtaatcccagcacgttgggaggccaaggcgggtggatcatgaggtcaagagattgagaccatcctggccaacatggtgaaaccccgtctctactaaaaatacaaaaattagctgggtgtggtggtgcatgctggtagtcccagctactcaggaggttgaggcaggagaatcgcttgaacccgggaggtggaggttgcagtgagactccatctcaaaaaaatatatatacattatatataagataaatatatatatttatataaatatataaatatataaatatttataatatataatgtatatttatatattgtattattttataatatatatttatataatataatatataattataatatatatattatataatatattatattatatattatatattatataatattatagattatataatatataatataatatataatatatataacattatagattatatatattatattatattatatataattataatatgttatatataataatatataataatataaaatataatatatataataatatataattatatataatatataattatatataattatatataattatatataattatatataatatataaatataaatatatatatatctatataaatatatatataaatatatatatttatataaaataagggacattatttcgtccatcgatgaaactcaagtatggatggcaggttaaagtattatctcaaagcaaatttcataaatttgattactattatagttatataaataagataacattcttattcttaggaaatacacactgaagtattcagggggaaaggagtataatgtgtacaaatggctcagaaaaaaagtggtgtgtgtattatatacacttgtatgtatgtgtgggtgtatttactaataacatacattatgtatgtatagagagagacaatgtcagagagagcacgaatgataaatgaggctaaatattaatggcaggtaaatctgtttttaaaaaacatgtgatccttgtttcttatataataaatgtgataagcatgtgatgagactgagccaacattagtgaaatatgggctttaaaatgttttccagaagcagttattctatcctgtgatgtcctctgtgaccaaaaactaaatgaaggatgtctttggaagactctaaagctaactggacaatttggaaactgacctctaactatactttgattaataccactggcgaatcattcatagggtatatacaaatacaaatttggcctcttgtttaaagggtttctgtagttcaatcattatgaactcctaactgatacttagtagaacagcatataggtccatatttataattcaaatcattggcaattaaaagcgttactatcggccgggcacagtggctcatgcctgtaatctcagcactttgagaggccgaggcgggcagatcacctgaagttgggagttcaagaccaggctgaccaacatggagaaaccccgtctctactaaaaatacaaaattagtcgggcatggtggcacatgtctgtaatcccagccactcggcaggctgaggcaggagaatcacttgaacccagaagtggaggttgcggtgagccaagatcacaccattgcactccagcctgggcaacaagagcgaaactccatctcaaaaaaaagaaaaaggttactatcagtaaatgctagctgaaactacagtaacaatttataaacagtaattctctactaaaatttaccaaaacataattctttctgagaacattattgtcacaagttttattacatgcttatattataaacctaccaataatatatttattaatatgataaatactaatttaaatctgttcttaatatgacaaaactgtgttattctaaaatccatgaagatgagctattccaaatgagaactttttctaaataactgaagggctagtaacactgtattccttctaaaccacaaaggtatagtgtggtatgcagaatgatgctccctcccaaagatgtccacattctattccctggaattcatgaatatgttattaataccataaaaggcaaagaggaattacagttgcaaatggaataaggttgctaatcagctaacattataacagagagattaacctggattatctgggtgagtccagtgtaattacaagagtaccttaaagtacaagagggtggcagattaagtcagagtgatgcaatataagcactcaatctgtccttactgactttgctgaattaaggaaggaagccacaagccaaggaccatggaaaacatctagaagttggaaaaggtaaggaaacgaattctcccctagacgctctagaagagaatgcagtcctgccaacaccttgattttacttctgtgaggcctgcataaagccattacttttgtggaaatttgttatagcagcaacagaaaattaatatatattctattttcttttctcttacaaaaagtgtaataaatataatttgatcttaaaacttcctgtagcaaatcattgcaggaatcaattcctgtactaaacaacaccctaccaatccctacctccaagcatatatagattcccacatctatgctttagaatataatatagttttcatgtaatcttttgataacagagatgttctatctattatctattactacccttcatctactgtgaatggctgtgctctctctaccctcagcaccactgactaccctagatgtccactattctctttcccccttagcctctccttcaattattttatatttgctcacacagtatctcctgagcttcttggctctagcagaagactgtccttaaatacatgaggctattcaatgccttttacccttgtctacaaatctaccaatcaacatataatattctgtgcacctcagctctttccattgttgctgagtattcaccggttgctttccagggatatttctccctctatttgcaataagcattaaatttttctttagaaggatatacatacatacatatatattcagcctatctgcaaaatgtaatgggacagcagcaggaataatgatagcgtagttacaagtatactctcattgctatgggcaactatgataatggcaatgtaagtacatattcattttctctatacataggcatcctcccacaccctgctatgtatgtatgttctcagtaaatgtttagaggacagaggagaaagtaaggtcttaacctcctggtatgcaaattataggaagaagagagaactaagcaaacaaacttaagttacataaagtaacagaagaaataatacatatttaatccataatatattttctaaaaatttatctgcattcaagacattaaaggccttcaaatatttaaatagtagaaacattacactgagagttattagacgacaaaattatgtcttactcattttcatttctctcatgcccacaattaagtttgctttgaaataattttttttttaataggggtcttgctctgttgaccaggctggaatgcagtgggatgatcatagctcactgcagccttgaactcctgggctccagcaatcctcttatctcagcctctcaagtagctgggactacaggcacacactaccacacccagctaatttttaaaatattttgtagaaatggagtcttactgcattacccagactgggttactcagggctcaagtgattataccaactcagcctctaaaagtgctgggattacagaaataagccaccacacctggttgaaataattttttttaaccttatgacaaatttgtatatgagcctaggtacacagacccttgcaatctaacaataagacttactagtattagcatcacataatcacaaggctgaaatattatagtgttagactctctttaaaatctatgtttttacacaaatcaataaatgtaatctatcacataaaaagaaccaatgacaaaaactatatgattatctcaatagatgaagaaaaggccttcgataaaattcaaacatcccttcatgttaaaaactctcaataaactaggtattgatggaacatctcaaaataataaaagctattcatgacaaacccatagccaatatcatactgaatggacaaaagctggaagcattccctttgagtggccctctctcaccacttctattcgacatagtattcaaagttctggccagggcaatcaggcaagagaaagaaataaagcgtattcgaataggaagagagaaagtcaaattgtctctgtttgcagacgacatgattgtatatgtagaaaaccccatcatatcagcccaaaaactccttaagctgataaccaacttcagcaaagtctcaggatacgaaatcaatgtgcaaaaatcacaagaattcctatataccaataacagacaaacagagagccaaatcatgagagaactcccattcacaattgcaacaaagagaataaaatacctaggaagccaactcacaagggatgtgaagaacctcctcaaggagaagtacaaatcactgttcagtgaaataaaggaggacacaaacaaatggaagaacattccatgctcatggataggaagaatcaatatcgtgaaaatggtcatactgcccaaggtagtttatagattcaatgccatccccatcaagctaccaatgactttcttcacagagttagaaaaaaagtactttaaagttcatatggaaccaaaaaagagcccatatagccaagacaatcctaagcaaaaagaacaaagctggaggcatcatgctacctgacttcaaactatactaaaaggctaccgtaaccaaaacagcatggtactggtaccaaaacagatatataagaccaatggaacagaacagaggcctcagaaataacaccgcacatctacaaccatctcatctttgacaaacctgacaaaaacaagaaatggggaaaggattccctatttaataaatggtgctgggaaaactggctagccataagtagaaagctgaaactggatcccttccttatccctcatacaaaaattaattcaagatggattaaagatgtaaatgttagacctaaaaccataaaaaccctagaagaaaacctaggcaataccattcaggacacaggcatgggcaaggacttcatgactaaaacaccaaaagcaatgacaacaaagccaaaatagacaaatgggatctaattaaactaaagagcttctgcacagcaaaagaaactaccatcagagtgaacaggcaacctacagaatgggggaaaatgtttgcaatctacccatctaacaaagggctaatatccagaatctacaaagaacttaaacaaatttacgagaaaaaaacaaccccatcaaaaagtgggcaaaggatatgaacagacacttctcaaaagaagatatgtatgtggctaacaaacatatgaaaagaagttcatcactgatcactagagaaatgcaaatcaaaaccacaatgagatactatctcatgccagtcagaatggcgatcattaaaaagtcaggaaacaacagatgctggcgaagctatggagaaaaaaagaatgcttttacatcgttggtgggaatgtaaattagttcaaccactggggaagacagtgtggtgattcctcaaggatctagaactaggaatttgacccagcaatcccgttactggataaatcattctactataaagacacatgcacatgtatgtttattgtagctatgtacaatagcaaagacatggaaccaacccaaatgcccatcaatgacagactagatgaagaaatgtggtacatatacaccatggaatattatgcagccacaaaaaagaatgagttcatgtcttttgccaggacatggatgaaactggaagccatcatcctcagcaaacacaggaaccaacaccacatgttctcactaataagtgggaattgaactatgagaacacatggacacagggaagggaacaacacacaccggggcctgttgggccatggggggaaggggaggaagagtatgaggacaaatacctaatgcatgtggggcttaaaacctaggtgatgggttgatgggtgctgcaaaccaccatggcacatgtaaacccatgtaacaaacctgcacattctgcatatgtatcctagaactaaaaataaaataaaaaatgtaaaaaaaataaaatctatgttttatattgatcatacacaacattgtagaatagattttacatatataattagtatacattttaaatatagagatttaacataacaactctcctggcaatttcagctgacaatttccatggcaaagtacaagctgcacacaatggaatcctgacttacttctttaacacataaaacacttaataaaatgtggaaaagctataccacctaagagttattctaaaatattttatagtgtgaaatacatttatatgtatgtatgtttaaatttactgaataaagacaccaattaagaaaattaaacccctaaaagctaactactattcacatactttaatttagtttgcttattcatttcaagtctttcttcattaatataagtttaacatatgtaaaatcatagcatagaggccaagcccagtggctcacacctgtaatcccagcatctggggaagcgaagataagaggatcacttaaacccaggagttcaagaccagcctgggcaacacggcaagatcctgtctctacaaaaaaaaaaaaaatgtagtcaggcatggtggtacatgcctgtagttctagctacttgagaggctgaagcagaaagattgcttcaaccctggagttcaaggttactatagcttgctactgggctccagcctgagagacagagtaagatcatgtctctaaaaaaataaaaataaaagtttaaaaatcatagcatggaaataaccttgtgcttttatcttttgaaatactttaagtataactaattttattactacataaatctaccatttcaattctcctttaagaaatctacaaagaaaaactcacatgatactttcatgacctctgaagattaaattatatctggattgtatctgaatcaaggatataagataattcatgaatgaataaaataggatttaataaagtaaaatataaaataaagactgatttcaaaataacaacttgttttaggactgtagcagactttcttttaattatagatttccaattaaactatttaggaaaagctatactttaattttaatcttaaaagttaaaagaagatcaagtaactgatactaacttcacattaaaatgtatttcactaatacaaatagtaataatgaccatcacaaaaattttagctaaatattaattgacctttatctgtatactttgactgtatttagttatttaaatactcacaatcaaaatatacagatacaacttttaaaaatacacagaaagtacttcagcacttatgaaatagaatgccatcatcttccgtataaaagctgaaatcaaatcagaaattgaaattgatgtcagtttatttctgagagcttaatatatttggtaaactgcttcctctttgataacagtggtttcagttttgtataaagactcattataagccacaatatttcctaagtataaaatatgcagcattttattaacttcatttccatcttttatgaacagcatggatataactaccaatcactttaaaacaaaatttaagtttcaagtatttttcatgtgatttgctacaaattattttggaaatttcctgactatataacattgtttagactgcaatcattttattaaaacttacctaaaatgataataacaactgctacttggccctccatgtatttaaaaaataaaaaacgtgagccagagatttccagatctctatatattatctgatcatgtcgcaacatttcagagtaggataacaagatgctcttttgaaaattaatgggaaaaaggaaagctttggagcttcttgtgaaaacaagaaaaagtgtaaagaaaaaggtaggtgatataacggacactatttaagttgtgggaaggcaaaacttacttaagaaactgtcatggacaactgcagacagggcattaaaaaaaggacaatggcactgatgggataccagtaaaaatctgatggctttaaaataaactgccaacatcttcacaaattatgctttactgcttctgagctctagcaaggtttctatacagatagggataataatagaatataagtcattatagatttgttgagaggattatgacaattaaagtgcttagcatagtggttggcacagaataagagttcaataaagtggtgtgttattcttatcatctcatttcaattgagttttgcaagactttcacatctctagaaatgtcatactgtaaatttgaacttgctgatagaaatctgttggaaaaagaagggtatcaaatttatcactctataaggatttatttagcatgtactatttacctaggcatgtggtgctaccaagtaaataacttgatatctgccttccaataacttttcacattggtaggttaacaaagggagaggaatacatggataataagaggaaagaacaaaaacaacgatatattagagtgtttaagatcaacggtaactgaagcatcagttcaaagagagcacttgcccgggcactgtggctcacgcctgtaatcccagacctttggaaggctgaggcaggaggactgcttgagtccaggatttcaagaccagtctagtcaacatagtgagaccccgtctctacaataaataaataaacaataatattaaatttaaaaaacaaacaaaaaaaataaatcagagagagctctctgtgtggcatccaatgatagatgtaagaaagctagcctggaaagacaaagacttcagattgggggccaatgtgaaacaaagttgaataggtaggactttaaggattttaaagcactatggcatgatgacagtgttttattctattcctctaagtaaaaacctgccaagggaactagaataaagcatgtatttaatgaaatcatttaattattaaaccactgacaattttcccttcttttattccctccttctttctataaatatttattgaatctccactgtctagcaggcagcacgtaagtggtggtaataaggaaacattaagatgaggactatacctggtttgaagagaaaaactttagtgtaaataatcccaaagaaaactaaccaagattattttatcagcactgcacctgcacttcattttcttttaagtaggtagactgttttcttattacaacttaaagattttagagtttcaagattatatcaaattaacacatttattacattttagatatatattcatatcaaaagcattctaaaactccatcctcaaagctctactcacttaaactagtattctggaactgcacatgagcattcggttttaaaatgccttacaattttgtcagatgccagaaaacaacaatgaaaaattaaccctggttgaaaaaagggataacttataagtagatttggttcagaagactataaaactataactaacttttaccaggcaatccaagatttataaaagcatgtaaccttgagcaagagacccaaccttcccatgcctcagtttcttcatcagcaaaatggtgacaatacctacctcaagggcttgctgtaaaaatgtaagagttaatacaggtaaaacacttaaaacattgtttgccacacagtaaatgtttcatatgtgctattatcattgtagatgcatctttccaacatctgcttggagaaaaaaataccgtgacaaaagaaaatggctctaaagagccttcagatgtaacacaatagaaggacaaacaggtagtcgcagaattgtgttagattagtgacctaagtgtgtttaaggaacaagaggtaaagcagaggtcacaatgtgtgtttaactttaaataaatatatgaaacaaggaaaattatattctagattttaaaaatgtaaataactttctattgctttacattgtccaaacaaaagctgtgttaataataaagagtatacttctgaatctggagtcccatcaatgatttgttcagcttgcgtaagtcacaactgattggacacagtccctgtgggcttgccatttcatccagactggacggttcattagtcataactactataactgtacagcagagactgcagttttatctcatcgtacatctttgatcaagctgcctcaattctgcttcatcagcatatgaagttacattattggagctttttattttccagtcggtaattaacagagattatgctttttatcaaaacatgtatttggtcttcacatttaatagtgagggcccagatctgaccaccatttgacctctgaaatttctaccacctaaataccatgaatcataaactgaaatccagaataccacagagaaaattaaacaaagaaaagaactgacctgtgttaaaaagcataagatgattgcacttatctaaattgagactaaccatatttgctgcagcttctcattaaacattaaatcgcacaccagaagaaaacatcatacatatttattgttttgcactgtcactttcaaaagactcataccacaattagtgtttctctcaaactataagctacataaagaaatttcccatgaagcctgaagacaaagtaatgtaaaagatggttcaagaaggttaaagaacagatggataatagatttcactgaacactaaagcataatacacttacttcagaaaagaaaatgttgccaaaacttagttcaaatataaaatactgaatgaaattgatgtgtcgggaatttttttttccttccaagttcttttggagaacaatagggggctaaaaggcctgtctcactatttttgcatctcactattttcgtgtgtaaagtgtccccactgtaggctgcatgaacaatcataatcgacagttacatgcaggcactgaggctgcaaaaatcccagagtaattagtgttgtctgaatgcaatgacatctgtgttctcatggttctcgagacatgtcaggccaataagatgtatatgaaaaaatatgacaagcattgcaaatgcccttctgaaaggtcttacactttaggggaaagctgaagaaataacacatgtcatcttctctttgtaagcaatatatttaagattacaagatctagaaagatcttttgagtcattcattctctttttgtaactataaagcatttgttcagaatacatcactagggtatgaaaaaaatctgttgtaagttggcttctttttaaaactttctcagcacatgtgattctgtgcagtgcaatgtaggtgcccattcctgtaagtgacaaaacagagagcatatcttattaacattccttggtttcgttaccttttaattaaaaaatattacctcttagtactgaacataaaatagttcaaaatttgtggttaaatgccttagaattatgtttgtatttttctaataatacagagtgtcaaattgactgtattaaaaagtctttgttttaagacaactaatgcttttgcttactgatgcctattactgaggcctctccctctatatgctgtagcagtatgtttgagcatgcacttgctccaagaaagacattagtcatcattaacagaagcactgacaccaaatctaagtgcctctccacaatgaccaagtggcaatcatctttctcttacactgtcactgctgattaggattttctttcatgaaaatttaatttgtacccctttctgcagcttcttttttttttcattcctgaaaaagcaacgtgttcaggagagattacagataaagcaaagaagctctacctataatatagctaatgatatagagattgcaagattctcaggtaaatcttttctctaatccaacagaaaaacacagattaaatcaatgattaataaacagaagaaaaacaatgattttaaaaggaatattgctttattgctttaagaatccataagcctcaaaaggtaactaattcaaggaatccaaataaaacttccctaaatattaacataatcccaagcttctttaaaactaagataacactttgatagttgccatctttcactaggtttcaaatttgtattctccattttgtaaacaaaaagacaggggcattcacacagaaatatcactataaactgaagaaaatacttaagcattcatacctttagtatgcattaacctactggttagttgtttttttttttttttttttttttttgagaaattttcagttgcactggacaaatgaaagtgattcatttggccaagcagggtactctacagctagatgatactacagacaaactctggttctgtacaatatcacaatgttaaacaagatatcatagcaataagttatttaaggaagtttttaaaaacatttacttttctgttttatttcaatctgtttaaagtttttttttttaatgtaagcatgtgatagtttgcaagggtcctggtacgacccaaactcccacttctagttataaatattatcatctcttcgtattacttaggtattataacaaaatagagattggtttaaatttaaattatcttgaaattattttatatcccttttagaacatatgtacttttagtcaaaacatgtaacacttttgtgtttacatgagcataaattgtatctttttaaaatgtaaataaccacatgaaatgctctgaaagcaaaaatcaacattatttctttgtaaatcagaagcaagtacaattcatcaaactttagtcattaaacgatccttctactcctattttattctgaaaaataatacagaaagtcaaacagcaactgcttagtgccatttacaaatggtttgttttttctttttttctatttaaaattggtctgcaattagaacatgtaagaggagattaggaattaaaatggattctgagaggcaatttctaactactgaacttttataacaggagtatctttgattaaataaggagctagtctaaactaaaagcaaaactgtaccataataacccaacttaattatctttgcagaatacatttataaatgattggctcatttctacctttacttgactaagtaaatatgcctcttaaattctcaaacattgaaaattctgattctcacagttgcacagacttatctaaatcaaaacttcaaaaagttacaatataattactgactccattgctagatccagtacaagttcaagtaaggaagtttagctctgtaacttccactcctcaacctaaacctccaagtcacttgtcagttaaaggttgggcgatttattgaccgcctctggatgcatactgtcagtgctgaaggaaatatgagggagggttgttgctactgttctggagctcattgataatgacatacctgcctctgtcacccattacccatactacaaactacttagacctaactgaaaaatcaatagcctacttgcactggttcctgtggctgcctcctttgattgtcagctcctgtctagggtcagcacttacatgaaaggggctgtgactgcctgatgctttcaggacaacctaacgatatgaaactagccaacagaacagtaaattctgcctccctgccctcctcatcaattaggctttgactaggcttgcctgtagaaacctgaccttttaagtttaggtgaatatggactagctgaacacaccattgccctcagcactgagccaggaaatctactgacaggttaaacaaaacagaaggttgtaactgtcataatttgcattgcactttcacgccaacaagggtgttatcagtaggggcaagccctggaacacacaactccagcacccttaagccacgctactcataaattttcaagtgaagtgagataaaacataaattcacaaatagcaatgcatttctcatctctcagtcttttaggtttgcactttgcaaacccacagagtgcccatcaacaactccttttggtcacctggcactcccattgcactaattagggactttcaatgaccataacacagaagtaaaaataacaatgcccatttaagacctattttagagagactatataatatagcagatagactgactggtatatatgtcaaaatgagaacaattagatctcaatatgctatcttttcttgcctcaattcactctctccaaaagtatccacaagcttagacaaacaataagttatcacgtaagtgaaaggaggtgttgaaattatttcctaccaagctactctgatatagcatcttttacagtttgagggaaaactaagaacatctgtaaaataaaagatgttaacacttttatgcttgtcagatcttctgatgaaaacaagtgaaaagcatgagaaagcagtataaaactttcctttgtttagtgactcatgttttgaaaaccacttccctgcttagatctatcttttaacacagtaggaacttggtaatatcatagttgcttagcacaatgtcatttctctaaggagaagaccaataatttatttttttaagttaattgtgaatgggaacttactttggcttcaagaactaatatttacacaatacccaatgttcattaaaatgtccaaaacattgacagtccattaaatatttaagggaaaaaaacatattgtttatataaacatatattatttttctatatacaggaacacatactgcattttgttttataattttatgattcaacccctatcaagcaataattagtatactcaggatttttcccaagttgctacttcattgtccctcacagttgtctccaaactatattttgtaaattttttccataaatctaaaatatctataagcttattcttgtctgagtttaaaaactttcatatacctacgttagagcagcactgaaagcctaaacatctgcagaaagatttctgatagaaataaacaaagatgtcaacaaatttagtcatgtaatggtggaaaattttagacttttttaactagaagagatagaaaagattacctagtccaacccactcatttagcaattgagaaaataatggataaagatagtgacttgatcaaagtcacccaggtaaccaagccaggacaaaaatttgggactttttgtttcctagattgatgctttgctgatacgttcacactgtctccttttatctatccaggtattctggatagcaaccaccttacatttaaaatacatatctatagatttgtatcattcatttttaatttataaagtttatagaaagctttgattagcagaaaagattagattattcgtagagcatttaaccaaaaagttacccaacaaatattagaaatagaaggcccaattaagtatggttggaatcctttactgaccaaatatgatgattaactaagcatctggtcatctttctgctcctttgtgtgtacatagctgatagcaaagtgaaagggtatggatagtgtctgatcccagcaagcaaatcatttgaaaacagtcatagctacaggtcaaagattttctactcagtctagatggatctaaacgtactaacctcgattttaaacctaattacctatataccaaatcagtcagaaaataagagaatgactctttatgatccaaagataataagggaagataggaaggaaaaattcaggaaagagactggcagaaccttgatatccataggccaagacagctgttttatatcctagctttatatcagatggttaaaggaaaagtttccattccttagatcattaaatattatttcatttatattacacagatgtcttccatacatagattacaaccaatgaagcattttgttgttgttgtttaaccactacaagcaatcagagaaacctctctgcacatcacttttactctaattcataacatttaaaggatgaggcaggctagatttttaacatttccattaaaaataacacaaagtccattaagtatttcttgtaatcttagcagatgatcaatgccaaattactactattcataataatatagagtgctacagaaccaatacatttttaaataaaatgtttaaaatggctagtgctcctaaagtataacaaaaacctacccatacgatatgcttaactaataattttaaacatagacccacaaaatgtctcatatgacctgaaagaaatagcacataatgccaaatattatattttgaaccaagtacagctcaacactagcataatctacgtctctaatttcactcatctgttttgttaatgtctggcactgatcacaagagaaagtagaaagggagtggggatggatttaatatcctaagaaacatattctacacaatttttgtttcacacacattgttttggctcacaatgtgagtcaataatattatcttcataaacaaaagatatcacaccttgaaaccataaggtcagctttcaattttctttaacacttaaattcattattatctgatcctggtttttctgtctaccttctggaagtgatgttaaaggccagcaaaatttggttctccaggtagaaaagtcacaaagaataatccacaaattatacaatcatttcttaaagttaacagttggctctaccaaatataccctttcatgtgaagataatagtgacttatgaaagtcaaagttatttggcaggtaaaatttaatatttatctaatagtacattaataagttcaaactggtttttaaaaaaaaaaaaaggaggaggggagaggaaaagaaggaaggaacaaggaagaataggaaaagaaaatttttaaaaattttgcttcaacttttcagaactgcttaactatgtatgtaaataaaagaatgtagtgttacaactcaaaaatgtatacatttaaaatgagaaaaagatacacgatttcttggtaaggtcaaaagacatatgccaatataagtgtgaatatagcaagttcaaagaaactttctaaaaaatacttgctgaattaacttggatgttaacattgcacattctagcgcaataatataatggcatttacttcttagtcaggctaaaagctgcttactttaattttcctgagcacaagtcccttactctatcattgtatatttttggtgacatcaaattatgtatagtttaataaagtactcatttatgcagttgctattcaacttgggggaaaaccctgatatacagcatactctcaattttctcattccactatataatacaagaattatatttgtaaagtctaataggtaacaaacatctctaatcatatatattatctaaggcaatccaaacaaatttaaaaggcccacaaacaatactcatcaaaagtacataaaagcattttatttttcagtacagtttgataggcttactgtacaaaattaaagctactgcttttacctgacataaaattatctgaagttcaacctgttcaaatgagaacaatacccttgggttactaatcaaagagagtaaaaaaaaattttttttattaaggctattttgtgaggggggaagaataacttgtttcaacagcatgcttgaccatataaaattattaacaggcactatggtgaactgttcaaggcaaacattcaattactggttattttagattgattccagaataataattacaagtagcttagaaacaatctccttaacactttggaattttagaaaattaaatcctttgacagagaataaaagagaatgtagttttactgtgacttataatgtggacagtataatcttgatgactgtcattaacacatcttacatatatttaaatataattacttcaataaaatttcatcaactagaatacactaacaaatcatatctgggttatttacttttctttctgtttttagtgaaataatttttaaattcagagaacttaatagtgttttatttcctcatttacaatttgaccaaaaataaaaatcaatgttcatttttttaaaaaaaaaaagcattttcataagtatgtagaatgattaagtatataagaactaaaaatgtagcacccacatagatgtttcaaagttagaatttagaggataagactatataccagtaaacacgtggtcctttgttttccaaaaagtataaatcctccagaaatgctttcttttcttaagtcaataatctgattattttttgaaagcttctaaaatatttcctggaaaataagatcatgtattctaaaatttgtttactctttagtaaagattattgagatacaatatattatttttacagataataaaataatagataccttttaagtctcgttaacatgataaagtaacaaatgcactgacgttaactcagtaaatacatttttaagtaaagatcagcaaaaaataaaacagtttaagaattttgtattctctggaaacataaacaggattataactgtcagattacagaagcactgacttcagccattagtttggtttggctcctgagaaacacaacatgaactactgcatcatttcttttcaaatccatacattccctgcagccgttcaagcttcatcagcagtgcaggaatgtataaaaatgacaggcaaagggcattaggtttttttacttccatactgttttcctataaatggaagacaggattctttctcaaagcacttaagctcaagctcagtcaatgctgaaggaaaaatacaactgaattctctatgcaagaaagtatcacaattggattatttactacttttcaaggacatgttgataaatctaatactgtattattatcttagaataaaacattgtaaggttagcattctagcttaattacccattattcttcaattagaaatattttcactttttaaagtactctgtcaactcatcaccttattttaacaccaagtattcagttttgcttctaattttaattataaaaatttccttaaaatatgccaattttttttgaaaatatatttgtataaatagttaattttttatttccaagtttctgtactcataaaggtttcggtgaaataggaaattccattaataattaaaagtttatttaaccatgataagtaaaaataggatgtaatgagtaatctggttatttgactggaccttaaacattcacattgctataaaactagtaccgtaattactacaacctgactcaattttttgaagaaactgggaaattttcagactaaagttttaaacatcctcatattttagtttatagtaactaaaaacatgcccacttcagtactatcacctacattctttatgttcctaatgtaatgatgcaagaggtaaagcctagagaagtctgaaggttacggactacctgatatccaaaacaaaaaattcagatcacaccctgaatgtcctccttccctttttaggaatgtcctgcagctagcccagcaccacagctctgggctgaagcatgccaatgttggcactgcctaagccaaacaaacaagatgtttaacagtcaaataaaatgtcctgcagcctccctaatgaatttgtcaaggaccatcagatttcgcaccccctcctttgcctcattaactcaagtatgatgagacggattataacaagagaatacagatgaatcggtctgaagacttgaagtggcttttagcctctagagtttctttctctcacttggtctcctttaatagaatatagtatctcctgcagaaggagctgccagttcgttttaatacaccatcaaggagctgctgatggacttctatactaacatacataaaagcagaggtgacaggggctcttcaattacagcctcctcggataccgtttcccccttcaattattcaaccagaggaagagaggaccgcaaaggcgcagctgaagctgctcttagagcagaggcagccagagtgagttggggtgggggaggggggagaaagagaaccagcaagagggagcattatttgctggaagtgtttaagtttattgctcgaatgatgtttctaattagtaccacggccataaattaaagtcgcctttgtttaactgatttattatttactagagcatctacctaagacagggtaaattggtaatgaattgtttttaaatcaaaacatttgtaacgttttatcatccttccctctgtatgtaaaagtggagaagcgtaggggcaaggatgcgagaaaacttagccgagcttgacagagccgccagtggaggtgcagcggagtgtccggcgagtggtggcgcgaaggtccgctcggcctgggacgccccacccgagagaagaggagaaggcgcaggacttgcggcgcggcggcggagccatgcgaaccaactccgccacccctgaggctgtttgcaaacactcactctcgggagcgtcgcgggccgggccattcgcgaaccagacgcaacgacgaagcgaccacctcgagagtggggcgggaaagctccgcaccctctatccccgccaccagtctccgcccagtaactgcccccggagaagcaaccacggagcccctcccggccagtcgcgctctcccggcagcgcagtgccctccggcccaggcagttcccagagcgccggcaaggcctcccgggttagagccgggctcccacaggcgcgaactccgagggcgcgaggtcccctagatccttaggcggcgaggcgttccgggacgcacgcggcctccccggagaaggctggaggtcaagcagcccaagtctctgccactccagagaagttaactaaagctctggagtccaagagtcgcgcggacacttaattctgactcttcttcctaatcgcgggaagacaaaccctaagcaacaaatccgagatagtttttttttaagcaaatattccttagaaagggacttatggcaacgagagaggaagggtgacaaactgcctgtggtccgcaccaggtatgtaagaaagaaccaagaggcccaattgtctgataccaagtagatagaaagaaattaacttccctatgcaattcaattcaggttcacccggccggactttaagagggtaagtcaagccctcccaaggggttttgaaaaagccgaactaccaggtttctaaaacgaagtcttcacccaaatggacgcatagatttttatttttatcgcataacccagggctggaatataacctcccaaatcaaactaaaaataatcacatctacctgaaatacgttaaaaagattcagaatccagacatcttaggttcatacataaaccctcagtatcaagcaaatcagaaacaatgttctagctttttttttcacccaaaagtatggaaaggctacagtgggtacaactcgtttaggataatacatatactaaaagcacatgcatgcctttcattgaaatgcctagggaggagtgaagccatctgtgtaatcaataacaggatagttatagatttttgtggcagtgaagtcttttaaaagcaagagtcaattatgaaaataaaatcattttacaaatgaaactctgtacctgtaccccctaagaatacattcacaattagatttacaacagtaagattttaagaaaactttaggtttacatttacttgccttgtttttcattaagtttgaagcaattttagtagcttattttaaaagtatatcctactaagttctacgacatgtaagtttgcaccatttctcacaacttagatattttctctctcgtaactagttaattcttgtaacgataaaataatggtattaaatacatgtgaatcttaattatgaaataattatcaaacaaggtgcttggactagtttttgccctgccctgtttttaaacagcatatcgaaattactaaaaagagatttataaaccctcaccttatatccactccaaccctcactggtgcacatatacagcaactgctctgattcttggcaacaatgggaggggaggggaagagaaaggaggatgactttaaaggaggaaaaaacctggaaaaattaggtcctttcccagattcccctttcgcttcccatttgccttcaagccaaagtaattttgttacagtttgcaccttctactacacaatgttgatagaatcatttaaaaaaaaaaaaagtgaacctttctgaaccattgctactctccctcgcgttattccagccatctccaggagagtcccttctatataaactctttttcttctttgctactgataagagaggaggataaagaggaacggctgtaaaatgtgtgcaagcatttgactcccattatctcctcctattttcttacttctctctttaccctgtttctttatcaagtgcagtggtggctgctaccgttcgccaagcgtgcctgtcttctctctcggattggctaaagcactgacagctcggatagcgattgtaggaactgaagctccaccccctcatgatggccctgggaccattcataaactaaataactccaggaaacagcgagggagagagagaaagaaagagagagggagagagagagacagagagagttagaggaaagaagagagagcgagcacgaggaaggggggcgggggagagaagcagggggagagcggggcgagaaagaggtcggaggggagaggagggggagagacgactcagaaagtggaatctgtaaaagcaagctagaggagaagaaggaaaaccctgaatcgttataactacaccccagatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcacttaaaaaacctcatttccagatttctggacaatctcggctgcagacatctaagcctaaccttttggtatcctgagttttttccctctccttctccttcctcacgcccaccccgcttctctcgcacacggtcatctttacatatcaagagaaagcaaaaaggttccaagaggtacttttctttttagaaaatcaccttttctcccctaattcttctgcagaagaaaagaggtttcgaaagagggaaaaggaaaaaacaagccggctacggtatcagccggtcagcccaggtggaaaacgagagtgaaagtagggcttaacggggagcgcaccgcctctttcgaaagccgctgggccaccaccagtgcgtgagccttggatccctcaacgtattgcgagacgccggtgtatagcccggacctgtgccccaacatgatcgccgctcaggccaagctggtttaccagctcaataagtactacactgagcgctgtcaggcgcgcaaggcggccatcgccaaaaccatccgagaggtctgtaaggtggtctcggacgtgctcaaggaagtggaggtgcaggagcctcgcttcatcagctccttgagcgagatcgatgcccgctacgaggggctcgaggtcatttcgcccaccgaatttgaggtggtgctctacctaaaccagatgggcgtcttcaacttcgtggacgacggctcgctgcccggctgcgcagtgctcaaactgagcgatgggcggaagcggagcatgtctctctgggtcgagttcatcacggcgtcgggctatctctcagcgcgtaagatccgctcgcgtttccagacgctggtggcccaggcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactctgctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatccccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgtaattgactgtttgtggattgttcttaagtgaaggcaggtgagatcacagtttataatttccaatgtaaagatgtgacgaggaatcaaatgcaagaagcttccacttgaactgatttgcaaaattttaaatacagtacattttgtagaattgactgtataagttccgacccaaatccttagaaaatagaaaacactaattttactcaactataatatatatttgttctgtagatgttaagattaaaagtaacatctacttcacgcttgggaaaaaagtatgaaagaaaatattttgatcctaatttttaaaatagaaaaaactttttcacattaaaaattaagagatgtgctttcttatgccataatttcaaaaaatccaatctgaatccgatatacaaaggaaatatttatggatttttctgaatagttaacaaagtcagttgatacttttccttcaaccgtttgtcctcttcaagctttgagtgataaaaatttaacaattaaataaaccacaacaaaaaatacaatggttatagcaataatcctctccccaagcatatggtgatatgaaccattcagatttataaattacttccattttaaaatggcttagttgtaaattccataagtatgattattttaatcaaatttcaagaattattctgaaactgcttatatgcaattcaaacaaaaaaggttttcataccatttttataaccaaagaaaaattattattccaggatttagaaataggaaaagtaccttcctcctctttctgtttttctaaggtaacaaaccaatatactcatttcaatgtttcagctttaacaaaggtttctttttaatgcaagggaataactgattagaaaataatataattagtcaaacagaaagtatcccaaaggaattggtttgtcttgcttatgttgaaggtaactatatactccattcgctatgctaatgatgagacacaggtacagaatatatgtcagatgttaccctttaatatctaacatttattctttgtattagcccaggttttaatttattgagaaaatgcacaaatgagaggtgtagagaaaaatgtttttaaaggcaattttaaagatcagaggaagaagtttgagagggggaagggctgtatggagggatgagcagcaggatagcagaatagatgaaaaacaagaaagccactcaggggtctgaagcctagttcacttgacaaacaggcttaagttgtgtaagattccttggtaaaaacagtcctgtgttaaaaatataaactttgatcctatcagttctgaaatcatctccactctttcaactcaacctctattatatctatttttctagttgctcttcctgtattcttcacagtaatattaagtggctcaaacaaacaaattcttttaaattataaaaaccaatttattctctggggaaaatgttctgaattttaaaaacattttcaaacaaacagtaggtgcttacatttgcacaaaatgatttaaaggaatagtgtttggtttcaaagataaaaagaatatctataagtgaccatttttctcactcacaaaagtatttacagcagtagacatacatctccctccaactattccagaaaaaaagtttttaagtcttgacaaaaagaaacaaaaatatccccaattcagcatattttcttcttccttatttaatttaatgcaggtatcagttaaaaaggaaaaacactgcaggaacataaatgtcctcatttacagaacaccttaaagcattaacatctatacaaaattaaaacttctcccagtagctgactgaaaaattgtttttaatataaattggcaggagttttaacttctggaatataaggaaggttgcagtgatacagaccatttcttcattgagccaaaagatctccatatttcacaagcaacaagaaaaaaataatttaatgatgctgtacagaatcagatcagagagagacaaaacttgtaacttctctaaaaggagcaaataacttcaaagaacctaatctcacacattggcagagattctaattttcagaacaattaattagacacttttaaattaaatcaaattttaggctttgctctatatgtgtttaaaagcatgatagaatatcttgaattaaatcccagtctttcttaaattcagaagttaccagaaatcagagagtttaattttggtaaccttcctttcctaaagaaactaatgcattttcagacatttcagtcatgggacaaagtagaaaaaatttttaattgatagaatttcagaattagcaagttttctctacattggattagttaacttatcaagctcaaaacaatcagtttcatacaatctaccaagtcctgtcttaataaaggcagcaatattgaaacaaagtgctagaaatatgtgtgagacatgatttgtttgtatagttttaaacaaaattataatattttcatcaagagctactactttgaaatacttctaaatcattcagatttaaaaattcacatgattacaaaatcaaagaacctaccaaaaaactcaaaatatgtgtatgtatatacatgtacataacatatgctatcagcctgcaaaataaattattccactttttaagccacctttttctacagattgcttattttgctcatttttaaaagaaactgtttcctctcagagcaaattataccattctttttcttgaaataaacctaattttggtttttatgactgtgctacaaatgtttcttagtaaaaacaaagttgccagggtctgaaaagtaatgagaaatatattttaaaggggaaattacattttcatttaagaatagaaaattatgcagtgccttgtaaaatctactataggtaatgggaaacagaggtatctcacacacaaaacatgcttgcatgcacgacagagtagtaagtcatggggacaaagcaaggagagtgatatattggcatcatatccagaaaacataaaggctaaacaaaataattccactctcaatctcactgaattttgtatcttaattcacccttgaccctttgaggcaaaatatatttatagacaatgttctcggaggttccttcccctcctcacaaagagctaatgataaatgtcattaagtagaatttgtttttgaatctaaatgaacttcaataatctaactaactggtagggaatcataaactaaagaagataatgacattgcatataagccaaggcaacttagaagaaattcaaactaagcctgtcagatttaccaatcccaatcctatccaacagcacccaccatcccatcataagaaaaaatgaaaccccttcatcttctcaccttggggtcgatttttttgaagttaggatcctcttcatccacctcaaaatagagttcggaggaggtgacagaaagagtgccctttactacaacagagggggccacaagctgagctggtgtgctcaggctaacaggacctgccaaaaggaaaagacaagccacacaagttggaatgacatttttcaaaaaatcaaattcgaccagaaattgtatttaatcttttcattctcacgtctagtactgaactgcctgccaactacttctacagttaaatattctgtccaccccaaatcttcctctgaaaatgcaaagtcaggattctcatactacaagatctataacaggcggttaatgataacagtaaactaggatgcaattattttacagggagtctgcaaagctttggtctaatctctaggtaagaagtggctctgcctaaataagtccatccacattccatttagaaaacaggcctcaggctatctaacaacatgaacaacaaccaggagcaaagaagcctcaataggcttccaaggccagcagttagcttacagtatggtagaggcatggctacaaaaagatcactagcttattaatgaagtgggaaatgttaaaccatattttctgatagagattttatgccagcttgacacaaaacctcttccataacaactttaccccatcaatgactggtaaaaatacttcttttctaagccttcctttccactgttaagtattgttcaatgcttccaaatctaatattagtgtagttcagggactctgggagtaaacagctggagggtgggtttccaagtgaatgaatttttattggaataatcaaatctccacagggcttatcaaagagacaaatcagactgctactgaaaacaatagattcactacagacagaacagcataatgtgtattagagctaaatataaaatatgaactaaaaatgttacatatatatgtctgttatgtctgtgtgtgtatacacacacacacacacacacacacacacacacagagagagagagatcgacgtagaaagaatttgaaattccattatcaattcctcatggtataaatcctataggggaagaaaacagcataagagaagattggcacttatagttctgaattaatatagtgcctataaacaagctgtgcctattcaggtaatcaatgggtgaataagtgtttcaaaattcagatgaattgacatttccatcgattgttagaagggtgatagtgcttaatctcacatcaatcttaatgtgtgccagtaggacaatagaagggatgctctgcggagatcagagcaggttttgccctctattcccaatgtacaaatacattgtgtttgcagatgggcagcagatagctgcagaacagccatgatttcccaaagctcatccttataaatggatgaaataagaagctatgtgttcttttgctgtctccttttgccctctgtacattagcatgtaatactgagaagaaataacattttttcaatcactctcagacattcaattacagggtaagcagacagctgcaagagctagggcagcctaggtcctacagaagacccctgacaatttccacttcatttctaacccacaccactttattagtgtggattacttcttaatcctattgccattgtcaagattatataattaaactcccctttcacctctattactgtatgaatgtattactagtagcaagaatagaagcaaaataaaggaagaaatgggtaaatggatgtgaaggaaaagactacagaatagcagtatctaccttactctccactcccaccaattaattttattttactttatagagaggtttacagttatcagagaagataccatcttctctttttgcttttcattaccaagtggcatagtagcacaggttgcagatatgtcaccaaaagcaaggtttttaatgtcttttctcttaaaattatcaaaatggaatactatgtaattttcacctattgaaattatagaacctttcagactttcttccttgagggacagagccacaggtattaaagtaaaaaagccatttaatgaatgactaaaatttccggctaaacaagagaatttttcccataagggatgtaaaactgagaatctgcagagtgcaaatcaaaattcctacatcaggcaaaatacgtgaatgttgtgaaaagccatggcattctcggaattgatttgagagagttacatgcatatacagcatgttcactaagacctgtatatcaaagcaaatagcttctctccttccaagctttatttacaaaaaaaaaaaaaaaaaactggcagaattttacttatagtcttactttacagagatttggtaactcctatgggatgggtgaagtaattttgttcttttgttgctgcttttaaactttttctttttcagtgaaaattattcacaaaagaaaaaaatgaggagagtaagaagactgaatagaatagaaaaataaaggagaaactgtagaagggggggaagtatttgaaataaccaattaatgtaattgtgggtataaacttggtagtcctagtggtcacagctgaaaaagtaagtaattatatgcttattgtcccagaggtagctgaaatatctgcacaaccaccaaatttaccggcaagattctctaaatctttctcatccacggatgacagagtatcatcatcgccttccaggaggatctcgttttctgagttctgatttcctaaagcctgactcctgatggactgttttcctttagcaaggatatcttcatctgtggctgaaatgaaaaggaaacaaagctgtccatcagttctgggaagagcacttcggcagaggggtaggggcttaggtaagggtaggtggccaaagatggtcaatcttttatacacagtgtcagctacagtggagaaagtgattgggatggcacacatgcctgatctgacaaactcgatcccccaacctagtctaatgttaccctaaacaagcaccctaatcccattaaatttgacccctgcactgctcaccaaaccatttatttacttatagttagggtaggagtggttcaaaagcagtacttttattgaaaattcattaataggaacaatcaaatcccagttttggaaacaatatttaacagcaaaaaataaggactgattcattcctccaaacaatgttatactgacaaacattttggaatggttgaggagtggctgtggagaagaatccagaattaaaaagggttaaagctaagagacattcacaagccagtgaggatttaggcccagatactgaagccatatctgacactaataagactacagcagctcctcaaagctgcaatctcttctttatccaccctccctccttccttccttcacattaccctcgtccacatgttcacacatacactcactcctccgcccttttgtcctttatacaaatatccaggagcaaggcggtgtggaaactaagtggaagctcaaacactacctcctctgcatgtttaaactaaagggctaaggcaccccgggggcaaacataacagaaagcctgggatgagaggcatgtgggcaaggggcctcatgcggcctgaactggagcagcttgtggagagcagcagtaccagactcaggcactatgacaaggcagcaactgcaggcagatggaggaaaagagaacacatctagggagggaagaagcagccctgcagagcacctacactcaacaatgggatccgaaaggagagcaaagacgcaaatgaaagtggaaaaccctgaaattcaaaactctgattcaaaacccacatccttccagggctcctcctgttgttttgagcagctttctccttacgacaagcaggaaggcagatgctaacttctaaattgtgatttgtaaaacttcatatgtgtatcttttcctaatctttttttgaatggtgtcatataagggaaagttaagaatcttcacctgaccctcctggcttccagctagataaatcccagaggtaaagcacctgatctacccaggctgcggcttttgatatggaaatcggatggctagggttttttttttttttttttttttttttgctccactgcagcttctgcctaggcataaggcccaaaccccagaaagaataaagcagtcaatttgcagtaacacgactaatatatatatatctatataatttattctacatagttaacctgcacatgtgttacctgatttggcagatcaaaggttcttagggtttgataagtacgtttacggatgatgttaaaggtaaaaggttttttttttctcatatttattgcgaattcaccatgtataccatttatatacaatacttatagtgctactgaaacataggagttttctatttaataagaagtcatgggaagaagctttctatatttacctttaaatacactctatgggtaaataaaatctttcatactcacaggctgcattgtaagctacacacatatgatggtctggacatatgtttgaaaagattactttagtgtatctaattaaagtggctttatttattttttatttaatttttttgagacaggatcctgctctgtcacccaggctggagtgcaaaggcacaataacagcttactgcagcctctaggctcaagcaatcctcccagctcagcctcccaagtggctgggaccacaggtgcttgccaccatgcccagctaattttttaatttaactttttgtagagatgaggtcttcccatgttgcccaggctgatctctaactactgggctcaagcaatcctaccacctcagcctctcaaagttgctgggattacaggcgtaagtcatctcacctggcctattttttttttaaaggctaaaaagaaatatacttacaattaaccaataatttttagaaaaacagaactatgttctaaaatcacttatatttcaagtatttatagttccttactctaaaatcagaaacactgccctgaggctaaacaagatcttttgcagtttgctatcaacattattaaaaatatattggccactgagaaatgcaaatgaagcaccatcttctaaatgtttttataaagtaaattataataaattattattttccagttagattttagtacagaataagtataccacattctttttatttcttggatttataattccttcttcaaagcagaaataataataaggctaatattacatatcattttgcataagtcagggagtagtgttaaaaatactttacatagttaattcatttaattctcataaaccttctgcttagttctaattttaagataagaaagcaggctcaaagaggttacataaattgaccaagttaacatgcgtttgacaattagagtcaggatttaaaaacaggcagcacggtgccagaagctgggctcttaaccacgatgccatattagctcttagatgtaagaaacagaaagaaaacaaaacaaccactgttcaaatatgaatgtgtatataattaatttgtttactaattcttgtttttcatagtgcattttaaaaggttaaatgagaataataatcaagaacaaaaaatattcatttccaaatctaaaattgatgaacatgccaaacacatcagaaacaactaaacaccctgctcattacttcctctgattattgccatacatgtcctaaagtacaccaagcttatgtgaaaggaaaaaagaagaaacctctttaatctgcaaacatttacaaaaaaatgagagtccccagtggcaatatgtaatggtttaaaatagctcaaaaaataaattcacattcatttataaatgaccacgagaaatataattatcccttccaattgcaattaaaaaatttttaaatatgttctaatcatgctgcctatattaaaacacagtaaggtaacttctgaattaaagtttcattaaaaattttacatactataggtgtactgtatgcatacacacacccactttaatttatttatttacttatttttacaagctcagattctggaattgttcaagctccactgaaaaacctcttgtcatggaaaatatgcagcttactgatatttagaatggttttcctgtaattaactcccccttgaggattttaagttagcagcagtaaaattaccaacagtactctaatatacaccacatgcgctggtgttcaattctcagtggtctaatagctttctgctaaagaaccttaaaaaaaaattagaacaaaacttttccaagcataaaataaaggattattatcatgtttatatgtactggggaaaagtatatttttaactttcatttgccttattctcaatcaaccattataaacaagtattttgatatcttctgtgagcatattctacacacgtctaaaagttaattggatgaagtcagaatatactttgggttccattttaaagctcaattcagatatttctggctaataaaattgttactaacatgattgctgtttaaatttttcatatcattattaagaaatgccttttattctggtttaatttcaccttttattctagtttaatatttatcctaacttaatacttaaactgcaattgttacataaaattggagaaatctgtcagaaatgtcatctttaaaaatgatttgattcactgaggctaagaacaatgaaaggcctaagagagagaggctggtccccaaaatgtaaaattcaagttcttcagagctaactctggacatgagttgatttatctatccaccacaaaacaggtaagtagaattaaaatataaaaacagcaaaaacacacacaacaaaaactgttccacctttgatataaatcctttttaacatctactgagcaagtgaactggaatcatcaatagtctgtattaaagtaaaagaagtttatactttaagaattagcatttttaaaaaagactactattagaataacagagtgccttcaaacatacataaaataaaaatgggtatctacttatgtgatctgaagcacacaccataacagcattctgaacaggacacataaagaatatcttataatcaactattgttctaattgattcccctctatagtttatgccatgtccatagcattccaagtcaagaaaactgactctgtaaaaattaatgaaactacaaaggataattaggagaataagccaggtgcatctcgtaataatcatgggctaaccaaaattttagatagagaacctagtatatgttgatcctaaaaaggaagcaacagtatctggcattattgaagttatgagacaatggcacgatttaagatctttacatgatctgtcatccctagaaaaccaaatgagttacttgtatcattccatatgcttacaagatacttttaaaactatgttaaattctccttatatatttctattagcaagcacgttctctaccaaataaaaatgtcttgaattcaataggattctctgctaaactgttttagcacctgaattaaaaccaatctttctaccgtttaaaacattttttacatgtctttaatttaaatataaaattcccgttatatttaataatgaattttagaggacagcacagcacactgatatgaaaatctgggtttcagtcagttaacctgggctttagtcctttatctaccaaaaattatactggccctttgtttcctcagtttccttatctgtaaagaataaagttagactagatgttagccttaggttccttctacatctaaaatgctctgatagtaagtaacagctaaccagggctctggcattaggaaaatgttacaaatcattgctaccaatttctaataaattttaaaactataaaatggaagaaaatgccctcaagaataaaatgcccagctttgcttgagctgctaatttccataaagaatacttaatcataagaggaagtattaattttaattttaaaatatgactcagtttctgcaaagttaaagaaatctcccattacagcatgacttttataaataaccactttggagggtctctgcttgaaaaattacctaaagcttttttccccaagcaagttaatgtgaacttgggaagggcaattaaattgtcagaattaaaaaatttgtttttaactagaaggtagccagaagtagagtcatggggctggtattgatcgcccaaacagagaacatcactcttcaggtatttactctgccacctttacactagaggctttccttcaaatcaaatcaatctataaaaaagatggctcttactactaaaatacgtaactgatctccaatggcacttctatttagatgtcttcctttgataatgataatatagttcatggtgttctaagattctgcatttttaaaatgtcctatctccttagttaaataaattataaataaaagtgagaagtcataaaaatataagaatgacatactatcctcattaatatatattttaaacatttaaattcaacattgaagcacggtatttatccatgttaaaatctgtaatttcaactgctttttgatcacattaacaattttgttttgcatacttaattcttaataagtttattttgattagcttctttaatgctccaaaatttttaaacaccaaattaaaattgaatgtcaccataaaatatttaatacaccagtaaaaaattaagctctttgtttacagaatatattagcataaattttctaacatcgaacaataccataatacaatctatgtgctgaatttattccctttttatttaaaataaaataaatatgaggtaggattagaatttgtgtttttttaaaaaatgttatagtaaatattaaatatgatatatctctgaaattgtaagacaactgaagaatctcctacacatttagatttttaaacatatatttcaaacgcaagttttgtttttaacattttggagtatgacaataatcataaaattactataaaatattactcaatgcttacctttgctgttctctctcaatttaaaaatgcacactaaaacatagataattaacattggattaacctttcaattactatcgagagtaatcagagtgaaatctacttctatacaagtcaagagtcttaggatgatagtaaaaacatgttaataaattcttttttgtcaaactttaatgcagatgcttagcattaaaaaagctgacaaaacaatatgattttaagagctcaacaattaaaatttattcattaaaaatcctgtaactcttcaaaatggttaaatgtactatttttgataagaatattttaataaattctatattaaatctataccacaaattttaaattgaattattgatatctaaggataaaagattaacagcctatctatgtgcaattttagaaaacaaatcctccccttccagatataaaaggaaaatgtttttacgaaaacatattgccatgtatagatctcagaactcacaaattactgtaaatgatggtttagaagacagaaaaataattaaatttcaaattttaagtggacatggtaatacattttgttaaaaattgcaaaaaaagttcaccttctccatgtaagcatcattaaccaaaacaaaccagaaaatccaaaaaaacacacaaaaaaagaaaaaaaaaccctctgaaatctgttatcaccacctaaaaactatatgtactctaaaagcaaaagtggcctaattaattctacattttatttctctttctccacctcctgtagttgaagatgtagggccatgagactattattgcttttagatcactttgttattgactattctctgtatgatcatttattttaaaggactgatgtaacatgtggtgttatatctgatgacatattgtggacattttcttccagaaatggctctttaaggctgagtgcaagaggttaagctgcctgactgaggccaaacctaagattacagatttttaatctaaattcttaatatccttattgaatataaattaacatttattttgtatgctacatatttccatttaatcacaagctcctgcatgttaaaacaataccctgaaaaaggaaaattaaaagtacttctgactttattaaaaaccaatttatattttataaagtcaggataattttaatgtggggaggagcatttcccccttaaccaatatatcttaattgactttcaaaaatcataaaataagtgaaattttataaaaatttatagtatcaaatccaaaggaaattttcagtttttccaatttacttataagacttttacctaaactgaatcatagtcatatgcattgtatcaaaaaagcaaaaatgttttgttaagctctgataacaaaataatatagaataggaacgtatgaaaataatgtttattctctttttccatgagccatctatcataaccatcttcaaatcaaggctcagaaagtatctaggcaattggacatttattattatctttcccagttcatgatctcatgctaaaataccaggattgggcgaaaaccatgtatacacaacagaacctagaaacttatctggtttgtaaatgctgtcttcctgatattcatggatttaaggcatgcctcctggattcatttactcaaagctgaatgtgtcgcttaaaaggagacatatttaatctttgtactctgaaacaaagggtctatgttaagtaagttttgtatgtgtaacataattaataaatatacttgacaccataatttaataggactctatagtaactataaaaaaatttaacttctctttctggtatgaacaaccataaaatgtggtgttggaccattttacagtgccttgtaataatgaagttatgctcttcattaccaagtcctgtacctgctgctattggcaaggaatggtttatacactgaccatgttccacggctgtttttagtgtcgcttcaggatgtgtcgatcctagagggttacgcacaaatcgtcgccggcgccgcaagtcatcttcccagtagtcaaggcgccagaactcaagaggacgactacaatgaaacagagaagccacatatgttagcaattatcaaacagcgtggtagcactgaatttctgcataaagctctccttgtttgctctgcctttttttccctctccttccacttaattctccctccatctcacactcccctttctgcaatctttaacttaggtatgtccttgaaaataacaatatcaccttctagtctaaggaactccttttccttttcttggaaggtgaaatgagcactaaatacatcattttgaaatgaattgctgacagtgtgatcagtttccccacactctagtggcatgtgctctgatttcagcctcatttcagcctcagcagggcacctttctctgtagctgcatttataaaccagaatagggaaaaggctattataaatatggtatagcattacctatattaatcaaagtccgtcccccttcatttttcttcctaatttgtgcctttttgcacaaggtcagtaaatcataccatgaattcttggtccagaaagtgttaactttaatgaatatctcagttacatggttatgtatgtgataataaaatattactctgtttagatgtgcaggaatttaattaaaataatctcttaaaatattcattacatttagcccctgaggcttagaacaacacaagaaaatgcatttcttttccatttactgtttttaaataaaccattcctgtagagtgaaatagcaatctattttcaagcaaatcagattggatttctgttttatgtactctgtttttatatttaattaaaaactacatgctatatgatgtgcaataattgctatatcaaaagcatacttttggaaatgtattttttaaaaaaaggtttgctcatttcaaattctatatttcccctattacatacacattttatatggcaatatataaatgtcagctttctctcttgttaactaatcatgatctagcatgctggaaaaatattttataaggaaaatactaaagtgttttcagttatagtaagaaaaaagtctctgtagaatacattaattcaataaagatatacagcaggaacacctgtaagtttcaataatgaaattaaaaaattattcataatcaaaacttcttcaggaatgactaatacaaaatacaatcttacttatatttcgggagctaataaaattgtatctgtcagctttgacaaattagtagtcttcaacaactgacagtcccaaactacccaagtaaaagttacctttattttgatgttttaaagatgttctctttaaaaattcaaaataggtttataaataagtacttttatcaattaaaaactatcttgtattaataaaaagcataaacagtacgttatttaaagaaaatctttttaaaacagtagagactgatctctgaaaatgctgaagggataagaacatcaaatatttccttgggtgattttggtcaggagaaggagatataatgtaatcaaaatgtaatacaaaaaaagtataagaattgcagttctcaaaaagaaaaatttaaaaagctattattatatatttcttcattattctgtctaaatttgaataaaaacatgatgatattatttaaaaataaataaatacccacagaatatacatacaatcaaaagacaacagttgttttaactcaattaataaaatgaaattctccttaggtgagaaggaaaaaggcagtacacagatggctgtgtgtatggctttgatagtcatggagcttggataggcacttcatcattctgcctacctacatttatctgttaaaattattatcaaatatcagccaggatgcagtcgtgaatcacaggctgctcctcgccttcaggggaatgatacaatgagggtctattcatcagtgcggcaatcggcacaagtaattagttccctagactgagatctcctacaaagcctatttcagtcagcaccacaaacatatgacgatgtaaagctaatgaaagctgctcaaatttgttaaccttttctgccatctatccttctaatactctatgcttcagtattatgcaaaggtagtaaattattaatttgtcattcatccatccttctacattttgagtcaaattaaatgatgtcattcttcttgataacaattaaaattataagagatgttaagctgctatgataaaattatgactaaattaggtaacaatagattctactataatgcaccacagtgaagtcaaattcaatggctattaagcatatgcacaataacttttatcacacagcagaaaaaccagaggaattataaaattattcacaaattatcaagtaactcaaagataatatctatagcaaaaataaccaaaattaggaggaaataaaacgataatatttatttttataccttgacactaaaaaaaatggtcaaaatggtgacatttggctaaaacaaaaacaccaatgcatcagggaactgagaatttgttcacataatagaaatgaaagttgtttcatttctgctaactatatatatatatgcagacatacatactgtcttcaaatatattctatcaatttttttttctttttgagttggagtctcgctctgtcacccaggctggagtgcagtggcactatctctgctcactgcaagctccttttcctgggttcacaccattctcctgcctcagcctcccgagtacctgggactacaggcgcctgccaccatgcccggctaattttttgtgtttttagtagagacagggtttcaccatattagccaggatggtcttgatctcctgacctcatgatccgcccgcctcggcctcccaaagtgctgggattacaagtgtgagccaccgcacccggcctattctatcaataatttttttaaatacttaaacatggtccaaatagaataaacgacctgtaataccacagcatgataatatttacaatctcctgaagctatgtcacttaaggactatttttccaacacaatccagttacaacacaattaaaaacaatctgaagacaaagcaaatatcacttagttcagatcacatatctagaaagaattataaaaatcatttcaaaagaccaacaatttcaatatattttttgagagtctcttcatataaagcactgctccaggtgctacagtgtacaaagttctcatgtaatagacttataatcaaacagttagctattagtctcatttgagaaaatagcatttatcacccaatttcagattgtgtaggtaatacatgtttttggagaaaaagccacacacccacttatttgagatatatttaaagtcatttaaatatatttaataactagcatatttaaagtcatttacacagtaacaaacctgggcctaaagtacaatgttttgtttccctaagtctgctccctccaacaacacatactctcagtataacgctctaccacacacacacacaaaaatgaggccggctttgtcattttaaaacagtattataaaggagaatgtgtaggttttggtcttcaacttactttcttcactctcatttaagaaatactgttccctaccccgtcccttcctcaaaagcctcttccaggcaaaagaggatacaaaattggcaaatttattaataacatagtgatccaaccctcttcccaaaaggttataaagtaattaaaagattatacatttttgtagttatcaccatggtacgatcagcaaaatttaaaagacttcatgtgttcagaaacagactgttgaccaaatataagcatggataagatcagaaatcacttattctggcaccttataagtacatatctagatcacattatatacctatacctttatatatctgtatctatccccaaaagttatattaatactacacaacaccctttcacaaacttcactcatatccatttccactaagatcctcaaaatcttcaaagtaaagaggttagcctaagttttagatctggaaatactatttccttcagaagacataagcccttctctacaaagatgccctacttagggctcctcttaggacacaatctccaggtactaaagtctttgactggtggaacatatgtctttaaaaagttatggatggcactgaagttaaatattataatctttctaattattttttaatttagttttttcgttctttggtctaacttcagagtctgaagttaaaattaccatgtaagtctattggacttttctacatatacgtcatctaattatgtttctactttttaaaaaactttcacgttatgtgtttgtatacacacacctttaatacatcactataatctacataaaataacataaagcaatgtcatggcttttttgtggttgttgttgttttttaagatggtagagtgtcacccaggctggaatgcagtggcaacatgagggaacagaacaaagctcactgcagcctctaacttttgggctcaaaagattctcctgcctcatcctccccagtaactgagacatcctccccagtacaaaaattagtaatctggctaattttttttattttcttagagatgggatcttgctacattgcccaggctggtttcgaactcttggcctcaaatgatcctcctccttgagcctcctgagtagctgggattacagacacaagccactgagcttggctggcaatgccattttaatacatagaatatatgttttatgttctacaagaacagaatttgatagattattaaatttttagaaagaaatataactcaaacatcaatagataggctatttattctatttcctaggccctttatggttactgatttgatcaggtagaacaaatgaataagaattaaacaaatgagaatcatttggaagaggcagaagtattaaaacaaaatcaacaactaaggtacgattcacatttttcctctaatagttaaatgatacaactatacaaatttgactattatttttctcatgttaattgtaagaatttttaggctgggcactgtggctaatgcctgtaatcctagaactcagggaggctaaggaaggaaaactgcttgaggtcaggagttcaagaccagcctgggcaacatagcaagaccctggttcaaaaaaaaaaaattagacaggtgaggtggtgcatgtctgtagttctagcttcttgggaggctaaggtgggaaggtttcttgagcccataagttggaggttgctgtgagctctgatgatggcaatgaactctagcctggctgacagagggagagactatctccaaaaaaaaaaaggaattataaagtttagattttttgaaacccaattagccagttaacatggtatgaatggccaaatattctaataaaataccaatatattttctaataacaattatttattatttacctgagtcagctgtggcaatacaaggattattacaatgttgtccctgatgtcatggaaaaggcagatgcaaaaacaaataataagaattcaaaaaagtatgtgtaacagaacagagctttactacatggctattaaggtgcacaactccagggggcacttttcacatcaaaatttttgtaaataacatgccctggagttatgcaatgctcactgtacattactatatgccacagcccaagtgctaggagaatactacctttacccacacatcccccagttcccctgccccacaattcaatgctcaggctcctttctttctctggaatccaaaagttaaatctaaacttgggaacaggaaacagaacaaagcccttcagacactatcagtggcagttgcacagtcagtatttccctgctgtaggaaaaagtggacatattaggaagatgcttggttgtcaaaacacaagcaaaattcaataaaaagaatgaaataattaagtacataagagaaatattaacatttatttaaccaaaaaccattaagttcgcattgctatattaaagtagataactttctggatattgctgtattaaagcagagtagtttccagaacaatgttaattactgaaatcagtggtagctatgtaagtatcccagttattctacaacctagatgaattggcacctattatcaaatgagtcaaatgtattcatgtctatcatctcactggttttagtgtcattttaatgtaacttaaatatgtcaataaaagtatatgagttttaaaaagaaaacctgtcaaaacacaatcatattagaaaattttcccattttccatctcgcccactttgctttggcaatacctgataaatcttgataaccttaacagaagtcagtaagaaattctcctagctaaagttccaaatcctagaacattttagcacttcatattttgttcttaaattttcacattgcctgttttttaaactcctatatctgactagcttctatttccatatttttagattaaaaattcatagtagacattagttacaactgaaataaatggtaacccctaaaaagcagtaaacattttcagagcactgtcagcttgaagataaaaagcacttaagttctagaaaggtttcacattctgtataaatcttggtgaaataatgttcaggtactataggtatcatacaatataagagaatgctttacctcacaaactgaaatctatggtgccttcatgcaaataaaaagaaaattaactaaaacctctgtttaccaagtaccaactataaatcaagggcagctgatctatgcattatgctgtcttaatgaaaaggacaaacaaaaacaaaaacaaacccttcaattgtgtggattccagcagagaagacacatactaaagcagaattctttctttattgaggcctgacattgagacactggagtatcatatattttatttaattatgtaaaatcaaattttatgtaattaggaatttctgcatgtcactattcaatgtatgtctgtatttgttttttaaagccatctagatatccatcttcaattaattattagtttggacatttggcaaccaagttaattattcaagaaatgatcccaagcttttcctgtctgttgttagccagttgaccatttctttcttcacttagaatttttaccagggattgagtaaagttatgagactatcaaaatctggtgttatactaccagttaaagctctaacaaaagacatctaggaaaaaaaaccattaaaatgatgttattaagaaccagaagccttaaagctcacctcagcctcactatttagacaaatctattatactgtccccaaatatctaatttaaaaaaattcaccaaacacttgttgagtgccaactatgtaccagattgtggtacatacaaatgaatgatgctgggctcaacctacacaggacaatggggacaaggaaattattaaatataaaaaaaataagttaaaatagactatattactttaggctactctgtgctacacactgttctctgttatatacagtaccgccaagcctcaacaaccctgccatgattaaatactgctattctcattttaaaggtgacgaaagtaagttttacccattggtagtaaataataagtctgatgacgtctaagccaatgagcttttcactacatagcatttcctcttgaacatcttattcgttactattatagctatgatcaaagtactaattaaccctgcctgggaggactcaggatttcattaagatttcaatgaggatctattttgtaagttacatgaagagaagggtttatgcgtaattcactgaccaagcacagtaactgttacaaaactgccacttaataaataattgatcaaagagtaaaccgatgacttttaaacagaaacttaaatgataaacaggagtctgctgaacaaaatggaaaaggcactataagccaagaaatagcatggataaaggcatggaaatgtaaaagggctctgtaatttaaggaagttttggtaagaaatcacagctagacagccttaggatgggaaaagctaaggtaaaaaacataggtttagaaccagatttcaaaagaccttgtagagttaactaaagtaactacctgtacatcctagagtctacagagacagcatcaggctttcacaagaggtttaatatgatcaggcttgtatgctacacggcagcaacatacagaatgtctggattaaggcagtgaggatggagcctagaagtgaagggtttaaagacatatctgaggtagaatagataagacttcacatgatattcaaatatgggaggtgaggaaaaagataatgagaataaaatcaagggctgtaacaagagggaagttagaagataaagatgctatttaattaaaataaatacaggttaaacaggcctgactgggaaaaataatcgcatcctagatgcctaataacatccaggcaggtatttctaataggtaagtaatataacactggaattgaaagagaagaggcctgtgctagagatttaaaatagggagattgaccaggcatggtggttcaggcctgtaatcctagcactttgggaggctgagacaggtggatcacttgagccgtggagttcaagaccagcctggccaacatggcgaaaccctctctctacaaaagatacaaaaattaggcagacacggtggctcacacctgtaatcccagcactttgggaggctgaggcgggcggatcacgaggtcaggagtttgagaccagcctggccaacgtggtgaaaccccgtctctactaaaaatacaaaaattatccaggcatggtggcatgtgcctgtaatctcagctacttgggaggctgaggcaggagaattgcttgaacctgggaggcagaagttgcagtgagccaagatcgcgccactgcactccagcctgggtgacagagaaagactccgtctcaggaagaaaaaagaaaagatacaaaaattagccaggtgtggtggtgcacgcctgtagtcccagctacttgggaagcagaggtgggagcgtcacctgagcccaagaggttgaggttgcagtgagctgaaattgtgccactgcactccagcccaggtaacagagtgagatcctgtctcaaaaaatatataagaaaatagggagactggttagtcttgggagtcagtagatttagcattcatttaacaaaaatgtactgagtgtttattgtaagcctgggtattttgctagacccagagaagagtctattgaaagggcaggagaaagatggggatgaatattgcagaacagaaaaggatcagtaaaagaaacagggaagtaacagtgccttacagtcaataagataatgggagaaccaaaatagaacggtgccaaaaaagacaaatgagcaaaaatgtttcaaagcagtcagcgggcaccattatttaattctgcttaaacatgctcaaaaggatgaaaaatgaagagaagtctttgttcatgttttgtgtttttaacagctttatgatatataatgtatacaccataatgctcacccgtttaaaatgtacaattcaacgttttttagtatatttacagagttgtacaatcatcaccatgatctaatttaaaaacatttttatcaccccaaaatgaaactccatacccattacccgtcattccacatcttcccttcctcccagcccctggcaatgatgagcctaccttctttctcaacatatttacctattctggacattttatataaatggaatccatacaatatgtagaattgtgtgactggcttctttcactcagcataatgtttttgaggttcatctatgttgtagcacatattggtagctcattctttttattactgaatgatatttcattgtgtagatacgctgcattttgattatccattcatgtactgatgaacacttgagttgtttccattttgtggggatctttgggttttacgatgagaaaactgaagtacttggttagctatctagcattcacttctctcctctttcctaataactgaattacaattttgttcagatatctatcactttttaaatgtttctctgactcatggaaagctgaccaaattatgataaatccggtcattctcagcagcgattggttcaggaatccagctttaagaggatcactgcataaattctgcctagcaaccacttttcaccaatatgaaatggaaaccttctattcagtggttgagacaagagttctttctttttcctgatggtctgacacaatgaaacatgtagatccagttgctggcagtcataaggcatccatgagagaagccagattggaaatagtttatacatccggggacagagaactgaaagagttacaggaaaatggagccagaagcctgccccaaagcctatacatatctgtacttcttataagagatattatacttcttcataatctagtgaagtcaggaagttcacttggtgcaagatttcttattacttgcctttgaaaccacctaacagatacatggattactggtgatgctgtgagcaatttgattacagtggctggaaggaaaagtagagagtaaaacacttatgctttggtggcaatggttaatattgatctcctcttcaaaaattttgacgatgaaaggaattagagagctaggatggcggtttaaagaaggtaaagaacagacttaagcatgtttgcagaaggaaaagacaaagtccaaagaattcaaagaagctgaagatggcattgggggtaggaggtgggtagcaggagcagggtttgataaagacagaagaggtatgatcccataaaaagataacatgatgaacttggaagtaactaaggtcatctctttctttgtggcaaaatccaaggatgtaagactctgtactttaataaattcagggctgaagagaagaaaaactaaagaccagattttcacctgattgtttgttttttttctattacgtagcatatttttgactaaagaaaagaatagaggaggtaaaattagaagaggtgccttggggaatacagaagaaagctgacaaaggaaaagtttaaggatgattaaatagcttatgaaggtccagctgagtttggaaaccattgaggtagcatcgatctgcagaactgtgtgatttttcctataccctgaccctgaccatacatagtaacctgggagaaagagtaaaaagagcagctgaggccaggtgtggtggctcacgcctataatcccagcactttgggaggccgaggtgggtgaatcacgaggtcaggagttcgagaccatcctggccaacatggcgaaaactcgtctctactaaagacataaaaaattatctgggcgtggtggtgtgtgcctgtaatcccagctacacgggagactgaggcaggagaatcgcttgaacctgggaggcagaggttgcagtgagctgagattacaccactgcactccagcctgggcgacagggtgagactcccatcacaaaaaaacaaacaaacaaacaaacaaacaaaaaacaaagcagttgaccagactcattcaagatttaggactgatttggttggcagaccaaaataaggaaggttaaggaaaatgagtaggctagtaagaacgcctgggatgactatgggtgataaatccatgatctttctggactttaataaaataaataacataggctttatagacattgactcattgggaaatcaaatttatcctgcatcccaagctacttatattgatgataattaatcaatataactggcttatgatgcagtataaatttgattttccaatgaaacaatcagtaattctatttaatcaatatatccagtccccttatttactgctgctatgttttcaacttgtactaaaacacatatagaataaaagaatggaagattatactgtacttgaagactttcttcagtcttcaaaatgataggatcactagccaggagatgaggatagggaggagaaggttgttgtaaataatcatgggactgaacaatctatacgcagagaccatctgaaggcttagggaggcaggacctcactcttttaagaagtatattacattatgctcctggaaagaggatgggaactaaaatttactgactgccaataatgtattaggcatgctagtacgtattttacatgtgatctcatttaattctcaaaacaaccatataaattagagatataacacctatttaacagttgaagaattgaggcccagaaggtgagtgattcagttactaagaaatagcgctagaccctcccaactagaactacccattaccaaaaattttccaggctactttggctaagacattcatatgaggttcattaatatacttcttatgacagttcattatattggtatgagtttaaatatctctttcataaagtgacagatataactataaacaaaaaattttataaattatatgaaaacctatcaacacacatttcaataaagaataactagaaaattcataatttttccagcattagcatcactcaaaattcaaatagcaaggctattagactaagggtaaggagttacaaggctctatcgcttttcaatgtataagtataactaagtactgtgtagtgcagggtcagtatttgtaagtaagtagcctgaaagctattaatattcagaaatatgtttagtaaccacatcacttgccccaaatttggaagaactacataagcatctacatgaagcaatctcatatccaagaaccactgctttggcatacagaacctttatttctacgcgctctctctctctctttctctctctctaagacaaggcctcactctgttgctcaggctggagtgcagtggcacaatcacggttcactgcaacttcaacatcgcaggctcaggtgatcctcccacctcagcctcctgagtagctgggactacaggcacaagccaccatgccaggggaatttttgcattttttgtagagatggggtttcgcccctttgcccaggctgtatttctctcaaagtcaagtcctataccacatttgttgctgttcttcttaagatactttgtaagtaacaggaagacaagaaaagaacaaaaaaaaagtcaccctccatagcataacatttttatctttaaataattttttaaagtttacatgaagaaaaaccctgcataatccatcacttcctctttttaaaccaaaactctcaggaaaatactgagagtaaataactgattttaactaacataaaagaaaaatatatatactgtactttgcaacctggataaattaaagcgttagcaaaaggtatgtgctttttatccactggggaaaacaaggcttattatgttacacttccaggtttttaagacagttggaagccggttctctgaatagttgctgtcatctcctagatactttctagtactttcaattttgaagcaattatttacattctaaagtgatttattttcctctctttctttgctacatttcatttcttctggttctcaatgaccatctctactttggcttaattatattcatttacaaatattttctgagtacctgctaccgtgtggaaagaactggttgaggtgccttaagaaatactcatatgaagaaaacacaagtctctaatctcaaggcacttaaaatctaataaatgggataaaataagcaaacaaaaaattatatgacataaaatccacaccataagaaaagtaaaaacccagagtgatagaaaggcaaagagtaatcacatttgttttaaagggaccaagaagctttaaagagcaagagatttttgagaaatacccttaagaagaggccaattttcaattgatacacaaagaagacgatgacattttaggcttttaggagatcttaagtaaaagtatagaggtctgaaaattggaagcagtctcatttagccggtccaatagaaaatgagatatgaaagataagttagagccataacataaaaaatcaggaatgaaaaactaataagcttatatttcactcatttactcacttgttcatttaatcaaaaacacatactgaataccaacaatgagtaaagacaggagattcggtcatttggtgatagaaagtcattattctcaaggtcctcaaaatccaataagagaaacagatatatgaagagataattacaatatatgcaaaaggtaccttagggacacagttgaagggcattatccaaagtaatagaagccttcttagaagtgagtaatccacaaattgagtcaaagagttaacagatgttaaccagaataagaaaaggaaaatcattctttctgagggaacagcattagcaaagccaaacaagtaagaaacaattgggtataagctaaagttaaatgtttccagaatttttggagcggcataaagcaagaagtgcccaaacaagaggctatagagggcaggggccagatcatgaagaatcattttaggagtctggctcctggtttaaaacctatgtgtgatttttttcaggccttaccatgggtagttacaaaacctttacctggcaggcctcacagagaaaagctgtactccccacatcagacttgatgtacagcgaatgctttgcatctctggcgggagttgcagctaaggtcttaggcctctctggccagttatgctctttgcacatttacattcctagccctgatgaattgattcttgggtctgtatctgaaaccttggcctaagatcctctccaggcatctcttcctagaactccttacttggagaggaagggaaaactctgaagacagtattccctactctgattcagcctgttccaagaccaccccgctagcccttcctctgacctcgtgtccataaaactaccagagtctttagtttcaagtttcttcaacaataagatgactctcacatctgcgcagatccacactaacccttgaaaagcatgccattctatggcgggaaatggaatggggagtcaaccccttccttcggatttagactcttgctaataccatcatagttaatgattaaaggcttaccctttcatttttggcttgttactttaattggctactcctacacctgacagttcaactctcccagctcagcttaggccatggccatgtcatgttaaggagcttgggttttaccctatagcaatggggagatattgaagagttttaagtaggtattataactgcagataaatagaaaattagactatagggaagaaatatcttaaatatcactttcacaagaaagtggaaaaaaaagtaagaaagttattggaataaacaacatgtaatgagagccttcaatactaatttttaaatttctatttttcagatttatcctatcaaggttttattgaaacttgcctaaaattgtctatgatacaaggtaggcaataaatataaatgaataagggtatgaaagaaaagctcaagcatacagccattttgttcacaacaaaatagtttccaaaccatgtgatgtacaaagttaattaaatgttacatggaaaaagtagacctataattgaagtagagatcaaagtcctaaagctaagtgtagagatgaaaaaagaacataggaaaggtccaataggtgatatatcacctcagcccagaaaggacatacatgtaatctactcacattccactcatctccctaagtcatgtaacactgcaaaagcaatgtgttccctggctgggtagccatttcccagcaaaactttaaactatacaaagaggcatgaaactatggttatcagctggccatatctgtgacagatgacaataagtaccaaagacaaaacagaaaaaagggacagaaaatacaagggaggtaatagggaacatgttaacatctcaagtaagatgcttagaaataattttctgaaagcaacctttgagcaaagacttgaaggaggtgaaggtgtcagttatgcagatatcttaaagcaaaaggatttccggcagggaaaacagtaatgcaaaggccctgaggcagacacacttggtgaaatgatggaatgtaggaggccattttggatacataaagaataacagagttaagtagaaatcaaatagtttctaagagggccaaatcatttaagtcttcataggttataacaagaatttgacttttattctctgtggaatgagacattagaagattataagcaaagaattgatgagacctgacatgttttaacgtgatcactccagctcctgcaagagcctggctgtgagtggaaagagtgtccagtttataggcttttgcaataatccaggagagagagacgatgtctgggaacaaatagcagcagtggaagtagtaaaaagtcattgaattatggatatatattgaaggttgagtcaaaagaatatgctaacagatcatatatgggatgtgagagaagaggaggcactgatattacaagtactttgatctgagaaaataaaagaactgaccctgagaaaaaagagaatgtgagaggaataggttttaataaagaaagtctaaaatttggttttaaacatgttttattcagggtgcctattagaaatctggggcagaaaagggctaactatttgccaaatcccttttcatcttcttcttaggcacacaactagaccatatttcccaatctcctttgcaattaagtatggcaatatgactgagttgtagccagtgacatgcaagcagaagtgattgaggcacacttccaaacccggccaataaaactttccacatacaactggccatgctctaccaccttccactgttttgatgcagatgaatggggcactcttggaagccaagaactaaggataatggagctataagatgaaggaaattatccaccagaaacatgttataaaatttatatgaaacagaaattatgttctattatgatcggacactgactgagatttggaatctatccactaaagcagttaccactgcccaaactaacacagatatccaagctgagatattcagtaaacaactgaatataagagtgtggagttcaaaggaaagaacctgacaggatatataattcgagagacattgatgactagtgtttacataatacaggtgtggactggctcagactttcaagcaagtgaccaaagctggagaagaaaatggaaaagtaaaagtacaaagagtaaggcctgtaccagctcaacaataaagagattgaaaagacgaggaagaaccagcaaggaattttgaagagaggccagtagtaagaggaacacctgtttactcatctcatattggcagtaagaagaaaacaagaaaaatacagtgtcccagaaaccaaatgaaaaaaatgtgtcaaggagaaggtagtaatcaaccatatcaaagggtatcaaaaagtcaagtaagaagaaaactgagacttgactattggatttatttatttatttatttaaagactagtcaatgactattggatttaacaatattgatgtctctggtgaccttgaaaagaacagcttcagtatatggtgggaaaagagcttgagtgaagcaagttcaagagagaataggagaagagaaactcagcaagtagaaataaatctttcagttattcaactgtagtacagaagtcacttaaattatatactggatttagtacattataaacatttgggggggaaagcatgaatgcaaataatccaccaaatggtactttacaaatgccatagaattttacaacataaagagattctagtagaccctgacacatcgtaagaatacactagatatagagaaatataatttgaaaagataaaaagtcaaaatcacaaagcctgcaaacttctaagggcttattcatgttcagttcattaacctgcaaaggcaagtttagtacattttgtcagcaagcttgtcaactagggtttatacttcaaatactgacactcaagtatcaatattcaactttgaggagaatcaaaaagttaagagaaagattaagaaaaaatggttcctgaaaaaaaattcattgatgggagctgaaatagctctaacaagcagcaatactatctatgttaatttcaagaactaaaatatgaactatctcaaaaaacctcataaagaaacaaatatgatttaacgataaaacacttaatctagacatttaaaatgaataatctggacatttaatctagacatttaaaatctagacttttaaaatgaataacaagtagcgctggctggacactggcctcacgcctgtaatcccagcactttgggaggccaaggtgggcagatcacctgaggtcaggagtttgggaccaggctggccaacatggtgaaaccctgtctctactaaaaattcaaaaattagctgggcatggtggcaggcgcctgtaatcccagctactccagaggctgaggcaggagaatcgcttgaacccgagaggcggaggttgcagtgagcagagattgcaccattgtactccagcctgggcaacaagaatgagacttcgtctcaaaaaaaaaaaatggctctatcaattcaaacaacttaatgtctatgtgagagctttcctatattccgcctgaggtacacagaagccatataggctacgcatcaattttcttttaccagttcattgctatagccactaaacctcgtctattaatcacaaagacacattaaaatgcactgttcggctaagcacagtggctcatgactgaaatcccagcactttgggaggccaaggtgggccagactgcttgagcccaggagttcaacaccaacctgggcaacatggtgaaaccccatctctacaaaaaatacaaaaagctgagtgagatggtgcgagcctgtagtcccagccactcaggaggctgaggtgggaggatcgattgagcctggggaggttgaggctgcagtgaggcatgatcatcctactgcacatccagcctgggtgacagagcagagcaagatcctgtctcaaacaaaaaaaaaagaactcttagattctgatagtttctcttcttgcctttataatcacacagtataatcagcttctgcaaattactattgttgaaagtttacttttcattattctgcttcattcatttagttatatgtgctcggctagggatatagcatggggaaaacaaatgaagaccctgctctcatatcacttatactcttgtctatctgaaagactctctgtcccaaaaaggatcttgcatggaaaaaaagtcatcttttagtaaatgaggattatgcaggctaacaaaagcataaatgaaatgtaaaaatattccaaagggttcatgagattccctcaactttgtttatattaggaaacagaaaaattaagttatttgagttgtagctcttctctttcaactcctaatctttggaaacctggaatagttttttattttttaaagttaaaaaagtataaagccctaagtttagaaataatttatataaaaaattagttgcaccctctcaagaacaagccaatattttcagtgctaatctcttcaaacagcaataaactatattatgtcctagtcagttcattagttttactgcaaatatatgacaagtaagctttctggtctgctatagcattttctttagctacagaagtgttaaaaatgctgtttattttaattatgtagtaaattcacaataaacattatgtatacatatattatgtatatgtgtgtatgtatatatatatatatatatatatacacacatacacacacatatatatatcctaattcagcagttttaatcaaaagacaaatatgcacttaagtctactaaaagaaataatcatgttagagagagagaacaccaagaataacctctacattttaatttgctggagaaataaatgcagccatacctggaaaaaatgcattaaattttaaaagcaaagtcattatttctaagttttataagtttattatcaatgcaagtttaaaaagaaaataaaatcacagagaggtacatgtttaaataccttatggtttcattttacacttctcatatcaggatgaagtcttaaaagtaattcaaaaggaaaatgaaagtatttgcccagacgatagagtccatatgttcttcaatctggaaatccattgggaaaaaggcttgagtttttaaaaactgaattttgacaattggaagctgatgtggctttttttccctctccaggaagatttgagtcattctcagagggaatgaaatagacctttatcaagtattgcaaagcttaacacctgtttaactccaaattacttagaaaacatttagttagtcttcagaatctcaaaataagggttgttataaacacttttcctaacagtaagatgttttttaagtttagcaagaaggcgtatctacatattcaagtctgtttatatttcatattctacagatatcaaccatcttgtaacagtctatttgttattactatacagattcctatataattttgttattcctaagattataagtaggctgtaattaaataactagttgaacatccatcataccattaggctccacaactgagggcagtctggttcttccccactgtttgtatgaatcccaagcttctagcacaagaagaagcaactagtatgcacttaaataaagcccatcaaaatgataaatatgtaccctactctgatcattctttcatagatctaaaatgaagctaacatattcaaagttaaaatgagtttgctctcaaaatcaaggtagaaaatagactggagttcttacaggagcctcagttttacacaacatagcacaaattggataacttgtgctccactactaatgtataaaattcctaaatgaatgtaatttaactacaaaaaatttattgtattcctattatgtaaaaagaaatttgctaaactatactgacatattaaatacctagattaaaaacgttaatgtttcgttaatggatcaaaaattacatcagagttaaagtaactacaatagtgtatttttaaaaaaaacatttctcaaaacatatacaaatggccaacaaacatatgaaaaaatgctcaacatcactaatcatcacagaaatgcaaattaaaaccacaatgagataccaccctactcctgcaagaatggccattattaaaaagtcaaaaaacagtagatgttggcatggatgtggtgaaaagggaatgcatatactctgctggtgggaatgtaaattaatacaacctctatggaaaactgtttggaaatttcttaaagaattaaaagtaggtctaccattcaatcaagcaatcacactactgggtatctatctgaagggaaatcagtcattacatcaaaaagacatctgcaagcatatgtttattgcagcacaattcacagctgcaaagatacggaatcaacctaagtgcccatcgaacaatgaatggataaagaaaatgtggtatgtatacaccatggaatactactcagccataaaaaagaatgaaataatgtcttttgcaacaacttggatggaggtgtaggccattattctaagagaagtaactgaggaatggaaaaccaaataccacatattctcacttataagtgggagctaagctacgagtacacaagggcacacagagtgatataatggactatggggactcagaaggggtaggaccagtggagaggcaaggaataacaacctccatattgggtacaatgtacactacttgggtgactagtgcactaaaatctcagacttcacctctatacaattcatccatgtaaccacttgtactccaaaagttgttgaaatgaaaaaaaaacttagagccacatattagttttgaaatttttttggagaaatttaattgtactctgctgtttgataaaaagtgctcaccagcaatcttatgttctggctcctttgcctccaacttctttcccttcttcggaaaaaaaaaaatgcaataaaataaaggataaagagtgcaaaagattttttaataagaactctcagtaaaagcaattgcatgaaaatggaaattactggcagtaagtggtctccaaacatctgctttgaaagatattttttataatgattcaaatgctctttttatacatgatctcccttatcatttaagctaatttttttaacttttaggagttgtatttttaaaaactgtgggcttcctatttttctttattcctcaacaaatgtttgtatattgtaagttgtgctctcatacatacttgttaaaaagcttaattatgtcactacataatagtactataaaagcaacacagtgtgaaaaacagcactagagtactagttagagcactagttagaacagcactagttctgattttataattaaatacctgttggatctttagcaaactcatataacctacttgggtctcagtctccttttcaataaaataaatgagctgaattaaataatctttacctccctaacaccttaaaagtgctaccattttgatatactacttaaaaaatatatttcatttttagttatactccatacacttgcctgtatgttcaaaatcattacttccagttcctcagaaatctcaaaaaatactgctgaaggaaatggaattaatttttactttcctattatgtatttctcttgggagtaaggaggacagaatgcaataaaatacaactatttgtgcagttgtgcgatgtcttagcttgtactgagggcaatgctgtatgcacccttttgatcaatgtaaagaaggtctagcatagataaacttccctacatggaaaccaaaacagttgggttgactttttctttctccttgccacctaaaactgtgggacatactagagatgaagaagtaagggtaaattaaacttttgtaagcatacaggaaagcaagcagcagcatgtttatttttctttaccctgttgaatgtcatgggctagaaagacactgaagttgtgaaggaagggaggcaacatgtttaaaaactcaataccaagttttataatgcaatggcctgtttagaatatttaaagatatggacatgagatgtactgagcacatgaaaataagtagaccatcaaaagagcagaaattatgaggaatttctaaaagacagatcatgtgtaactccagcactttgggaggctgaggcagaaggatcacttgagcctagaaggtcaagaccagtctaggcaatatatcaagatcccatctctacaaaagttataaaaagtagccacaatggtggcacattcttgtagtcccagttacttgagaggctaaagcaggaggatcattgtgcccaagagtttcatgctgcagtgagctacaattgtgccactgcacaccagcctgagcaacagaggaagaccctgtctataaaaaagaaaagaaatctagtaggatcaactggaaggtaaaatcccagacacatggaagataagtactcttccgggggaaaatgcgggagcttcagcctaaaggcaacagatggaaacggtgggtgaagacaacagtcacctaaatcaatcttttttttttttttttttttttttttttgagacggagtcttgctctttcaccaggccggagtgcagtggcactatctcggctcactgcaagctccgcctcctgggttcaggccattctcctgcctcagcctcctgagtagctgggactacaggcgcccgccaccgcgcccagctaatttgttgtatttttagtagagatggggtttcaccgtgttagccaggatggtctcgatctcctgacctcgtgatccacccgcctcggcctcccaaagtgttgggattacaggcgtgagccaccgcgcccggccaacaatcttaaggctgatttcctctctccccttcccttacttctgctgggctgcaagcaagattgcccacccttggctaaaggcatatgtactcttggattagaagaagggcagattcctagctagctactgatgaccaaaaagaataggaagcactgctggtagaagaccattactgacaaatctttcctggcggtacattcaaaccttgccccacaagggcattctgacagtatttaacaaaatttgtattgcaaataactccttttgacttagtgacttcacttctaggtatgtatcctaatagaaatgctcacacatattcattcagaaagatgaatctgacaagattgcagcacctctaaataaagaaaaattagaagccagctaaatgtccaccagtagaaaagctaaaataaactatatattttcatactattaaatagtatatgcctgttaaaaaataatgaggtagatatacataaaatagcattgaatataagaaaaaagttagtagctaatatactatacacagcatagccacatttatatttttaaaatagtgtgtttataaatgcaaaagaggaaaccagaagactatacatcaaactatttacctcctcaccactaggagactttctgggtagggataagtactaaagagaattttcacataataattgaatattttacaatgagaatgcatttctatataccccttatacttgaaaaagaaaaaaaaatcttgccaatttgaatcgtgaactgagaagaatgttccccacctagataagaaaattttatacaatttatctaacaaaaattttaaaataatatccacagcactctattttttattttatgttattattattatactttaagttttagggtacatgtgcacaatgtgcaggttagttacatatgtatacatgtgccatgctggtgtgccacagcactctattaactttagtatgttatagataactgaactaccctctaccacaacatacacataccaaaaaggtacaaactatatgaacagattacattattgttttcatttcgtaaacatattcaagtaaaatgtttttaaaatctatttctttttaaaatttaaatgtcattcatgcaaatacttgttttgtgacaactatgaactaactgcattctcatggtttcctagcacaataacaagaaatatacatgtttgaaaccctgactgttgctcaaacaatttgaattcagaatatgaaaatgcagtcattcactgcctttcctctgtataacaatgccaaaccctacctccctatcaaaaaaaaaaaaaaaattgaaacccaggctgggcaatggagtgagagactctgtctcaaaataaaaataaaaataaaaataaaatccccacaaacacaaacactattcccttttcactcatacaagggcttatgtgtttcccttctctaagttctgctttctcctgtcagaattctattctctcccttgtcactatatgaacaggaaaaacatatcaaacctaaagttatccaaagagaagaaaaatttctaccataatcttgaacaacaaatgtgtttaaatattgtttagtagaattttatactaatgtttatacatgtttataaactacacatatttatacaactaatgcgtatataaaaataaattttaattaaaactagataaaggaattaaaaatgtcagatccacaaaaaaagcatgtgatgtaaagcatatctttactcaattttgccactccacattgtatatatatttcaaaacattatattgtacataaatatgtacaacttttgtcaattaaaagtaattaaggtttttaaaatgtcaaacacattttttaacttacaagtttttagataacaaagaatacaataataattcaaacagatgatcctgaagtgattttcagaaagaaacactcattttatattggattgtttggctttttctatctatttataagagctctttgtagtcaaggaaaataactagaaaataggtttttggaagacacaaattgaaaaatgtatgttaatactttagaacaattaccaggagtaggaaatagtgggtgagaagtgctattactttagaacaattaccaggagtaggaaatagtgggtgagaagtgctatgtcaagtatggaatgtgtcgaaatctccagaagaggttttctaactataaaggccacttgatcccccacaatcaccttttgaaatctactacaagcaaatttaccaagagatatacatcatacaagtgaccagagtggaggcagtgtggatgccaactactgcttttagactacaggtgactgataaaataaagccgtatcttcaaagctttttcaaggagcaggcagaattatattttatctcaaatgagcaaaaagtaacatttttagaatagcagaaaatctccaagttatctaaaattatttgtaaaatattatatgcagctatgctcaatatcttaatctaacttgaaaacctgctccactgttcacaaacaatcttgggtttcacagaaagagatattataatttaacacagtgcctctcaatcttgcatgagcattagatttacctgggaagctttataaaaatattcatgcccaatcagcatctcttgtggtggaatcctggtaccgagattatatatatatatatatataattattattattttttttttgagacagtttcgctctttgttgcccaggctggagtgcagtggcgcaagctcagctcactgcaacctccacctcccgggttagagtgattctcctgtctcagcctgccgagtagctgggattacaggcacccaccaccacacccggctaatttttgtatttttagtagagacagggtttcgccatgttggccaggctggtcttgaactcctgacctcagccccccaaagtgctgagattacaggtgtgagccacagtccttggccggatatattttttttttttggaagctttccatgggattctaatgtctagccaggatgaaaaaacaattggattaatcaaacgaactggcctggatgctatatattcgtctttgatttttctatgctactgagcagctgtggaaacttgggtatttaacacaatattctgcatcttaattctctcactctgtagtatgaactgacctggcttaacatgatgcccagggatccttttggctttaaagttgtttgattagacccttcaaaactggcacctacatttaacatctaaaaagtgcttcaaataaaagttaaacctcataacatatatactaaaattttacagttaaggttttccacatttgcaaatcccatgtgcagaactgtatttatcaaaataagttttaatagcttgttattaagatgttgttactatgtgtttatcaatacaacattaattcctatgaaatcctatccttcactgaaaaatatgaagtcatcttcatactctaggggtacattttcagtatcacataccattaagagttattctttgtggtaacatatatcaagaaaaaaacaaaaaagaagagactgtagtttttatgtaaagggttttcatcaaaaccaataactaatttatagaaaaaaatggcactagactttagaaattaaatacatatgtaaagaagtattcatttaaaaagccatttttaacaaattaagatttcactgccacatattagataagatttaaattgcttctgtttaaacacttggaaatgggattaccattagaagagcaagaaaaccttaattccgtatcaaaaactttaattaaagctatataacttgtgattaattacttatatttgattcaaattgaaagacaatacattcttttttaaaagataatattctttttttaaaacagtaactcacttcttctaaaatcatacatacatcaagatggcaacacttatgttaatgtaaaataatcacctttcatttatcagaacatattggcaagggcaaatttttcagtcatatagttttgtaaaacaaaatgtaagtttatgctcaacatctcatattagccttaggaaaacaaatctgaaaaaaaactaaagcacattttaaagctacatacaagtcattttgggctgctcagtattcctggtcctatttcaacaaaacacaaaatgagagcctgactgtgtgctgaaaattaataagtatgcaaataataaaacttcaatataatattctaaggtactcctgactgtgtgctgaaaattaataagtatgcaaataacaaaacttcaatataatattctaaggtactttgacaaaaaaattctacaataaatgacatataacaaggcttaacttagttctatttttatggtataaatgttaaatcattattagtataaacacaagggtagttaatcttgaaaatattttctatagaacatcacttgaattttgaattattttcaaacatgactttaaaattaaggtcaaaattagcaatctaaaatactgtaattaaaagaaagcaaattcccaaaactaaatagaaagtatattcagccctcataagacatatgaaatatttacataataatatgtaagatatatttcttgttgcaacaaattatgcaaggttggaattagtcttgatgcaaaatgatattaccaattcttttcaaatattacagttcttacattccttttacatttccaaatcataagactacttaatagatgtaaaaatataaagtactggaatgtcttttttgccctaatatttaggaagaaaagagaattctaaggaataaaacattcagttaaaaatatgtttccccttctactttgaccctctttgaagtcaacttttcaaggtccattatcagatggaatgcagtagtaaagattttatgacactatactaaatttttattatttcattgagaaaaattgtaataataaaaaggattaagatctatttcctttttcgccatgttaagcttttaagctttttttgctttcatcaattccaatataccataaatcaaaagtattcttcttttaatcccaacagttgacaaaataatgcattttacacttgaatatgctcaaggaaaaaaattaacattctttatcatttcccaacagagacagttaatactctaaggccacattaatagaatctttctgccattgtagaaagtttgatagcactcctatttcaatgtctgaatttttctcctttttttgacaaagacaaatgattgccatcaatcaagatccaatcgggtatagagagagtcaggcaaatgcatcactctttactggttttcttgttatttgagcaggctttgctccatattattttatagaatgatcaaaaaacagccataagatagatcattcacacccactgtaaaattaactttcacgaataatgagttttaaacctcagataatgtatatgttataccaacgatattactgagttcattcctggctagagattatgtaaatgataccatatgacctttatcattacaacaggacatgcaaaacacatattatttcatacatcattttaaagcaagtcagtttctaaaggaaaaatcatcatttataatctgcatggtgaagtgttaaagttttgaaagaaagaagtatctctgaaccatgagtccttcttttaacctgttacttccattgaacataaggcaataaaacctactagttcaaaaagatgtacttgatttctgtatttctttgttgagctactgttaatgtcatttcaaaaactcatatcatgttggctaatcaacactaagttttaaatggataacaagtattaatatacacttctaagtcattcctctcaaaatttttgctgttgtttttgagaaagggtctctgtcacccaagcttgactgtagtggcttgatgatagctcagtgtagcctcaaactcttgggctcaaatgatcctcctgcctcatcccccaggcaactgggactacagctcaatgtcaccacagctgttttgtttttgtttttgttcttttgtagagaccagatctcactatattgcccaggctggtctcaaacttctggtctcaagcaatcctcctgcctcagcctcactacgtgctgagattacagttgtggtccactgcatccagcctcaaaatgtcaatgtaatgggttaaggaagtaaaggaaaacattccaatactgtttctttagaactatattctgccaatcttaaaatactaaaaatgtaagtataaactacaacggcccaccaattataaaatagctcctttttttaaaggtataggccaggaacagtggctcatgcctgtaatcccagcactctgggaggccaaagcaggtggatcacttgaggtcaggagttcgagaccagcctggccaacatggtgaaaccccacctctactaaaaatacaaaaattagcagggcatggtggcacatgcctgtagtcccagctacttgggaggctgaggcaggaagatcacttgaacccaggaggcgaaggttgcagtgagccaaggtcacactactgtactacagcctgggtggtgacagagcaagaccctgtgtaaacaaaataaaacaataaaaaggtatataaagaaatacatattgcaagccaggcatggtggctcacgcctgtaatcccagcactttgggaggccgagctgcatggattgcctgaagtcaggagttccagaccagcctggccaacatgatgaaactccatctctactaaaaatacaaaaaattagctacgcatggtggtgggcacctgtaatcccagctacttgtgaggctgaggcaagagaatcacttgaaccctggaggcggaggttgcagtagccaaggccacgacattgcactccagccagggcaacaagagcaaaactcagtatcaaaaaacaacaacaacaacaaaaacatattgcaaacccagctcccttctgttgtaattccacccccatcatgttgacacagttatccacagaatcacccaagcacaaagcctgtatatcatctttgaaccctccctctccttaagcttcttacaatgaactttcaattgttttttcctaaataattttcaatccatgcccactaccacagttctgccatatctcatgcctagtctactgttattataacacctatgatttcactattggcagtgtttttcttcttcaaatctataatcaaaaagaactaccagaatgatctatcctaaaaagatgtgttgacatcaatagtttactccacaaatttcaatagcactacatcccttacagcagcgatgcccaaaggggatacataacataattcatctggatgttggaagataattgcagagaaaaaagtcagaaattgagctttattaatatttaatatatagtttaattctggcatccttattcagtctgaatatcagtaatcatgtcatatgtgatatgcaattttctcatattaacacatactgtagtttatgtctacttaaacaggtttacagattacactgttttaaacaaatacagtatttagaatactttgcaataagataaaaagtgaccagaaattacctaataatggttgaatagtatgataatactcaattatcttaaaaagccaattattccaaatttgctaaacttttctgtggcagtgcactgcaacaagctctgaaacagctatttgaaaataaacacataaaatatatacctttaacataaaggtagcattttaactctaaggtaactaccttagaaaaacatactatggaaagagatgtttagaaatatttccatcattatgtgatttttgttgcctaaaactatcttaaccacctataaaaactcttaaatttgtattttaattaaaacaaattagaaacagtgtcataacctagtgtgtcaatgggttttgtacaaacataatgtctgtaaaaacattaaaatattaatacaaatatttgaagagaaccaagagttttgtaaagttagatagtccttaaaatattttctttggctttattttatcctttaatttctcctagaaatagtggcaatattcaacacttgctttaaagatttcagagtttagactattcttgatctttaaaaaaaaaaaagtaaatgcagagaggataatattatctatcttataaggtaatttaacaagatatatggacttagtaaagggatctctaactagtaacattaagttgctgctgctactactaccattcctaacatttttattagtatgtagtacaccaaaaaagggacttgtttctcggaatgagagtataaaacattaggagtaatttatgagaaaattggagtggaaggcatccaatttaggaacatgttaagttatataggaaaaattgatttatcattttgaagcaaaccacaagaccctctgcatgaatggcatatatgaaaatgttttaagatgagaataaattgtcttaaatttcgatatgtattacataatcaccttccaaaaatgtaccagcaatatactcttccatatgagaatgtgtatatcccaaatgtcattaacactgagttaatactggccttattaatctttaccaaacttacaggtgagggatatgaaagagaggagactgttgaatatgaatccaaggttttaagttagattccaatactgatgccattaataaaaacagaaaacaccggaaggaggagagacttgcaaacagagatgaatttagttgggacatgttgagtttgaggggccagaagtacatccacatggaaaaatcaaaaaggttctgaaaacagagatgtggaactaagaagagaggtaaagatcagagtgttgatttgagattcctgtatagaagtgatggttgggctgggcgtggtggctcaagcctataatcccagcactttgggaggccaaggcgggtagatcatttgaggtcgggagtgtgaaaccagcctggccaacatgttgaaaccccttctctactaaaaatacaaaaattagccaggcatggtggcaggcacctgtaatcccagctacttgggaggctgaggcaggagaattgcttgagcccaggaggcagaggttgcagtgagcagagatcatgccattgcactccagcctgggagacagagtgagactctgtctcaaggaaaaaaaaaaaaaaaagtgatggctgaggtgctagcagagattaggatcacaaaagaactaatttagaaaaagaaaaataccagcaacagaatttttctgggacaactctaaatagcagaattaggcaaaagcaagctccaaggacacaatgctcatcttgctaatccctgttacagtgatgcctggcaaagagccttgctcagagtaggtattcaataaaaacttgttgcatgcactatttaataattaataagagacagagtcatcagaacaaaagagaactagaagcaaacaagtcaaataagatttttttaaaaattagacaccattaggcttggtgctcccaaaaacattattcaaccacaatgaactactttccatcccatgggcttatcctagctctcctcctatctctctctcatgtgtactctctcatgttgcccctgtcctgtggcatcttccccaccaaccatgtttcaccctatctgcctgctaccaattatcatccaacaactaagtctcagcttagatgtcagctcctacaggtaattttgatctcagcaatttatacttgctgcatcatagcagttattcaactactttatcattgcctgtttatatttttccccctccaagtctataagctctgtagtttttatacctaatcatcttagccactaagttagagtttctttctaggccattccttttctcaccctatattctctcatcctatgatctcatccaaacttttggctataattacccacatgtatgtgaactccaaaatttatatacccagcgaaaatctccttttgagttctagagccatatatctaaatgtttacttgctatatagtttagcagttaagaacatgaaatcaaacacagtatttttaaattctgggtttgccagttattagctatgttattagctgtgtgaacaagacatttaacatctctgtacttcaactgccttacctataaaatgagaataacaataaaaagagaacctaattcataaggttgttgggcagattatataaaacaatatttaaagtgcttacaatagtgctttgcatataagaaatacttcttgagtgctaaatattgtaataatgttaattcagtgaaggcagtgattttcatttcttttgttcactgtctaatccccaaatctttagacaatggctgacacactactgaatagttgttgaataaatgaatgaataaatccatctcaatttcaacacagtcaaaaccaaattaatgaccttccccacaattagtccccttcaatgtgaaaggcatcgtagttcatccagttgtgcaagtctacacaatctttgttctacacactgcagtcagggggttctcagagcataacactaatcatgttccccatcctttccatcataaaatctttatggctccttattcctctttagaaaagcacccaatatggccataaggcctcgtgtaatctggctactatcaatatctccacagtacacacatccactcactatccacgttccagctatataacctttcttctggtccttgtactcaggcttcttgtttaaatacctctgctggtcggatgcggtggctcacacctgtaatcccagcactttgggaggccgaggtgggtggatcacctgaggtcaggagttcgagactagcctggccaacatagtgaaaccccatctctactaaaaatacaaaaattagttgggcgtggtggcgggtgcctgtaattccagttactcggatggctgagccaggaaaatcacctgaaaccaggaggcagaggttgcagtgaaccaagatcgcaccattgcactccagcctgggtgacaagagcaaaactccatctctgaatggagttttcccgtcttcatctagctacctcctactaactcttcaaattccaattgaattgttacttcaaagataacttaccagagctctttaactagatatcaattgaaggcattcatcattcagttttgtcattcttcatagcattttcacaacagtaaatttgtatctgttttataatattaatagctgtctctccttctggataatgaaatctatgtaaactgggaacatgtccacttctgtttattatgggagctctgaggcatagcatagtgactggcacataacaggtgaatattcactgactattcaatcaataagataaaagccaattaaatttttttatcttattcaatgaacaagataaaattcaagtaaccataggatttaaggaagcagtatgaatagggatgaagaaggtaactataaattcaattcatgacgtccatttgaacagtaataagctatcccacacaatactattgtgaaggatctgacactacctgttcatatatttcttctttgcattcttttttcagattccagaatatagtctcacctgtttttctccctcattttcctttctgaatcttggcttctgttctgcagtggacaggcatttgcaaacatacccctaaaggtggaggaagctaactgaccaaacaaagaggctgataaatacagtttctcagaaagaaacatttaatagggacttaaaacagaagccgtagtcttaagcagtcataagactctagagggtggatccctgcaccactgccccctagacccagggcgtatataccatagagaaagaatgtgtaggacaattgaagttgacctctcagggaaaggcaagcatgctatgtgaatctgcctaagcgggggatttatgatcaaggttgtttggacctggggcaggatttatggtaacaatagataaaagtagaaatcttagaggcatttccagaacagaggttaatcagaagtcaacatggcagattagcatccgagacggagtttctttagcctccacagcttctctacttttcctttcaaattctgctcctagattctaccataaggctgtttttcttacaaaccaggaatatcagcatgactcctgcaactaaaaccatcacctatgtgacaatggtaccaaatctcaactctttactccagatttttctcataagactgcgttttcaaactgtttaataacatttccattttgcttacccaaatatatgttaatgtgtcccaatattaaaaacagtatcctatttctaacttgttccttcttctatatttccataccactatcattattctctccaccattttccctctctgcctctaacacataacacccccaaccatctctcttcttcctaccagggtttgtctttcatctccacaggttttaaggcttgttgtatatgaacttgttaaattcttatggagagggcaaaccttatttctttttttattttgaaaatgtttcaaatttgtagaaaagtggaaaatggtaacatgatgccccattgacaacagatactttctataaacaaggactttgttctacataataataatataactgaaagtcaggaaactaaaactgatacattattaccttccgattttaagcaccactcaaattttactaattaccccagtaatccttatagcaagatgacacagctgagaatcatgtctggcattgagttattatgtctctttattctctaacaatctggcagaatagttctatagtctttcctgaaattttaagacactgacatttagatgattacaggtcaattattttgtagaatgtccctcaatttgggtttaactcatatttcttctacatttcttctacatgattagactcagactaggcactctgggcatatcacagagtgatactatgatcttcttaatagatatagcctaaaaggaagcacatggtttcagtttctctaattactaatgatgtccattttgatcacttgatgacatggtacctaccaagcttttttttttttttttttttacgtgaattactctttctccctttgtaattaatgaatattttttgaggaggtactttggaactatgcaaattttctgatcttcatcaaactttccatttgttcatttatttatattagtatgatcttctattttattcaacggattataatttattgctatctattagataatattatctattttgacgtttgactgttcactgatttggccagtgggattcttttcaagctgattctttttccttcttacatgtctccatcattctttgagcacttctttacattctagcacaaaaaggtgctatgagctcatcttatagtttccctgccacagtcctggaagtagccattgctccacagagccctggtttcaatggagaagatcaaggctttaggtgcattcattgctaccaggatgtcactattcccaggccccctcagtggacaaagctaggaaatatatccagctgggcacgatggctcatgcccgtaatcccagtactttattgcccagctggagtgcagtgacacaatcacgattcactgcagcctcagcctcctaggctcaagcgatccttctgcctcagcctcccaagtaattggcaccacagacatgcactactacacctggctaatttttaaattttgtataaagatgaagtattacttttgttgctcaggctggtctcaaacttctgaattcaagcaatcctccacctctgcctcccaaaatgctgggattacaggcgtgaactatcacacctggcttaagtttattttttgatgccaataatatgtctagaagggactagactaaaacattaacagtggcttggaaaggatggtgtgattaaaggtaattttttgttcttcttttcatcttacgtgtatttatattttctacagtaaaaatatattattctcataattatataataaatacctgtaggaagcatatggatctctgacattagtaatgaagttgaattattccttctaaaaaaaaaatctaagctttccacatcgtgttacagtggtacattggcaagtatcagtttgccacaaaaaactggggtttattttgggattatctgttctgttccattgatctatacagctatcctatactaatagcatggtgtcttaattactgtatctttaagttttggaattaggtagtgtatatactgaattttgttgtgctttttcaacattgtttcggctgttgtgacagacagctccaacatagcccgtaaatgctccctgcctcctagtgttcatggtcttgacaatccctccttgagtaatttgcttctaaccaatgaaatatggcaacatcaaggggatgtcactccaaaaattaggttacaaatgactgtgatgtccattttgctagatgactcctctctcttgatggctttgatgaagcaagtaagccaccatactggagaagtccctgtggcaaagaactcagggccttagtccaagagccctcaaaggattaaattctgacaacttcataagtgaacttgaaagtggatacttcccagttgagccttcagatgagaacccagcctgcggacaccttgactaaagccatatcagagatggtgggccagaggaaacagctaaatagtgcctggattcttgacccattgcactatgaaataataagtgcatgacgtgttaagctgttaagctttagagtgatttgtaacaaagcaacagattactaatgcagctcttctgggacctttgtatttccatttatcttttgggttccgactaccaatttctattaaaaaaattctgaaacttacataggggattatattgaatctatagatcagtttggggcatactagcatcctacattatactgcataatattctatttgtttacaatttctttaattattttttttttttgcaacctctgcctcctgggttcaagcaattctcctgcctcagcctcccgaaaagctgggattacaggcaagcaccgctatgcctggctaatgttatctttagtagagacaggttttcaccatgttggccaggctggtcttgaactcctgacctcgtgatccacccgcctcagcctaccaaagcgctgggattacaggcgtaagccaccacgcccggccaacttctttaattattatcaatttctctttaatttctctcagtaaagctttatagttttcagtgtaccaacattatacttcctggtattttattctttttgttggcttaaagatttctcacctatatttatgagggacctcatttacttttaacaataaaatgctattttcaagaacacaaaactggggttcagagaatacttaagaacacataaggacatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacgatgagatcacacggacacaggaaggggaatatcacactctggggactgtggtggggtaggggaaggggggaggggggagggatagcattgggagataaacctaatgctagatgacgagttagtgggtgcagtgcaccagcatggcacatgtatacatatgtaactaacctgcacaatgtgcacatgtaccctaaaacttaaagtataataaaaaaaaaaaagaaaaaaaaaaacaaagaaaaaaaagaacacataagcaaaacgtgggaataatgagatctaaattaatctatctaaaaataatgcactttctaccccacccgtggtactcaacagattcagaactgttccctagagtgaataatagaaatctgcaaggaaagttttggttgtcacaaatgactgagtgctacaatgatttagtgggcagaaggagcaaaaaaaaaaaaaaaaaaaattctagacattccacaagaagaatagttcaataataataatggtcctagatcctacattactttagaatgttctactgtatatcagtgaaagtgacaaactagaagataatctgagcctatgccccaaatatatatatatatatatatatatatatatatatatatatatatatgtgtgtgtgtatatatatatatatgtgtgtgtgtgtgtatatatatatatatatatatatatatatatatatatatatatatatatatatttagatggagtttcgctcttgctgcccaggctggagtgtaatggtatgatctctgctcactgcaacctccccctcccgggttcaagcgattcttttgcctcagcctcccaagtagctgggattacaggtgcctgccaccatgcccaactaattttttgtatttttagtagagatgggatttcactatgttagccaggctggtcttgaactcctgacctaggcaatcgacccgccttggcctcccaaaatgctgggaatacaggcatgagccaccacgcccggccccaatttatttttaatttcaaaaaatgcaatcattgtgtaaagtaaggtaaaaatgaatgttgtctgcttagtactacaccagtatctattcaccacttagaaaaatcacattatagacaatcacacatcccttgtagcaggacaaatcatacatcatacctctatcagtctgatttgtacctgtcacattcacagtgacctatatataaatacaagcatccaattatgtcttttagcatagttatgttcgtacttatggaacaatgaaatgcatactacatatatttttaaatattttatttctcttgttatggtatagagcactgttgattaatattatttatctagaaaaggtctatttactattcaaaaataaaactcatagataaggaataattgcaaactacctgtgatataaagagcatgttaaatttcagagggtgaagaactatagcattacattatgctacctcctaaatatatctcctgctcaccataatttctggcactgccatagttaatactccttttatctctggtctagtgtcttttgacagcctcctatctagtctccatcacttgaacttcccatccaatataatttacttattgtcgaaatgttactgcttttcctttaaaaaaaattattatccaggatataaaataggatcaagatacttaagttcctactatcctacagaaaaattccaaattctccaccatggcatttaggatcgcttatgacctgcttttatctgtttctagatttgtctacaaccactctctatcacatattatatgtctaaaccatgctttctggactttctcaaaattttcatattttctcatggcaatgccttgcatcacctactccctattctaccatgacttcccatcatcattcctgtccccatcttttgtccgtctggaattcacatactgtgtgacatcctactctagaccctcctcaaatctatgtcctatttcacagagatccaaaagcttacattcagactttttaccatacacatttcgcagtaatataattaattatatgcttaacattcccatgaatcctcaatatcctcaaaatgtaataagaaatttttatattccctaacaatttttatcattggtttttcatatttgttgattcaatgaatatttaactaattttccactctcttcatattctaactttcttttctgaaattctagacattaattacatatatctaaatacataatggcatcaaattctaatttactccacaaaaacacaggaatcacaactcttctaaatatgtcatgatggaaataatgtagtcagtcttgacattcatttctttattaagcagaatctcagcatctttcacacagttaaaataggagaataaatttgcaaataaggtttcatttgcctattttcttttttttctttgcagcaaaaagattaaaaacattttagcccttcaatgtttaagttcaagtggaactatctaaacatcacatcaatcaatacctttatatgttcttctttatatgcacaagggcaagaattagtttaggggtataggagttggttacagtcattatgctctaatgtggcaaacattagtgtcaatttaagtaaactctaaagggttatgaggtcaaaatgcaagactgcataatttatcagatcaagcaaatcactttgaaagtacagaaataagtgaagcatgaggctattactgcctctcatgaataaaggttaataccaatgtttatttattacacactggatggtatttgctatctaaactttatttattaaaataagtattttgctacactgtcatattttaaactactgagtcaaatttaatttacagcactgtcttatactaatacaattaatacagtattctaagttttaaacaaaaaattgaaattgctttggacattttgattagtaaaatatgttacctgtaaaatatgaaatctcacttttgcatcaagacacaccaatgagcaattcaaaagcacaagaatacattcatatgtaaattctgcatgtatttcaaagttgtggtttattatttgttcttgttgtttggtatttctacatagtattttcttatgcacaaaaaatagaaagttgcgggagaatggtataacatactaggccatcaaaaaaagaaagataaagataagcttttaaaattagttgttactctttcttttatgaaagaaaagaatggtattttggttttccataaattaatactaaaatattcatattccattttctaaggtaaacagtaacatgtgaaatgatgtaatagacataatagctgtgaagagtacaggaaaatatattaataggaaagaaatgttacttttccagaacaaatcttaaatgaaatggtgtaattagatgaagggttatgtgaaacatggcaatatacacaagcaaaatcacaatgcagatcaattctgttacttttacattttactctgcatataatatattgaaaaatattatttaatctaaattcaataagatatcaagatttcctcaaaatcaatgttttgtagtcaaatcaactcaaataaaacttcacagttataagacagataattaaactgtattgaagtagatgttttatatagcaaatgttgtttattatggttacaaacacacacataaggaggcaaaagaattactctcaaagaaaaaatgttcaaattctaaagcattggaatagaaaaatgtaatgttatattcgcatcattattgaaatgtagctttaacatgacacttaaaaaaattaatattctagtgatttgtgcaggacctgtatctttcatttaacccacataaaaattttgtacatagactctcttgaagggaaatttaaagttccccctattttatccatttcaaccaacataaagatttcaaataacaacttcaacgcacaagtagtccaattccaggctgggcatatctaaatgaagaaaaaaattgatctgtcatgaataaccattccattttaggaaaatgcagaccattagagttcatttatttattccacaaatatgtactgaatatctaccatatgccaagcactaaggagacaccagtaaacagaagaaattagcaatcaaagaaaaaattaatttataataaaatgtcataaaaagtattatgaaaaaataactttaccatgttaatgcaggctaagagatagtgatggaggcacatagatgataagaaaaggctgacataggaaagtaggtggaagaagaatgggcaaagatgacatgtgagtaaataacctgtatgaagaggatatgtaagctatattgacatttggacaaaaatgctgcatgcatgaagaacatgtgcagaagttctaatacaggagcatggtatgtttactcaagtaatagcaagcagtccagtgttgtcagagcaaaatgatctagtgctcatctaagatcagatcatccagggctttgtacatttcaaaaagatagtttagctgtaatataggataaagagataaaagtggcattaggaaagtaagaatcagcaaactgttgctgcatagcctatgagctaagaatggattgtaaattcataaataattggaaaaaaagatatttcatgatgtgaaaattatataaaattcatatctaagcttccatgaataaatttttattggaacagagccatactcatttgtctaggtactatctgctggttttgcactacaaaagcagagtacgtggtgctctcatcacttagcactgatgctcagcacatttcagatcatactaatgtagctatagatgaccgtgtttcaaatgtcacacatatagccataccacattttatttttattttcttattaccagtgtgtacccatggtattaaaacataaaaaagagaaacgtagactttaaataacatgtttttaaaggcatagtggagtctgaattattttgttttagaattaaatgttaaagcatttttgtttagtatgcagtaacacgatagctagtgattttaaaatataatacacatcaatattaccaaacaaagcactcattataatattgctaatgcataggaatgcagcagtgaaaaacttagaaaatttaaaacaaattatctcatcaaaacagaatctcttcagaaaaattaaaaatgaaaataaggctgcaattaaagcaagcttctgagtgattcttttgttagtcaagcaaaaaaagtcatttacagatggtaagttaattaaactgagtttcatttgacagccaaagaactgtatccagagaaaacaaaattgtttaagaatattatagcctttcagtgaaaacagttgcttaaggagttgaggacattgaagcaaaatcaatagacaattaaaaataaataaataaagcaaatgattccaaatggttttccttggctcttgatgagatcacagatgttacctacataatgttccattgttgtttattcaaggagtaaatgactattttgaagtgattgaaaaacgagcctctgaataatctgcatggaataactatacggatgattttttcaaagttgagaaaacaaaaatttagtaccatctgaagtggaatctgctaggatgtcttataacaaatggtgttaaaagtatgtatgggggagaaaattgaacaacttacaaagtttgtgaaaatatacggtatttaaagcataagcttagtcactgtatcactcagtactctgtattactcaggtaccctgcaaaaaatattggaatttatcatgttttatcgaaccaggagtgtcatggtgaacttcattcacttttttttcatggtcttaaccaatgtcatttccatgcatttttctcagaaatacaagtggaatatactaacttgctcttccacacagcaattcaaaaaaaagtttttttttcttgagatcctgtctcaagaaaaaaaaaaatcttaacagtggtaaggttttattatgattttccgctaagggcatagactgatttttttttttttctgagaaaaaaataactactattatcacacactaaatggttttagaaattagcttttactgaagacataataatgtttcttaataaattccatctaaattacaaggcaaaacagcccatatatgggaaatttacactgcagtaaagtcatttagatgacaacactgtttgaatcacaagtaatatgaagttactttatatacttttctgtgctattaaaagttaaaaagaagtgagattgtcattgtcatacaaatttgcagctaatacattttccagctcaaacttcaatcccagaagtatttttcagatactgatgcaagggcaaaggaaattcccatatttcaaaatccatttaaatgtggtactgcggagcttctactcaaatatcaattgcaactaattaacctataatgtaacggtatgctaaaaggcaaaatcaagagaaaaatctaacaattatataaatgccttccaagagataaacatgctcaattaacatcccatgtccatagatggacattaataattgacaatatttatctgtgtgaaaacatattttaaaagatgaaatccataaaatattatagatcatattaacaggtgaatatttgccatctattttgatgacaggcaacagtaactatgaaccccaattaagtaaaatgttacccgcccccctcccaagaaaaagaaattcttctcattagaaaacccattacagaaaattgtactcaatagatatattttaaattttatcaataaaaatatattaaaatttgctttctgtcttgttacacaggtatttatataatatcctttatcttgccttttgacccaaaaatctaaaatatttactatctggcccattatagaaaaagttttacaatctctgatataagaaaataatgatttttctctagaccaggcaaagcagatgatgggaaatgtccagattctggctatatttttatggtagaaccaataaaatttcctgacatattgtggggtatataagaaagagtgaagacaaagatgacttcagggttttagcatgagcaacgagaaggataaataacagttattgccatgaactgaaactggaaaggctatggatgaataggctggagagtggttcagtattgacatgttaagtttaataaatctaccaaacagaagtggtttaggccaattagatacagaaatctggaattcaggagaggttatcttagcataagatacaaatttgggagtcactggccaataggcggtttttgaaacgttggaaatgaatgagatcacaagggatacttggtaaataaataaatgtcctgagaactgagtatcagggcactaaaacattcaccatttgggaaggtaaggttgatcaggcgaagtcaacagggtgtggaacaatgtctaatcaggtaggacattatgctatcttgaagcaagataaccaaagtgttagcagaaggagaaaatgatcaactgtgtcatatgtcaatagataagcatactcactataggttgcacataccaaattcaaaaatctggaatttgaaatgctaaaaaatccaaaatttttgagcacagacataacatgcaaaagaaatgctcattggagcatttcggacttttggattaggaatgtttgagcggtaagtataatacaaatattccaaaatatgaaaaaaatatgaaatctgaaacacttctggttccaagcatttcagaaaagagatattcagtgtgtatgtgtttatataaagcatagacagtagtgattaacagaacgaagaacatggtcctgaagcaccagaaatgtttctcctttaatctactaatcagtaaaactaatattttagtaaaaatcaggattttagtagtggtgctcctgttcatatttttccatcacatataataaggacagttctggaaaccttgtcaaatgccttgcagaatatgtcaatatgtgtatatcaagaattaaatgttcatattttttaacttagtcattctatttctgggactatagcctgaaaaaaaaataagctaaagtaggaaaatgctttatgactaaagataaaaacctttttccagattatatctgtaaaaagtaaaatgattactttttctttttttttttttttttttttttgagacagggtctcatgctgttgcctagactagagtgtgcaaggcataattattgctcactgtaacctcaacctcctgggctcaaataatcctcctacctcagcctctgtagtagcagggaccacaggtgcataccaacacacctagtagcagggaccacaggtgcataccaacatacccagctaatttttttaaattatgtgttgtagagacagggtctccctatgttgcccaggctggtcttgaactcctgggctcaagcaattttcccacctccttaaatgctgggattacaggcatgagccaccacactcagctcttactttatgctttacactgaacaactcaaagttccttaaagatgtgatgctgaattgttttcctggcaccacactctcagcctaactaaaaagttagtcattactttcaaagacccctccataatcgagatatttatctacatctattattgtggtttatcatattatatcagacatattattaatacgtctttctcatctattgtaagtatccttcctgagagcagggccctgtgcctagcagagtgtgaggttcaataaatgtttactatattcaattatccagtgagtaacttgtaattcaatgttctgagaatagcaggtatttttgctttgtttaggacataaggcaaatgtagagaagtaatagaaaataaagagatacccaagcagcatcaacatttatgagctaggagaaagaaggaggcagtgaggacatcagaagagaaaggaacacaagtagcaaaaaaaaaaaaaaaaaaactagaaaagagcgagatgtgccagaaaccagtggaacaaaataacttgacaaggaagtggtctacacaaacaaatatcataaataaacaaaaattgtaatacagtggttttgacaaagaagagctcacaagacctctgccagagcagtttctggcagacagcaagaggctgacggatgaacaggttgaggccgcagaaagttcaagatctaagaaacctgactgaaggagaaaaaaagagagactatgcagcagactactgttatttagtggttgtacaggaactctacttaaatatcacaggatatttaactacctggattccaacaataaaagtctgcaagctttccagtcattgtgacaatcaaaaacatgcccccccaccccacatttctaaattaccccagaaaggatagagtactgcctctgattgagaacccttaaatgccaactcatgctaaaacaggagtctctttcccatgagattgtttttatggtttaagatgaagcttattagcattttagaaaacgttggcaatacagttacaggggacagtaagtttggggacaatgccaagtagttgagggagctgaaacagagccacgaggcctctattttttcagagatgagttctgctgagagtatccatcacactatagtttcaagtacaacttcctactttcctccacataatcaaatttcttaaaagagatcttctctcttactcctctttagtaatcactcactcattccctaaacctttataatctggcccccactttctccatgctaccaaaacagttctatgataaccagtaccttcttggttccaaatctaaggcccttttcttagacaattttgcttctgatcaccttatagcattggtcactgctccttcttaagaccacttcttctcccaccactgtcctagtttgggcacttgttatctcttaaactataaaatacctctggcctctgccttcccttcagtttctcctaacatttacccattttacaaatgacaagatcttcctgaaacatagttcttaaactgttcctggctcagtaattttaaaatggttgagagaacagaccaaatatcttggccccaatatttaagatccttgacaatcaggtccctgcctatccttctcattttatttctcaccaatctggtttacataccactcgttctagatgagcaattagaactgctgagtgttctctgtacatgctcttctatctgctttctacgctttcacttatcttccttcaacctgaagtaacgcttttgcatcgcatggtcatatatccagttcttcttcacactttgatctataactcctatgtcaaggattccctgacctcatagctacaagcaatagccctacccttcctaaacttccaaagtactttatttgtaccttttttatgtcacctttaaacctgcattatacatttcatataaacatcctgcctctccaataaagttcactaggaactattacttactaagcattaatatcaggtacttacatatatcacactgtatcctctcaatataattgagttaccccaatttaataaatataaaaaacagaggaataggaaatctgtataaactagcaaatactcaatacatattttttaatgaataaattattattccaagatgaagtatcattcaaaatgtttacaaatatgcgggtgtgtttcactttaagtgaaccaaaggtagagctccaagaataaaaaatatttaagaaaagagccaataatagataagaggttgcgttcaaatctaatattaacagttactacttaacttgagcatatatgatttttcaggcacacactttctatatgctaatttattttattctcataacaatcctttagaatagatattgttttcactggccaatacttggtgaggttaagtgactcgttcaaagttgcaaagccaggatacacataaagccagcctttctggctttaaattctttgctctagagtagttagtgagaaggcccaaacagcttaagcttgaaagaaatacaaatttgggcaagtgcttctttttgctttattaatattaacatgtggacatctacaaaacgtaataaggcatttaaaaactgagaaaattttctacttttcccaatttctataaaatgtaatatgttatttaataaccaagaaaacattctattttttcctaatatctctaagcagacattaaaacttgttatttggaatgaatatttgtttccaaatgaacaatgaaagtagtatataataagtaacaaagcaccaaatagagtaaggaatctcaaaactcaaaactgaaaagcattgtaaacatcttcttattttaaaaaacactcacagagtcagcaaaaggatacaacaaaatgtataaattgtaccaacccactcatgctaggactttcctataaaagtttctggtcagatagtaaactgttaatatttgaattgaagtttatgttaaaatgctataaaaaataaaatttatgttggtaaaactgaaattaactgccatgaatgtcagtactacttaccatgatgttttacttcattagacaaaaagaccaaaaaaaaaagtctacttctatttacaataaataaaactaatccatattataatccttccacatgaatcattagaacttggggagagaactaaagaggagaaaccatcatgtctattattactgtgactaaatgggattaactaatcctcatgaggtaaagttatgaattaagtggtgctcagaacactaagaaaatttgtggggagagaatgcaaatagctccctaattatctacagcctattaacaagcaaaccttattacttgcaattaaaatcctcttaaattttatggcaaaagttcattgaaacgttgaaaattatatgctaattattatactgtaaagcacatgtttagtgtatacttttactatgggctcaataaataataaaatatcaaattcaaggtgatacagtaactaaatattttactagatggaaaacaccttggtatgaagccagtatgggctcctgttacaatttcacagcactatagcaccagaatatccccaataacaactaagttctatgtgcacggtgacacggctatcctgttaaccactgaatggaaccccaacaccatcacagtacctggcatagataagtacttaagtattaattgaagaaataatgttgacggatgaaaatatatatttggtgataatatcatctactttcaggttctgaatctttaagcgctaccacagagttcattcattcattggtttctgtaccaattcccacacaataaatctataatatttatgaaattatttatgtctaaaagctcccatggcaacctagaccaagtttgtcttgttcctaactgtatcagagcacccagcacaaataaagccatcaataaatatttgtgaaataaatgaatgaataaatacaagaaaaaaaaaggatgttactacagtttgcaactgcctgggacacaatattcttcagtaggcaatgtattatgttctaagaacaataagcccatgctacaaatggtgtgagtcatgaaacagtgcccacagatgggtcttttaactgaggactcccccagctcccacctgattgatgattgattgattgatttagagacagggtttgctctgttgcccaagctagagtgcactggtgccttgatctcctgggctcaagtgattctcccacttcagcctccgaagtagctggaaccacaggtgcatactaccacactcagataatttttgtattttttgtagagatggggttttgccatgttgcccaagctggtcgcaaactcaagcaatccagctgactcggcctcccaaagtgctgagattacaggtgtgagccactacgcggggcaccaatatcattttcacacctatacaagttaggggaaaataccttaatacataaaggaaacaaccaatattcagtttccctcaatgtttctctctctccctctcctcttcccctttcccccacctcttaacagctagtttgttcaaatcaggatccaaggtccataaaatgtgcctgttgaggtatttcataagccttatcatatacattcctcttttatttttatatttttgacatctatttgttgcagaaactaagctgtttctgcatgcatccagcttttttgcattctgaatttttctaattatgctcttgttcttgtaacatgttccccctttccttttgtttcccataaactggttattagatttaaaacagcaatttctattagaaatacaatgcaaatcacatatacattttaaagttttctaacagtcacataaaaaaggaaagaaacagataaaattaattctaataatatatttttaacaatatattcaaaatatcatttcagcacacaatcaatataaaaataaaatatttagattctttcatcatttgaatattaatccaaatccagtgagcattttacaacttatggcacatctcagttgagactaaccacatttgaagtgctcaacagccacatgtggcaaccatactagactgcacagtaatcgagacttgatcaaattgaggttagacacctaacgcctgcttgtttcctttttggtgatgttaatattggtctgtgaatctaggtactgtcagctttgtctattcattaggaaaatccatatcagcttctttcctaatgattttagtagctattaatgattatgcccagatatcaatttttttttgctattctaattctattattccttctgcatttattagctgcaattcttcaattaaaaagaactggccaggcatggtggctcacagctgtaattccagcactttgggaggacaaggcaggaggatcgcttgaggccaggaattcaagaccagcctcggcaacatagcgagaacctgtctctacaaaaaataaactttctctcatcaatgtggttatataagttacagtacatatagaaaaatgagataaacatatgattctcaaaatattaggtttttgacattaaaacctgcctccccagaatactctgaaggtaatccataaagattttgtaatgagtatcattatgaacacatggatttaaacataatttgccatgctttaatctattatactttcattcttttacttttagactgtctcatcttctggatagtaaaagctacttcattttacctcctgcaaccctttttacctcaccccaggaccctctggcctctgacatagcaggttggtccaggctgaccttgcccaatcaagccaattattttcactggcaaatgatatttagagacaacaatctaggtgtgagagggcccgctgctaccagattgtttgtcatttctaggccattccagtaggcaaagcaagaaaaaatactgtttaactttaaaaaatgagttttacagatatttccaacagaaatttaagataaaaggggttttcgcttctcgatttttaatacatgttcccattttctcttgctctgaaaaatcttagtttccaataccattaacataattacttatttgctttacactatagggtcataactgtatttcagcatgtatcaggaattcattccgtattttttcataaatacattgaaagactgtcattttgggaaaattattagaattaagttcagagtaacaatagcaatactactactaagaataatcaataatactccttctctggagagaaagaaggccccactgggaatcttcagattactgagttctaaagttacctgaaataatttgcctctatgtagtatataatagcaaattaatttatttcctttggcttccaattcagccattgatttaaaaatttttaattctattttataattatatattaaaagtaaaatctagaaaacaaggtttattgagaaaagtctgttgtcattgttttttgttgttgagacagagtcttactctgtcacccagaatggagtgcagtggtgcaatcttggctcattgcaacctctgcctcccgggttcaagcaattctcctgcctcaacctcccaagtagctgggattacaagtgcctgccaccatgcctggctaatttttatatttttttagtagagatggggcttcaccacattggccaggcttgtctcgaactcatgacctcacgcgatccacccatcttggcctcccaaagtgctgggattgcaggcacgaggcactgtgcccagtcaagaagtctattttcaattcctatctctctaccttgtctcttctatcgccttaaagtcattttttttattatactttaagttttagggtacatgggcacaacgtgcaggtttgttacatatgtatacatgtgccatgttggtgtgctgcacctattaactcgtcatttaacattaggtatatctcctaatgctatccctaccccctccccctacccaacaacaggccccagtgcgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacattaactcatccttttttatggctgcatagtattccatggtgtaaatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccaatactgggatggctgagtcaaatggtatttctagtcctagatccctgaggaattgccacactgacttccacaatggttgagtcagttaaactagtaaagtcatttttattagttttaggttaaactttccattttaaaaatataagcaaatataattacatttgcccctccccattccttaaaggattatatattattacatatatccttttctaccttgttttgttcatttatcctggtgatcacttccaaagcagtgtatattcttcattgtgtaaatgtaaaacagattattcagcttccaacactggatggacatttttatcctttttagacttttgctattatagatagtgctgtgataaatagccttatcatttttgccaccaaatctttaagacagattcctagaactggggttgctgggtgaaggaataaataagtgcatatgtaattttggtagatactgctaaattgctttcactacaagcttgtgttttctccagcaatgtacacctttttagcaagagcaatccactcaatgggcattgactgaaaaactgacacttggcaaaccaaaagtttgctgtcaagatatacaaatggccagtgctgtttctgtcttttcacaccactgacaagagcaatgcttatcaatttatttcactcaggacagaaacaaatagcaatggaaatgaaaaataattatcatttaggattgtctaatgataaagttttcatatgattttaaaataccaaattctatttaataaaaatcatggtgacatggaacctcaagggtcttccaaatagctactttccaaaggttctatattactgtattgtgttggggggtatttatcgccaactgcccctcctaaaacatctttttgtattctctcccatcgcaaacctagtctaacttgtaggatcttcacatttgtggggaggaggttagagggtagggtagaagatgtgtgatcagattctgggttttggaagggttttttgcttctatttgttcacttctctattttcaaaacgtctgccatttgcactccataccactcatcctaattgtagctgccattgctgctaaaatccactacacttccaacttctatgtttgcttgtttttggtgttgctttcattttgttaggcttctcagcccccaagtgaaaggtctaattttcatatcaagagcatcagccaaacctttgattttaatccagtagcaaaatgatgaactgaatgtaatacccttctcaggaatgctcatttctggctgggtactcaggagttgcttttatattgttagagaaggcttattttgtttgtgttgttgtgggttttgttttctttcttttctttttctaaatccagaggttagataaaaccagtcttcaaagtttactactttgccatactaacacagttggcgtaaactgtctgatctctgcctgcacaacaaagctaccttttatcagactgtgaaaccacctttcatggctgccacagaactactcagaacaacacagtctacaaaaatattcctaagacatttactatgataaaattcccttgattgcagaagtagtcattcagacaactgtaagtattactaaataaatgtttattgggcactataatattatactaaaatgtaagacccatgaaggcaggaaattttgtctgttttattcactactagatattcagtgcttagaacaatgttgcaaacagtgaaactcaatacctattacaaatatttattgaatgaataaataaatgagcattattcataaggcaccatgaaagtattatgagtagaaacagtatctgccttaagaagctgctaatttgattagactaggttaaacatataaaaaggcaaatatgtaacatatataagccaaatgaatggagttgacatcaatgttgtaagagcccatagaatgggaatatcatcacccagtggaggaatctctactcacatttggcttgtcataaaaagtagtactcagcttagcacagaagggggaagtacaagtgtatgaactaatgtgagcaaatatacaaaatcaggaaatgatgaacagcaatccataagacagacttcccttacgaaggagacatgtttttgtttttctagttttgtttttaaagcaaagaacattttacgcttaaagtgtattttttaaaaaaacaaaatataatttttctttataattaataattatgctaaaatgcttctatatcatataagcaaacaaaagatgtttttagtaataacctctaggggttaccattttaatatcaacatgacttgtttcttacatgtgtaagcatttaacattgtgttcacaggtaaagaacaatatttattccatttattctgaagatttacacctcaaattatagggaaaaatgattaatttccatagaaacatgggttaaaaaacaaattttttatcctttcaaaatttctgagatgtggaagcatttaccattgtatttatatataaagttttaaaaaaatacaagaattcatagtacagtttccccaaaactaagattattaatattttaaaagggggttttaagattcttaaagatataatagagtagaacaaagtactttaatgtttcgtttcccaaaaatattaaaaaactgagattttttaacttaatagtaataacacatgtatgtttactatgtgcctgacactactcttaagtgtttaacatacatttttaacagtattaataatataagatttaacagtttgctttttttaagttattttcttaataattttaaggtgcttagttcttacatttaatgttttatgtgccattattttgcttttactgcaaaagaaagatctggctcccaaagataaaggagatttttggtaaatggtgaaggtaaagaaataaatgacccacttgcctagtgtgtaattacactgcctgagattgtaacaatctatcacatgaaggaggatgacaccacgctaaggggtgagtcaaaggagatagcctttgactaactacgggaccctgacgatcgatactccacagatattgtgctctcaaaaacaattgaattctaaaaaagtttgaaaatagattcccccccttcttttgatactgatcagagacctatcttgaccttattctggaagagtaatactttcttaaaaaggtatatgaaatacataaatcgtttctatctctggactgttctttcaaatggatatttaacacattcctattaaaataacagtctgcaagccaaaaaaaaaaaaaactgctgaaatctttccttattagataaatatgccttcctgattggctgttatcaagttatcataatacttagcacatgacaggtaagtactccaaaggctcaaaacttgaaaaacctatcagaaaataaaagtctccctctccctctccctctccctctccctctccctctccctctccctctccctctccctctccctctccctctccctctccctctccctctccctctccctctccctctccctctccctctgcctctccctctccctctccctctccctctccctctccctctccctctccctctccctctccctctccctctccctctccctctccctctccctctccctctccctctccctctccctctccctctccctctccctctccctctccccacggtctccctctcatgcggagccaaagctggactgtaccgctgccatctcggctcactgcatcctccctgcctgattctcctgcctcagtctgccgagcgccgccacgcctgactggttttggtggagacagggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacccacacctcccagccgcctgccttggcctcccaaagtgccgagattgcagcctctgcccggccgccaccccgtctgggaagggaggagtgtctctgcctggccgcccatcgtctgggatgtgaggagcccctctgcctggctgcccagtctggaaagtgaggagcgtctccgcccggccgccatcccatctaggaagtgaggagcacctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcatctccgcccagcagccaccccgtccgggagggaggtgggggggggtcagcccaccccggccagccgccccatccgggagggaggtggggggtcagcccccccgcccggccagccgtgccatccgggagggaggtgggggggtcagcccccacgcccggccagccgccccgtccgggaggtgaggggcgcctctgcccggccgcccctactgggaagtgaggagcccctcagcccggccagccaccccgtccgggagggaggtgggggggtcagcccccccacccggccagccgccccgtccgggagggaggtgggggggtcagccccccgcccggccagccgccccgtccgggagggaggtgggggggtcagccccccgcccggccagccgccccgtttgggaggtgaagggcgcctctgcccggccgcccctactgggaagtgaggagcccctctgccaggccagccgccccgtccgggagggaggtgggggggtcagccccccgcccggccagccgccctgtccgggagggaggtgggggggtcagccctccgcccggccagccgccccatctgggaggtgaggggcgcctctgcccggccgcccctactgggaagtgaggagcccctctgcccggccagccgccccgtccgggagggaggtgggggtgtcagccccacgcccgccagccgcctcgtccgggagggaggtggggggtcagccccccgcccggccagccgccccgtccgggagggaggtggggggggtcagcccccctgcccggccagtggccccgtccgggaggtgaggggcgcctctgcccggctgcccctactgggaagtgaggagcccctctgcccggccagccgccccgtccgggagggaggtggggggggtcagccccccccgcccggccagccgccctgtccgggaggtgaggggcgcctctgcccagccaccacccggtctgggaggtgtgcccaacagctcattgagaacgggccaggatgacaatggcggccttgtggaatagaaaggcgggaaaggcggggaaaagattgagaaatcggatggttgccgtgtctgtgtagaaagaagtagacatgggagacttttcattttgttctgcactaagaaaaattcctctgtcttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaaaaaagtttccaaatgagggttacagtgtataccctgaacctgatacagtacttaataaatagcatgatttgactatgtaaaaagcaaacagaggccaggcatggtggctcacacctgtaatcccagcaatttgggaggctgaggcgggtcaatcacctgaggtcaggagttcatgaccagcccgggcaacatggtaagaccccatctctacaaaattggcctggtgtggcggcaggcacctataatcccagctattcaggaggctgaggcggaagaattgcttgaagctgggaaagccaggaggcggaggttgctgtgagccgagatcgtgccactgccctccagcctgggcaacacagcgagactctgtctcaaaaaaaaaaaaaaaaaagaagaaagaaagaaagaacttttacaaataaaaaaaacttttatgtccattaaatattttacaaaataattctacaggataaataatcacattagaattgtcttaaaacagtgcatcatgttttattttatttttatttttgagactgagtctcactctatcgcccaggctggagtgcagtggcacaatctcagctcattgcaacctctgccttgagggttcatgtgattctcatgactcagcttcctgtgtagctgggattacaggagcccaccatcacacctagttaatttatttttttatttttttatttttagtagagatagggtttcaccacgttggccaggctggtctcgaactgacctcaagtgatccacgagcatcggcctcccaaactgctgggattacaggcatgaggcaccacgcccagcctcatgttttatttttaaatacttgaactgtatctccacatgattcctattaccatagttataattaaattcattaagctatatcaaaaatttttcaaattatattttacataatttctgggatgtttgtatacagcattttaagtatctgtaactacaagagcaagtgtctaaaatacactttaaagtctgaaagagattaagtggaaagtaaaatctcatctaaatcccaataattattttcttttcacagaggctaatattaacaaatataatgtaatccatgaaaaatcatgattattataatatgaaagattataaaattaaactttttagaaagttcagaattttgtattgatactatagcatttgctattcgcagaggatgacaggtatttcgcaaaaatgtcagtacgagaaggatattacatgaaactgcaagatgtcacctctattctagagggttgtagcaacccactccctcccaaagcacacccttgttaggataaaagaagaattaccagataaataggctgtgcctcaaaccaattaaatccctgggggtgcaatccaggcaacggaaattttttaaaagcttcctacattccaatatgtagacaaggttaagaactactgctgtatggtatagatctgtttgcaaaggtgaagaagtttgaaagaagtaggcaaaaagagtgaaagtgtaagataagaacactattggataacaaagatgagtatatttcactccaaaatctacaaaggatttgtgaggccagtacctcaggcctgtaatcccagcatttaggaggctgaggcaagaggcctgcttcaggcctggagtttgagaccagtctgggcaacacagcgagattctgtctctacaaaaaaattaaaaaattagccatgggtggtagcagtcttagtactcaggaggctgaggcaagagaatcatttgaccccaggaggtcaagactgctgtgagccaagattgtggcactgcactccaacctgggtgagagagtgagaccctatctcttaaaacaaaacaaaacaaacaaacaaaaaaaaacagataaaatctacagaagataaaaggggttagatcagtagaaagccctcacaaactttacaaactagcaatttaattacattaacaaattattctgttaaaatacaaatacaacttgaggaaatttattgaattgctcacattcagaccttgatataaaatttatttaacaaaatgtaacctagctaaaataagtcacggttaatgagaattctgattgtctatagggaactaccgtttcagagaataaagggatctagggtgtagatcttgaatttccagaaaaaactttgaagtcactgtatatatatgaaggcaaaggagtctacagaagaccaggctcaagtaagatggcaaaaattatatcaagtaagatgtcaaattgatgacagaaggtgcacaaaagagtatcatttccattactgtctaccaaaatttggtaggatgtcatatgatataaaaataccagacttattttgaatataaaaaatttcataaactcagtttattcctgtgttttcaattgaacttaggacagttctactcaccccacttatgctgaaaaaaaaaaaagaagagaaaaaataaaagtacaaaagacatccatggaatctcatatcaatgttccttcttttattcagtatcaaatatttaagaccctggtagtatatatcaggtattggaccagggatgaaaacatcaaaattaatgttacgggcttctactctacaagtactttatagtatactgggaaaaaataaaatgtgtaccagactataagtgctttaatacttgtatttatcaaacgctatgagaacacatataagcaaagaaatatctaccaagtaatgcttctgagagaaagaagaggcaatggctgataaagtacttggacacagtcacatttcggaaggattctgaaagacaaatgggaactcaccaagaagataacatgggaacagaactgaaaacacaaagaagagcatgagaaaatataaagaaaaaataaaaggtatgtctggatcgcaagttgcttggtgtggttagagatgcacgaaaaagatgaatggcaaggaagatttaaggaatggcactaacaagccttgaatgtcatgtcttaggtttttcaatgaagtggttttaataatggtactaggaaggctgcaatagcattgaaagagagtaaagacaaggaaacccactggtagactacttgcagacttctataaccaagggtttttcaatgaatctaggttgtaatcataaccgattgttataatggggtatagatatagatcatataaacaatggaaagctgttctgatctcagaatagacccttgagttttctcttttcaatgaatacctaattatggcttgacatattatcgaaaacagaccaggaaatgtataatggcattacctaatacaagtgtatcataaagcataatagcctgtcactgacatttcacttctttatttctccatttatatatcctctaatcacatgcagtgtggatttcatgccaccggttcacaggatgtgttccctcaaagtatatataatccaaaaactcctaaatccttagcccctaagcttttccctaacatttcacatatgacacaggaattaacattgccatttaagattgagtaaactgaggtttagtgcacattatataattccaaggccaaaaaactactaattaaaagtgcttattttcaaaaacccagaactgtatgaggccaaaaccgatgatcattcttctatgccaaacttacctcatgagataattttcttctactcatgaatagattacaaccttaagaagcctagcaacttcaagttcattttcttttataaaataaaacattacataagttgagaactttttgagacataactcacatataattttatgagttttgacaaacacatacaattatgtcaggacccctaagataccatcagattcaattattcacaaggaatcacaggattgagtcatcttcatggctatgacttcctgaatcttgtcttagtacaaacaaaatcaacaaagggagtgccatggtacaagatctagagaaaccaggtacaagcttccaagagtcctttccttacgcaatcacacaggatgtgtctaattcctccaggaatttcacacatatcacaatgtgtgaaatgtttgtcaaaggaaccttatttagagactcagctcccaaggttttcatttgggactggttgcttagggaccctctgtctagtacatgctgtaattctagactcccagaaagaaaactgatgtttacaatcaactacatcgtttggacaaacagtctaagcacagtgagccactcatcatttatgtaaagttctatatcagtgtagggacctgtttactattcaaattcccagatgccagccaagggtccaccttgtaactgaccctttgtaaaggatgagacgctacgttaacacttttctgcaaagttatataatcaccaacacaatcacgatacagaacagctccatcatgccaagaaaaaaaaaatctttgcacccctttttaatcaacctctacaaccactggtctaatttctattcttataatgtgcctattccagaatgtcatacaaatggaatcaatcacatttgcacatagccttttgagtctggcttctttcacttattgtaatgcacttcagattcatccatgttgttatatgcaccagtaatttgttcctttttattgctaaataatagtctactatggatataccacagatattttcatctgccacaattcaatatggttttctccggtaaactgtatttctacttcacttgagtaaacatctaagaactatatgaggccaaaacctacgatcattcttctatgccaaacttccctcatcaaaacacgcagtagaatggaggaacctcaaattactatgctgagtgaaagaagacaaaaaagaagtacaaattgcataaaaccatttatataaaattctagataatgtaagcttatctagagtgacagaagatcaatgactgcctaggggcagggagggtgggagagagtaatcacgaaagggtaggaaaaaatctctagattatgatgatggtttcatggatagacataagcagagtcaacactcggtatcctcaggttctgcatctgcagattcaatcaaccacagactgaaaatattcatataagaaaacaataaaaaatagcaataaaataaaaaataggtcgggtgccatggctcacacctgtaatctcagcactttgggaggctgaggcaggcggttcacttgaggtcagggattctagaccagcagtctctactaaaaatacaaaaatcagtcaggcatggtggtgtgtgcctgtaatcccagctactcaggaggctgaagcaggagatttgcttgaacctgggaggtggaggttgcagtgagttgagattgtgccactgtgtactccagcctgggcaacagagtgagacaccatctccaaaaaagaaaaaaaaatgcaaaatttaaaatatagtaaaacaaccatttacatagcatgaacattgtattcagtattatatgtaatctagagatgatacagcagaaggatatatgtaagctatatgcaaatactataccattttatacaaggaacttgagcatctgtggattttggtattcatgcgggccctgcaaccaattctctgtggatactaagggattacatgtcaaactgtacattttaaatatgtacagtttattgtatgtcaattgtaccacaaaaaataaacaaagccttagtcacatccattaagttttcattctatttttttatattattgatgtcattttttctgtacccaggactatgtaatacatttcctatttcacatttgatattaaaccatgtgaagaatcatccttatttaactaatgaaaggaaaatatttaaggaagctgaaacccagagagactaagtggtactgaaaacacccaaaaaccaagtgctctgccagtgtcacgtatctgttaagtaaagagattcaaacccatgtctgctttacttaaaagctaacggtcttaatcactataccatacaatattaatatatcatcttaaaggaaggattcagaggatagacactgtgctaggctgaataacagcctcccaaatatgtctaaatactaatccccacaacctgtatgttactttacagggactttgtggatgtgattacattaaggatatagatatgagggcattatccaggattaacttcgttgggcatgtaatcataagcatccttataagagggaggaaggaaggttagagtgagagaaggcattgtgatgatggaagcagaggaaaaggagactgacaacagagaagcagagtcagagagaaatttggagatgctatgctgctagttttgaagatggaggaagaagccatgaaccaaggaatgaaggcagcctgtagaagatagaaaagtcaaggaattttcccccaaaaacctgcaattgattgaatgtttgtgttctctataaattcatatgttgaaattttaacccccaatgtgacaatattaggaggtagggtcccttagtcagtaattagattgtgagggtaggaccctcaggaatagaattagtgcccttagaaaagaggccccagagaactctctagctctccttccaccatgttaggatacaatgagaagtcagtagtcttcaacctgggagagggctctcaccagaatccaaccatgctgactggcaccagatcacagacttccagcctccagaagtctgacaaataaatgtttgtactttaagccactcagtgtacggcaatttattataacaacctgaatagactaagacaagcctccagaggaaacacagccctgccaacccatttcagacttctgaacttccagaacaactgtgttattcaagccagtaaatttgtggtaatttattacacagcaataagaaactaatacaggctctatagtcaatgtagtttctttcttccctatcataaatgttctatgcatttggcctacagtaaaagttcctgataatgatggaggtaaaaatggcctctggaagtttgggtatgggagaaaatataaaaggcagtacactaagcaattattcttgtggactctagatatctatgagtcttagtaaagtccaaaacccagtatgtgccaatagctttaggtcttcctttgcaaattttaaaaactcaaatgatgccaaagtaaactattccctaggctgacttaagacaatacaaattcattagtgggtctggagggaaagagtggtatcagagatctcacagtcagtctgagaatgatgtggtgttaccaaatcatactaaacacagactaggaccaaacaagctataggcagtgtgtaaaaagcaattcactctagactttattttattttgtttttaattatccatgtggcctaaatcccacaaaagagaatgttaaaacaaatttcaaacctgagacttgatttttcagttcatttctatcatctatagttaccatctttaaagcttggaacctgtaattctttcattcattcaacaagcatttattgtgtacaattcacagcacatcataatgaacaaaaataaatatcaccctttccctaatggcatttataagttagaagggaaagattatttcaaaaacaattaataaacagcttaacaagtaccataacatgggaagtagaagttgatgtgaggggcatggcgggaaacctaagttagtgagggaaatagaatatgaaaatgcttggagactagagatggaaaagagcataaagaaagagtgtgagagtatgtaagtggctgtgtattagaggggaagtgtcaaagggagggataaggagagataaggcctgataggtgagtaaaagccagccatgaagagactgcgccctggtcttaaatcccagtggtacatatagagatagcaaaaccagtcattgtgatgattctcaatcctggctgcaaatctaaggtcgtccagtagagtgcttctcttctactgtggcctggcaaacacagtttataaaatctgtgaaaagtgagagtaactgaaaactctaagaactgagactaatagtttcatgcatatgcaataataatagctattaatttttaaaatttgacaattttataagttacaaatattagagttcctgtatacccttcactcagcttcctctaatgttataatcttatataaccacactacaattatctaaatgaaaaagtttacagtgatacaatactattaactaatcttcagagtacatttgatttttgcaaattttcccattaattttcttttcttgaccaataactaatacagaatcccaaactgcagttagttatcatgtcttcttagtctcttcaaatctggaacaattcctccatttctccttgtttttcatgaactttatatttttggagactactgaccatttgttttgtgaaacatccctgagatttgagcttgtctaatattttctctttttttttttccctctggctctgtcacccaggctggagtgcaatgacacgatttcagctcactgcaatctccacctcctgggttcaagcgattctcctgcctcagcctcccgagtagctgagattacagtcatgcaccaccacgcccagataattgttgtatttttagtagatacagggtttcaccaagttggccaagctggtatcgaactcctgacctcaggtgatccactcacctcagcctcccgaagtgctaggattataagcataagcaactgtgtccggccaatattttcacttaattaaatggaagatttgtatttttggcaagaagaccatggaagtgctcttgtgcacttctcagtgcatcacatcaggtggtatatgatgtcaagaagtcttcttactgatggtattaagttgatcatttggtgaatatgatgtctgccacgtttctacatattaactatgaagttaatatgtttcctgcttgtaattaataactatcttgttgggagatactttgaaacaatggaattatcttttttctcattattccatcgccttaagtttcagtattcactgattattgcctaaactgtattgtattgtacagtactgtggtgtctgccaaaagatgatttttctacatctattaatctttttacttttaaaaattgacattctactgtaaagaagagctgtctcttacctcccatttataaattattgacttcacgataaactaaaaaatatttattctatgggtttttaatctattactgtcaatattataatgttgctcaaattgtcacagatttagctatttaaagatctttgggatttatgtccttttgacatgctgctacccatttttgagtacttccttaccttctggcaccacaagataatcttatagttgccctttcctagctctgaaatcagccatttatccaaaaagatctagttttttaagttaacaaatggcatacagaaactaagatttgggaactaggtttgcattttatcattggttgtcactgcttctatgtcttctcaggagacagggctaggtgatataagtatgtatgctaattgtgcatactaacacatgtatatgtaattgtttatatcatctttctatgtgtgtacacataacaataaattcacattgatatttcattccaatcaatcaccacaggattcattctagagtttcctctccttatttgtaactcctttctccaaaagaaagaaatcttgcttttactatccaaaatatatttacttatttgctctaatcctaggatacatataaaggaattttagattcattatctttctcccccacaattattggagcaattatgctgttcatttgtaatgctgttagattttcactttgtcccacaacatagctgatgtgtgtgtgtgtgtgtgtgtgtgtgtgtgtgtgtgtgtgtgagagagagagagagagagagacagagagagagattaggttctaagagtccaaagcatacaaaaggtatagtcagagaactgtcactcccctttcattgcttgtactctgttcccattccccagtcctttccagcacattctcacctacctgctgcagataatcaatattattagtctatgattcaacccttcctgtatctctttttgtacaaatcaacagctaacagttattaagcatttacatggtatatgtcagacactgttctatatgcctttctacatattagctccttcacctttcacaagcacctaagcttcaagagtgtagatgctctgaaacatcgttttcatctaggaatcttttccttttcgtaggtgttcttgattgcctcagatatacccaagagatattcattatagaattagagaactaaatagtacattgccaagtactagattttgttctgatgataatgatttaacatgtgataacaatttttatttcctcaggtagttaattcattacaaatcagtcactaagtacccataaaagtacatacaatttctcatttgtcacatttattctcacaatagcacaaggagacctgcatgtaggacaaatagcatccttactttacatgagaaaactgaagaacctataaacataaaaaggacttctgtgctcccactaaaaccctggtaagtaagttcatagaaggcttgagtcttcaggaagaagagagagacagagacaagggcagccagcaagaaagggaggagagtgaatcaacacagggaaagcaaggtctgaaatgaatgcctgagtacagacaactgacaatagacaactattgcaaattgttgattagcaaggcaatatgaaggaactgtttaaggaaattagcagtgtgtaaaatgcagcagaggatagagacaacaaggtgtaacatttctgggaaatctgaatgtataatataaagcattaaagtacctttctaacatcaatttctaggaatgctcattttgttagtcaaaagcaattacaggaaaatccaatctttgactatttaaacacagtgatttttaccattgaccatattaggataaaatggggagcttcttaaaaatactaactaccaagccattttccagaccaattaaatcagaatcctgggaaaggtgtacaggcgtcagtactttttttaataatcccatggtgattctaatagacagctatagttcagaaccaacacatcagtagtaaacattgacaagaagatgcccatatgtaataaagtttcgattttttcttttttttttttagaagatactctctgttgacagtgaacattctgcttttgcagaagtatatacttactaaggtaccataaacttcagaaatgtaaaagtaaaactaagaaaatgtacatctacaatttcctaatgcatttttataaataattgtagaaaagcaatttttcatatatcaatcctttagtattctaaagttattataatttattttttttaattttttgataataaatactccgtattaaaaataccctctctggaaattttccaaattatcatctggatcagagatataagtaacaacattctaaacacacaatgctataggactggtttagcatgataccaggggaagcagaaaataaaaggaaatctaaactacactcaaagcaacaatctgttaaattctaagctacgtgaggacagtatccaagtctgtctattctactgttatatactcagtaatttgcataaagcctggcacataataggtgtccagtaattcttagttccataacaaatctattttgaaaacttatttagaaatgcatcaacggaaggaagaatgaaaggaaagtagtaaggagaagggaaggaaaagacccttggaatgacgaacaaatgactgactgatttagtcagtcattctcaaaatggtgaagtgggagtcaggagagtaggattctgagtcttggctttgccagaaaaccagttgtatactcttaagcaaatcatttaagttctccacaataacttgctcatccataaaacaaggagaggcataaatgacttctctcatgacctacagtgttgaaaatctctatatatcactgtatcagatattttgaaggaaagtatacattaatctaagtattattttttaagacagaaaaaaattgacaagaatttactaaaccgaaaattttaagtaaaagaatttctaattcggcatatacaaccaaaatttctaattacatatttggtgaaaaaagataagtcattgtatatccagctatttcatatttaactccaagttttaattctcagttatccacagatagaggaataaaacataaggaaaactcataacaggaattctctcagtattttctcagatgtatttttcccagcaaaagttaaaaactaaaggaaaagttgcaagaacacttaaaaaaataaatcctacatctaaatttcccaccttgcttacatttcagtacatttgctttatcatgctacctcttagtctctcttggcatatgtgtgatagacattattttttttctgaatcaaatgagagttagttacaaatatcatgacacttcaacctttatctatatttattgactaagaacaaagatgttttcttatataatcacaacacaattattacacttcataaacttagtattaacaattcatgtggttggtttttaatccgggtccaatcatgtatcactttcatactaatatttgaataatattgtgttatttactaaaaattaattatacttttaaacaagataattcaatacaagacaatgagagttatagggaggctggacaatgccagaaagagtcatatattatgatttaagaggttaggttccacttcccttttattataacaagctgccattggaacctatctccttaatgggctggggagtgattttcatattgtgagatgccttgagcagcagtgagtaagaaacccatgagctttcgatgtcagctaggatggttcctttttatccattttatatattggggttctaactaagaacagtatttacaaaaaaaagtaatttttgtggtgttttggttttggggttttttttttgcataaaaatgaatttgaaaacaggctaaagaagtaaaggtaaaaatcattaggtaaaagagtagggaaaggaaagagaaatcaaattctcaacagaataagaatgatcctgacccaagtatttcagaatacaaaaagtcaaacagtcacagccttttattgttcaccacagttgaagtagcaaacagtaaagtctaaaaaaaaaaaagctttattacttgaaaaaccaagaatgcttctgaaccttcatttattccactgcaaaacagaaataataatatacacttcacagggttgttgtgaggatttaatgaaataatgtttgtaaagggctcagtaaatccctggcaaattgtaaacactcaaaaataaaaattaaaaaacatcctaatactgttgggtgaagtggctcatgcctgtaattcccagcactttggcaggctgaggcaggaggatcacttgaggccagcagtttaagaccagcctgggcaacacagtaagaccccatctcgacaaaaaaacttaattagtcgggcatggtgtcatgtgcctgtggtcccagctacttgggaggctgaaggaggagggctgcttgagccctggaggtcagggcttcagtgagccatgtttatgccactgcactccatcctgggcaaaagagcaagacccagtctcaaaacgaaaaaaccacaagaacaaaaaccaaactaataccaactactaatattaagaagttgactgggtgtaatggctcacgcctataatcctagcactttggaagccaaggtaggtagattgcttgagcccaggggttcaagaccagcctgggcaacatagtgagactttgttgcccagaaagaaaaaaaaaatagccagatgtggcatgagcctcagggaggctgagttaaaaggactgcttcagcccaggaggttgatgctacagtgagctgtgatctgcactccagtctgggtggcagagcaagaccctagctcaaaacaaaaaaacaaaaaaacaaaacagaagttgcatgatagttatgagtacaggctctagagtcagaatgcctgggttcaaatgttaactactcaatatactagcctttggatcttggtcaagtaacaaacttttaaagctctagtttcttcatttgtaaacttgggacaattaatactacctatctcattgctctgtttttaagatacgatgagataatccttataaaaatacttggcacagggctgggcgcggtggctcatgcctgtaatctcagcactttgagaggccgagacaggtggatcatgaggtcaggagttcgagaccagcctggcgaacatggtgaaaccccgtctctactacaaatacaaaaaatcagccaggtgtggtggcacgtgcctgtagtcccagctactcatgaggctgaggcaggagaactgcctgaacccgggaagtggagcttgcagtgagctgagatcccaccactgcactccaacctgggcgacaaagcgaggctccgtctcaaaaaataaataaattaattaaataattaattaaataaaaatacttggcacagtgtctggctcaaaattaattgctcagtaagtatcacctattattcacatcactattattataattatttaaaatactagcatatctagcctagatattaacatataaagctctaaattttattttctaattcttgaataaacttttagaatcacacaatcttagaggtgaagaggaccttactatccaatgaacttattttaatagtaagattgcccatatatttgcagtaagttatttgtgttaacatctcccctctttaaacctcaagctctatgcaaacagactattactttcttctcacttgcaatttgtctataatgaatgtatatgaaaattatgatcttatttttttttagcttattcattgtcacataaccagttaatgacaacggctgagaatacaaaggcatcaaactgcacagtgctctttccataaaatcacactaatcttgtattagagaaagacaacattttaaaaaagcccttttataacctccaaatatatccttgtttatgaccatttacagtgaaaaattataatcattgctttttaagctatttatttatagtttttcacttttctatttcccctattagagaaaaagttacatgaaggcaagcgatatatttgtcttattcatattgatttctacagtgccaaaatgtgcatagtaagtggtatacagccagtactaaataaatacgaaaagaagaattgttccaataggcaggagaaacaaaatttgaaacgtcaaatatcagctattataacagcctacagggtcctgaagtagaagcagccctgtcaacaaacttcaaggctgggctaaattattgctgtggttctcaagtgattctcatattgggattttttttttaagactgtttggtttcactctagacccatataaaaccataatattttctcaaattccttaaataattttatttgctcccaaccctttggaatacttctgaaaatttctggttatagcaaaaattactacagagacttaaaagttcaagcacccccaaactacaacttctagttatctgctgaatctcaaaattttctcatctactcagaacttaattgtcaaagaaaagtgttctttacaaacagaaaccaaaattcccaagtctgtattatctatagtacatctcttttcagacatactctacttctattacactcctcttaatctctgaatcaatcttatccttcatagtttacaactagttatgataaaatattttgaattttatttttcaaaatttattactgctttggttgaaacaaatatttctcagttcatacagcataatgaaaattttaagactaatagtttacctgaccccccaacccccaaaaatgatttctttatgacatactgtaggttcagtactatgctaagaactacagaaataacataaggctaaaatcttataatctacacacaaaacaaagaaatagaacttactgtcaagtactaaattctgcaatataaattgattataaatgccacagaagataggaggaaagaatatcaagaaaaactggagacttgaagaaaaactgcataatgagacttgcaggatattccaaaaatgctacaaattttttaatgtttcaatgagcatatgtgcaacaacttgaatttatttttcaatttgtttttatttacttttgtaatatattgactaatgctgacacttggatgccataagtttattttattccttatgtctttgaaattatacaaaaatattttactcagaattataaaaagcacatattcaattttgaatatggcaaaacatgttacttgccaatgaaattatgtggttttttgctttatattcattctttgaaaatgtagttaacctggcatggtggttcccatttgtagtcctagctactcaggagaggctgaagtgggaggattacttgagcccaggagttcaaagttgcagtaagctataatcacgccactgcatccagcctaggtaacacgacaagatcccatgtcttaaaaaaaaaaagaaaaagaaaaagaaaaaagaaaagagaaaagtgtatagttctctgattcccatatgttcagtatcaggcctgtaattagtacatcacaaatatacaaaagataatattcatacatttttctagccattaaaagtagaaataggccaggcatggcggctcacacccataatcctagcactttgggaggccgaggtgggcagataatttgaggtcaggagttcgagaccagcctggccaacatggtgaagccccatctctactaaaaatacaaaaaaatcagcttagcatggggcacacacctgtaatcccagctacttcaaaggctgagacaggataactgcttgaacccaggatggggaggttgcagtgagctgagatcctgccactgcactccggcctgggtgacagagtgagactctgtctccaagaaaaaaaaaaaaaaagaaagaaaagtacaaataaggtttgactaataataaaaattcaaatctagtgccataagtatgtataattatatgacacaactatactgtgaccatataatacatactacacaagaaaaaaatggctcctcagtatcagtactgcaatatgcctctgtggtagagacagatcccagaaatatcaacttactagaaaaatgagcatataggtgagtctcattatgtatctggccacaggcatttaaagtacatagtgtttaaaactaaacactaagtcatgcaaagactttcaaaaatatacctgttttctttaactaacatctccattgattcttccatttgttttgttagctattgattttttccctctccttcttatgaaaggggaacaaggaggggatacatggggaaaatgttacctttattaagccatcttacaatgttattgtcaggaatggctataaagaatttctagcatcgtcaaagtcccagagagagcaatgagtggtgcctgcactgatgtcaagtactagctcctaggcatggcttaggaataaaaataaacgcattagaaagaataagaatgggtgtatattgcacttatgagtacccatttgcttgattatccacatagcgtaacggaatcaaatgcctaagatgaactcttagtaagtaaggtatattagcattttagtatactaatttcactacaaattcattgatattacttatttagtaaaaaaaaaattagaggtaaaggatttttttaaagataggacatgatatacttcttttggaaaagaaaatacgtcaagatgagttcaatattgaatttcaccaatgagtatatattaaaacatcagaaattattttcaaaacaatctttccttaggcttaaaaggagaacctgatttaaaatcaacaccaccctagccatagcttttaacgggtcaagtacattagctactcctttctgcaaacaatggtacataaaaacaaagtgggatatttcctacaaagaagattaaaaattctttaggcctgcctttccttggactctggattttaaaatgacatactacaagataaaatagtaatgctaatattgatagtttgtccattacaggtcagctaactgtccactggaacagttacaaagctgttagtttcgatttcacaaggccaatcaatacagaggcatactgtttcaattttgtctgcattgatttttttttataacactccaaccttacagcattcatctttctgaaagaaggaagatttgatttactgaagaaaaattggagagagcatcacaaagattttaccggcaagcctgtgacacagaaaaaagatgaatgtctttcaggaagagacgcctctagcttgagggcatccattagaacacactcaagcaatctgaaaaggagtttcttaaagcagcagaaatctaaacctaaacagtctcctaaactaatcaaaagcattcaagaattttgatatgaggttccgttaaaaattcctaaaccttattacttctaaaataatttatgtctctagctctacctatgcattttttagagatgagaaccacctctttcccagactaataccaagagtgaatttccatggtacattagtcagcctattagaatgcaatgaaggacgatatgagaaaagggtagtatgtcctctgagacttccatccagtattctccatcatctctcctcatccttcttacattcagccactttaccaggtgtcatctacatgaaagatgatttgtctcctgacccaaataaacacaatgcctgctccatgcaccggaaaaaaattacttctgccactctgttcatttgtggcttctttcttgcttattccactattcttatcaagctctctcagttttcacctgagcctcactccaggtgacagtaatgtatggatgaacaggtacttgtctgtcccattatttcctgaaatctctaagcatttgaaaaaatgcaatgacagtaaagggcacagttatcagagctccaagggaggaatactttcctttacttaccaatgcaatagtctaggcatcaaagaaaaaagagagagagagaaagaactctcatggcaaaagctggtgtaagcgagatattaagacacaaattgcattcaggcaggtcactaggtgtcaaaagatattagatgcctgctgtgaggaaacaacaattcccatctgcctctgagaaaataatattttcattttcagtttttattgaatggaaacttttgggaatatgtctttataaagggtattaagtctaccaactataacatgttcaaaatggctataatcatcattgtgttatccataaagcagcagatttcatttggtctctttagatgggataaattggattcttttttccccggcttgcagttttgtcgcaggaccagatgtttctcaaatgccacatgctgaggctcctatactgaatgtagcacctgaccttctctataattgactaaaaatattgatgtaatggcatgggtctgattgtgatttattaaaaccactgccgatcccaggccagctgccagcattgcagcccactgatcgtgtggcattagaaaagccatcaatagtgaaacaaaataaatgacattaatgggaaagtatcaggcctacataaccatggctacaagcaaattacgtggattccaaaggagggtcaaaataaaaaaaatgccacaaatgaaatttctaaatattctaatatgattgagttaaaagacaaaatgctactataattctttagataaaatgcaaagaaattatacttaatttaatcctcttcactagaattttgctcattgtgcatatttcttttagcaggcttagcatagttaaatgcattacagctacagtatgactctgatttctctctaatgccatttatgttttctagaattatgctaagtgaagaacaaagtacactgtgttattcccatttattacaaccatgtccataatttacaagctgattatgcaagcctcatacaagggaaatcagagaatagttaaccactgtcaaagtatggtgagccagcatacatttttgtcagctacattttcttacatggaccttaaaaggaacattaagatccacacttcacattattgggaattaatattgaaaaggactatttaaagataatttttaaaaatgcattagggagaaaccaggtattctaaataagtaacagttgaatatgatacagaactaaatataatgacaaagaaatatgaacatacaggcaatgtgctttgttacatattgttttttaatgtaagatgagatttatagagaggaaaatattaatttaatcatgtccattttgtgatggtacatcctttcttgttgttctgaatttaaaatgtacacattagaaagctaataatttgacagctattttcatttgagaggaaaaagtaagagatattttgttctgtggacttgcagaaatattaaaatttcaaaatttatttcagttgtttctggcttaatgaataatagagttgataccttagaacaactctattactgaaacactaattatttctagataaatacatttcatggtccatttagctctccaagatattttattacaccaaaatcacttcaggaaaactatgttttccttttgataccacatgtatatactatgctatacaaaggtacagctatcaacagaaagaattttgatcccatcaaaataacccatgaaacgcttgacataagttatctaaatgtgtttattttaaaactgcaaaaccttttgggtgaaaagaataactttttaaaaagattcaacaaatgcacattgggttcctactgtgtgtcaggcactatgcatcagagtaatatcctaattcattcagtatctgatgtcaaaatgatatcaaatctgtaataataaagcactttgaaactctaaaaccctcaatacaacactcctccattctcctcgccatgggcttttagatgttgcaagataaggcaccagagatcactgacccatgaatagatgttatttccataaccactcttgcacctgcagatcaactgaaataacattaaaacaaacaaacaaacatggttcctgttggctgtccttttgatctcaagaccttgacttgcctttctttctctgaatatcaaaaattaggtacccagaaatataattcattatatgcaaatattctttgtaataaatatcacacgctacatttattctatattagtgaatactttatacaaatagctttcaatgcaaatttttgaagtttacttttctaaaagttaaaatttttttctttatactggaaaatttctaacactggattttgatgtctgatagacacataagttgattaaaacacaaatggaagcaaattacactcttatataatatacaagtaatttactatttttgtttttgttgtcttctagaaaaagttggtcaaaaattagaaattaaaatataatgttttctaatagcaaaataaaaactttctgtcattaactttacttaaaagagtcaacacatgttcctgaaatttgtagcataaaatatttcatggaggatatataatttgtccaagttccttagtcttaaaggcaatttaattaatttctataaagtaaaatcaacaacagcatgtccagtttggctatcttaaaagaaggtagatatattgagtaaaactttaaagaaggcatttaaccaagtttatcatcacagtcctgaaatttgcaacataagaaaaaaaatcattttattgtattttcaaaattatactttgaaaatatggttactttcaaataactaaaaaatataaaaagagcatagttttttaaaataaaatgttatatacgtaaaaatttggctataagtgtagatagtaagatagtttaactgcttcccttaagaattcatttcaaaaggagtaagtagataaagcaaatatgattttggaagtagttgaggaaactgatctacaaagatccataattgtacacatactgattggataaatatggatctataaagatccataattgtacccatactgattttctccttccctttggctttaaattcatagagatgatgaaagacaaaattaaattactctcttcttcatctggctttgatcatatccaaagtcatttatctaaacctaagccatctacagaaaatcagtggccaaatcctaaaggtatccctttacctcactgcagaatttccccaggctccatgcttgtctgtgagaatgttgataattttctggattagttgagttgctgtcacgtggtcacgatattttgctgctcttatcaaatgatcacacatcttctcatcttctcgtttgtctgcagaatactgggcacacagtgacttggagagaaaaaaaaataatactataaaaaatgtgaaaaaaacctttaaaatccattatgaaataatctttaccctaaatcaaaacaaccaaaattttaaatctacttttacattcctcattcacctaactgagatttagtgatctgctgtctcaataaaacatcccacaagaatttacttctgtgaagtcaatcatgagatacactcagaagtggtaaacattcaagtagagacctgaacaatgagacaaagacagtcttgtaagaagcaggggcccagcacgacaaacagcatgaagtgaagttgcaaaggacttgagacatagtgaataaggagaataatggttaagaaataattttcaaaaggcaggccagggctacatcatttgtattatggtaaggagtttagattttattcaaatgtaatggaatcccagaggaaagttttacgcagtgaagtgataaatttacatattaaaatgatcatatagctgctatttagagaatggattgtagtgggacaagagaagtgaagttggcagttatgaggccactgcacagggccagaaaagagacaatagcagcttacaatagtaaattgagctagttctaaatacctttagaacatgaaactgtttggtcttttaagtcctagcaaaatgtaccaagagctctgggattgcctgggatcttatttcaaatgcagagtctcaggccccaccccaaatctattcattttgtgtttgaattttaattcccaggcaatttatatacatcaaagtctgaaaagtactgtcttagatatcatcaattttaccaaaaaacaccttagaattatttgtcagtaatcagatacactataattgctagtctccaaaatgcttatttctcttcttttggaattcggatacttgtggtgtcatgtttatgatactgtagttaaggcattgtttaaaataagaaaacaaagatggatgtagacttggtcctttgttctattcagtgtctactggagtcctctcccccacccccacacacatatcctttgatagataagtaacataaacttgatgttgggataaatatttctagtttacatacggaatatgcattgtggatgcttgcctctcctacagtataccagtttcgatagattgctgccacgcactactcccaccaccaccccagcaacaaataggagtcctgattgtcctgaaccaatcgtaataatcacacccacactggcaaactggattagggaaggacacttgatgtaactggtacaggtagggcaaagttcaagatttagttggacagttggttccctccttcctctcaaggtgtaaaagaagcagcaaattctaggagtattggaagctctctgtaccatgagggaagctggcctgaagatatggccaaaatgagagcagaactatgaaaattgtagaaaaacagagctcactccagaatcatgaacttccagatcaatcaaattctcaagaccagccaacccctatgagactttttaaagatttttttttaagagccaataaactcctgctcattgtaaaccagtaaaaacatccaaaaaaattggttttttttgttccttacaccaaaagcaattcatcctttgcatggtgtatatgtacatgcataaggaatcaaatatatatatatatatatatatatatatatatattttttttttttttttttttttttttttttgagacagtcttgctctgtcgcccaggctggagtgcagtggcgtgatcttcttggctcactgcaacctccgcctcctgggttcaagcaattctcctgcctcgacctcccgagtagctgggactacaggtgcacgccaccacacccagctaatttttttgtattttagtagagatggggtttcactgtgttgcccaggctggtcttgaattcctgagctctggcaatccacctgcctcggcctccaaaagtgctgcgattacaggcgtgagccaccgcgcctggccaagaatcaaatatcttagtctgtgcaaaacactatgctagggagatgaaaagctgaattgtataaagaggaattttagaagttagtcttgggtgggaataaaggaaacctttaaagcaaaggcaaggcagaaaaacgttaatcaatttcagggagggacaaagcaagagagtttgacccaagtacaaaatacaggtagaacgagtaatagtctgaagaaactctggaatgcagaatgagtatagaaaaaagtcacaggaatcatagtatacttatatgaatgactacaagattgggaagcaaaataaaaaccaggttacggtatcacccttgctaatatctcctgtcagtcttgatcaattcactcatttacctctttaggtctaaatgtcctcatctgcaaaattagcaggttatattagatctaagattgggtcaatccgaagattctgggcaacctctgtgagggtacttgagagtacctgagttcaacctctgagagatgttcactggtaaaggcaaactgtttatttaatctaaacactgatgtggagaaaataaatcctactaagaactagaataactcatgagaaattaaaagcaaatttcatacgctatatttttaaaaaagattgacccaaaccacagaagagttcactttgtcaaaaatatgatttgagcaaataaaagaaaatgattaagaaatgtatgaaagggcagcagtttaagtgaagataactaggaaattatttcattgtaacaaaaatgtcaactgatatgtcattttttatatattcattcaagaactgagaagcattctataggttatttcatatctaacccaaccatacactaaaacaaatagtacgaaatgacagacattcacagaactgtaaactttcaacattctctactatatccatatctgtccttgtctaacttcacctaagaggaaattcaaatctactgatgagatttagaaaatcaccggtttctgaaatgctatgaaccaccacataccttcatattaaacagcattaaaagtaaccaaaaacacattattaaatagcttgtcatttctatctcttattaatatattaatttaaaatcaaattatattttgtaaacatttgataagctattaaagtttgttctaaaaggcataattctaaaaacaagggctcaaggtaagctaaacggtaaaatggtttaaagtgttctttaatggatccttctttacaatttgaacagcaacttttcatatctgacataaaatctatagatataaatcacattaaagggctattctttcctgattatcaatctctgtctctttgtggaaccttagggtcacatctgacctaaaaacatgataaaagaaaaccaaacaagaatgtttcataaagatataatgaacttgtaatattttttaaatgtccttataatgtaatttgaagatgttcttatttaaaaaccaataataaatcctatgtatgaaatattgttcaaagtcatgtggagataagaaatatttactctagaatcaaatacatattatttatttgtagtatacatatttgtgtatgtatgtatacctgtatttggaggttgagtggaggtacaagagaccttaacaaatattgctatttatcggtaacataaacggtcaaatctaaaactttcattcaactttaaggcagaattttttatgttttatatcaacttttctgtgttcctatttgtaagcactatataaactagataatataacatcacaacatggccacaaaatatttgactataaaaagaaaaaaataagcatttggggaacaattctattttatgtgattattgctaaagaaacctaagatttataaccaaagaatgaagaaactcaatataggataaataaacctccacagaagaaattcagtcactcacagtaaatagacaaagcgaccattttagctctttaaatgtaaatgaatagagacaatatttaatttttccttccagatgtcatagctctacctaattttactattcatcctttgcatgaaagtaagagaggacacaaacaaatggaaaaacattccatgctcatggataggaagaatcaatatcatgaaaatggccatactatccaaattaatttatagattcaacactatccccaccaacctaccaatgactttcttcacagaattagaaaaaactactttaaatttcatatggaaccaaaaaagagcccatatagccaagacaatcctaagcaaaaagaacaaagctggaggcatcacactacctgacttcaagctatactataaggctacagtaaccaaaacagcatggtactggtaccaaaacagatatataaaacaaatggaacagaacagaggcctcagaaataacaccacacatctacaaccatctcatctttgacaaatctgacaaaaacaagaaatggggaaaggattcgctatttaataaatggtgttgggaaaactggctagccatatgcagaaaactgaaactggaccccttccttacaccttatacaaaaatcaatccaagatggattaaagatttaaacgtaagacctaaaaccataaaaaccctagaagaaaacctaggcaatgccattcaggacataggcatgggcaaagacttcatgactaaaacaccaaaagcaatggcaacataagtcaaaattgacaaatgggatctaattaaactaaagagctcctacacagcaaaagaaactatcatcagggtaaacagacaacctacagaatgaaagaaaatttttccaatctatccatctgacaaagggctaatttccagaatctacaaggaacttaaactaatttacaagaaagaaacaatcccatcaaaaagtgggtgaaggatatgaacagacacttttcaaaagaagacatttatgcggccaacaaacatatgaaaaaaagctcatcatcactggtcattagagaaatccaaatcaaaaccacaatgagataccatctcatgccagttagaatggcgatcattaaaaaatcaggaaacaacagatgctggaaaggatgtggagaaataggaacgcttttacactgttggagggagtataaattagttcaagtattcaagtattgtggaagacagtgtggcaatttctcaaggatctagaactagaaataccatttgacccagcaatcccattactgggtatacacccaaaggattataaatcattctactataaagacacatacacaggtatgtttactgcggcactatacacaacagcaaagacttggaaccaacccaaatgtccatcaatgttagactggataaagaaaatgtgacacatatactccacggaatactgtgcagccataaaaaagaatgagttcatgtccttttcagggacgtggatgaagctggaaaccatcattctcagcaaactaacaccagaacagaaaaccaaacaccgcatgttctcactcataagtgggagctgaacaataagaacatatgggcacggagaggggaacatcatacaccggggcctgtatggggatggagggcaaggggagggatagcattaagagaaatacctaatgcagatgacaggttgatgggtgcagcaaaccacaatggaacatgtataactatgtaacaaacctgcacattctgcacatgtatcccagaacttaaagtataataaataaataaataaatatttttaaaaagtcctaaaagatttaaaaaaaaaacagaaatggaaaatgttaatagatatattctctattaaagaaattgaactcaactactttaccataaagaaatctcaggcccacatgtttatatcggtgaattccaccaaacatttaagaggaaataatactgaggccgggcaagatggctcacatctgtaatctcagcacttagggaggctgtgacaggaggatcgcttgagcataggagttgaagaccagcatgggcaacatggtgaaaccccatagctacaaaaatacaaaaattagcccggtgtggtggcatgcacctttagtcctagctacttgggaggctgaggtgggaggatggcttgagccctggaggcagaggctgcagcaagccgagattgtgccactgcactccagcctgggtgacagagccaaaaagaagaagaaataataatgaaaaaaaaatttacaacagcatgaaaaatatgaaatacttagctatattttaaaatttatacagatcttataaaaaataaaaccataaaatagttaagagaaattaagaagctagataaatgaagaaatatataatttatgtatacaaaatatacagtttatagatttaaagattcaacattttaaaaattgattttatatattcaacacaatcttaataaaaatttttagcaatttttataaaactgaaaagctgattctaaaacacatataaaaacagaaggtaggccgggcgctgtggctcatgcctctaatcccagcactttgggaggccgaggcaggtagatcacaaggtcaggagatcgagaccaccctagaaaacaaggtgaaaccccatctctactaaaatacaaaaaaagtagtttggcatggtggcacacgcctgtaatcccaggtactcaggaggctgaggcaggagaaacgtttgaaccagggagttggaggttgcagtgagccgagatcacgccactgcactccagcctggcaatagagcaagactccatctcaaaaaaaaaaaaaaaaggtaataacagcaaagtaactttagaaaacaaagttgtaagacttcacacccttcccaccatattataaaactagaaatgaagagcactggttattagatgaagaaagagatgacaaaatgaagaaacaactggtactgaaacacctggctatccacatgagaaaaaaaaaaagacgaatcttttctttcacctaatatcatacaaaaaatacttaattcaaactggatcaaggatataaatctagaagttaaaactataacatttccaaaacacaacagcagattttttttataactttgggataggcaatgttgttagactggacagcataacagaaagcatagaagaaaatcacaagaatttaaaaactgacaaaataaactttatcaaaatttaaaacacctggtctttttttttttttttttttttagacagagtctcgctctgtcgcccaggctggagtgcagtggctcaatctcagctcactgtaagctccgcctcccaggttcacgccattctcctgcctcagcctcccgagtagctaggaccacaggcgcctgccaccatgcccagctaattttttgtattttttagtagaggcggggtttcaccatgttagccaggatggtctcaatctcttgacctcatgatctgcccgccttggcctcccaaagtgctgggattacaggcttgagccaccatgcctggcccaacacctgctctttaaaagaaccatttataaaataaaaggtaagccacaaattgtgaaaaaaaatttaacatacatctaaatgacaaatgaattctttacagaatatataaagaattcatacaattcaataagacaaacaacctaattaaaaataattagcacaggatttgaacaggcatttcacaaaagatatacaaatggctaataaagcacatgagaagatgcttagtcagtagagaaatacaaataaaaatcacaataagctatcactatacacccactagaccggctgaaatttaaaagagctacaataccaagcactgacaaggacatggaacaactggaactctcatacctaccttggtggttgaattgtaaagtcgtcaactactttggaaaatagtttgtcaatttcttgtaagcttaaacatatacttacagtagcatgtagcaatcctactcctaggtatttcctcaaaaggaataagaacatatttctacaaaaataacttgtatgaaaatgcccatggtgcatttagtcataaaagtcagacactgaaaacaacccaatgtctgcctatagctgaatggataaacaaaataattcaacttagtatttaaaaaaacaaaccaataatacacacaacaatgtgaacgaatatcaaaaagtttatgctgaccaaaataatccagagtacctactatttgattccatgtatataaaattttatagcagataaaactatctataataacagaaatcagatcactggttgtctgggattggatatgagtatatggagaggaattgaccacagtggatcacaggggaattctctaggatgacaaaatttcctatatctttattataatggtaaaatcacagatatacacctttatcaaaactcctcaaattgtatacttaaaattttattacatgcaaactatacttcaataaagtttatttaagaagtgtttgtttgtttgtttgtttgtttgttttttcaggcaggatttcactctattgtctaggctggagtgcagtggtgtgatcttggctcactgaaacctcaatctcttgggctcaagtgatcctgccacttcagtcccccaagtagctgggactagaggcatgcaccaccatgcccaactaattttttcgatttattgtagagatgaggtctcactatgttgcccacgctggtctcaaactcctgagcgcaagcaatccactcacctcggcctcccaaagtgctgggattacaggcatgagccaccatgcccagcaagaagtttttaaaaagtggatggacaaggtatagatggaggaagcagttaaaatgctcataccaaaaaataggctcatatagcaaataggtaaataccttctacaaatcaatgaggaagagacagataaccaataagaaactgggtaagagagcaacatgtacttcacaaaagtaaaaaatagataatatataacaagcaggagaatagactcaattcttttaaaaattcaaaataaaagtacatcagaatgccaaaataaaaatcaccagtcaactgttgatgagaatgctgaataataaagaacaattctacactgaggctgggagtggtatatacttttgcaagatagtgtgacaatatctattaaaagtgaaaatatgaacattttgtaatcaagtaattccaccatacagaaatgcacaaggatgtacgccagacatataaaatattcaaagtgcattattcataatagctaaacactgaaaacaaccaaacaaacagaagagattatttaaaaactaatggtctacatattcggaatagctaaaaattggaaataatccaattacctatcaacagtagaaagaggtaatgaacagctagcagtctatacataatggaatactatgtagtaatgaaagagaagttgaaaaatgtaagaaaataattaaatgttggaaacataatgttgaaataaaatttccagaataaaatacatgttttataattccatttatataagggtcaaaaattgggcaagggccgggcgcggtggctcacgcctgtaatcccagcactttgggaggccgaggtgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaattgggcaagaaattacagtgctaaaagaaacatacttaagttttgaaagaataaaacaaaagcaaatgtcaaccataaaattcagaacagtggttaccttaacagggcagaaaggggttgtgattggaaggctagaaaacttctcacaaactcttcgtttcagtatcacaaaaaaattaaattaatgatgttaaacatacattgtttctaaagttaggttttcagagtaataagttttttaagaaataggttataaaaagcaaatttttattaagtttgcaattaagttcttgttaagttttgaaataaaaataaactacacacaattttaatgctaaaatagcaagcccttttcctaaattaataatgtttaatgctaattaaacaatttgttttggtctcacaagttttgtatttaaaacctcttttaaagacttttaaaagaaacatatacttgcttttaaaaacaaatcaaagaacgacataaaaaagaaaaagaaatttctctcttctacctcctccctgtttggtcagctgctttctacagaggtagtcactgtttagagtaagatgtcattcctatataatggaatcaaactgtacatcattccatgtcaggaccttctttcttttacatggctacaaacagatgattacatttttagttaaccaagcattgcttctgctaaacacgtttaagtgtagtactttccttctcaatttgtctcaaaatcacttacactataaattacttgtctcactgaaaacaatttaaaagtgaaatcacttcagggacaataaatgaagaagtttctcagtatttcacttttggaggtctttgtacttgatcccttaccttaaagtgtgatctttaacaaaaaaaaaaaaaagctatctacagaaactcagaaagactcatagaaaagacagaaaaatgaaagcttagaaaatctcaacagcaaacaaaagtcaaccaatgacaatgtgtgacagccacctttaattctgtagtgattcctctgtcatgcaacgactcaaagtattgatttctctcagcatgaaaaagcctaagccaatgaaacagacagagcagcaaccccctcctcccttccccccataacagcattcaaggttaaaacaggcagaacacttatcaaagtatctcttccatttcttcttgttttaatagactggatacaacatgttgggttcttatcgttacaaactatagtcctcagacaatatttttaaataatttgaagattaatataggttattctatttttttgcttcacacttttggtaataaaaaacttgtttcaaatgctttttttttctgtgaactcttaacagaagtatatataatatttgtaaaaacaagccgacactaataagaaggctatagtttctacttgtgtgccaattccacacataatattttgttttcattatttctttagagtacttattaacaataaaacccacaaatacctaagcatcttccaaaaagacaaagtgaatccttcaacaatgcaaacacacatcatacatctgtttggaaaataaagtaaactatggctgctatctgtgttcaagaaaatagtaataacataaaatgtaagcaaaggatagggttgaaaccacagaattatattttaaaactatagtatgagacaaaaataacaatcagctctctgtatccccaggttctacatctacagattcgaccaaattttttgttttgttttgtttttgagtcagaatctcactctgacacctaggctggagtgcagtgacatgatcacaactcactgcagcctccatctcccaggttcacgcaaccctcccatttcagcctcatgagtaactgggactacatgcacacatcaccatgcccagctaatatttttctgtagagacagggtctctcagtgttggccaggctggtctcaaactcctggcctcaagtgatcctcctgcctcagcctcccaaagtgcttggattacaagtgtgagccactgcaccaggccttgaccaatttttgatctgcagttagtcctggaaccaattccgcatggatccagagggatgactgtgtatcttcacaaaatatgtataaatggttacacacagagaggtaaaattaagaagctttaatttcttaaactttactttctgctaatctgcaaaagagttagatgatcttaagcaaatcctatcatcttttaactctacctaaccaatggatttttaaaagcataaaaaactagggtcttttagttgtattagcaaggtctcctacttatgaataaatatatttgctactacaaataggtaaatcttacacttaaatatcaaggccagacatggtggctcacacctctaattccagcacttagggaggtcgaggccagcaaatcccttgaggccaggagagttcaaagccagcctgggcaacatggcaaagtcctatctttacaaaaaatagaaaaatcagctgggcatggtggcatgcacctgtagtcctagctacttgggaggatgaggcgggaggattgcttgagcccaggaggttatgctgcagtgagccataatcaggccactgcattcctgcctgtgtgagagagtgagaccctgtctcaaaaacaaaaataaatttcaaataaaagcagttcaagaacaagcatgaaaaccagaaagaaaataagcaattatgtataaaaatcataattaacaatgtagttaagagcaccaactctagagctagatgacttgagttttaactcttggttttgacacattcatgcttaagcaagttatttgaaaccctgtgcctcggtttcctcatataaaagaggagatgatgtggtatgcttttcaggaggatcaagaatagacataaaatgattagaacattgccagtcatataaaggtaacacctaacatttattgtaggcttaattgtgatgttatcaaaatacgtaacaaatagtccctgtcttccagcatctcactgtagtttagtaaaataaatacaatatgagaaagaaataaactatgagataactgctcaaagagttatagacagtatgtttggaaagagagaaaaagaaggaactattaggaatcagggagaggctgggcacagtggctcatgtctgtaatcccagcactttgggaggcgaggcaggcaaatgaataccttgcactcaggagttccagaccagcctgtagagatggcaaagtcccatctccacaaaaaaaaaaaatacaaaaattagccgggcatggtggcacacatctgtagtcccagctacttgggaagctgtggtgggaggattccttgagcccaggaagttgaggctgtactgagccgagactgcagcactctactccagcctgggtgacagaagagaccctgcctcaaaaaagtaaaaagaaaaaagaaaaaaaaaaaggccgggcgcagtggctcacacctgtaattccaacactttgagaggccaaggcgggtggatcatgaggtcaggagttcaagaccagcctggtcaagatggtgaaaccccatctctactaaaaatacaaaaattagcctggcatggtggcaggagtctgtaatcccagctactcagaaggctgaggcagagaagtgcttgaacccagcaggtggaggttgcagtgagccaagatcacaccactgcacaccagcctgggtgacagagtgagactttgtctcagaaaaaaaaaaaaaaaaaaaaaaaaaacagggagagtttcacagaggaattaaaggctaagtacctgttcaccaagaagaaagggatagaaaaaataaaatgtagaaaataaaagaggtcaaaaactaagagaacaagctcaaataaatgcatttttttaagcaaagataggaataacagaatgagacatgtaataaagagccttctctttttaaatatcctgatacatgtttatatttttcttgggtaactaatacattttttttaccaattaccttcataaaggaattattcctcaaaggtttatataaatcatttaacatacaaaatattaactagatttgtatttctcagctgatgattgttataatgttataatttctttaattcatattcaaatgtattgccaacacagaccatttcaaaacaacacacctgaatattaactgggttataaatactgtttctcaaactacctgtagggaagggccagttttgttttttttttaacctttttaaacacctttagcactgatgcctttgatgacattgccagacattcaagctataaaactttttaaatattcaatttctgtactcagctctttgtggattactaagaagtaatttagtcagcagaccatacttaaacagcactaatataaaaaggtaagtagaaggaaactatttttatcaactcaagtatttccattttgctttgtatggtaaaatacttgctttgcaaaataaaatactttgtattataaaatgcttggtcttatattcagtgctttaatttttattaataaaccagaaacaacaatagccaatattctaagtgcacatgagaaaagtctaaattataaacaaatgttgtataaaatacactgtaaagatttttaattagcttagtttcttattaatctttattttaaaatccattaagaaaaggaaggctttacattagtacataatttggtctatggttaagataaccagaagataccataaactgaaagcttaagtaaaggcttgatatatctatgagggatatattcagacattttctttgaagagattttcaatgcattaaaaggtctggttttcaaaatatattttacaagaacatactgagaagataatgaaaaaacactcttccagtttggatttaatttgatcaacaatgcctgcaacagttttacctacatataaaccttttgctttttctagcttgctagctttaatagaaatatagtaatagtaagcatccgagtaaaatagctgtttttttaacctggtgcagcatcacttaacaatttgcaaacaaaatctcatcgattcacttttaagtggtcttcctttatcccaccaatgatagttcctttagtttcacaaacagctcaaaaattattatttcttgttatatgtatgtatatacctgtcctttatacaggtaagaatatgatgttcaaaagatacctacagaagagtaacagcagaaaatattgaggcctttcttttaacctggtcattttcaaaaagctaaagttgagagtatgacaagtaaaacacatcatggaagaacctctaaaaatagtgtgttccagactaaatacacaagactttggatatgaaaactgaaaaatattattactgcatagtccaggtctatagacgctacaacatatatgataaattggggtaagagtttccttaaaaaaatttgatggtgccgttgtcactcaacctgaggcaggaaaaaagggtaacactggactgaggaaaaagcaagattcttctctaagagaggaagcaggtgatcctgaactcgagaaagaatctggtcaaaagagctctcactgttggagagctaaactggcttctgcagcatggcaaagggagacgacctggggaaagagggagacagagtcaagaaaaactgcctgttcaagagtgtggcctatgaatcctaggagatgcaatatctagtattgttttgttttcctcttctgcactgtgatgcccttctatcattgcaaggcccacaaaagagaaaaggagaggtctatgtccacgctttgggcaacaggataaagaaaaacagctactgcctggaaaagttgtttgtaagatgggaagaggtattctccagagctctgatacaactctatccagcaatagtgtagataggaacctgatggcagagataagagtcctagattcactgtggcacatataagcattcaatttccagagattacttgaagaaaaaaatagctgttattaaacacttaatatggattcagagtaatgggtacattaggtttatcaaatcccatttattcctgacaacatagctacaggtaaacatcattattatcctgatgtaaaggtgcagcagtggtgtcttacttcacatggtttagtgaatgacaatgccaagactagtcaacaattttatctgatgaggtagtcagagctaaggtcaactgctgcagagtaatcatgtctcactggttgggtattcaaaccctagcaatttggacattaaaaagaacttgaatacttgtcagttggttatactggtagaggttgagtatcccttatccaaaaattcaaaattcaaaatgctccaaaatctgaagctttttgagcaccaacatgaccctcaaagaaaatgctcattggagcattctgatttccaggttttcagattagagatattcaaccagtaatataatacaaatattccaaaatctttaaaaacctgaaatttgaaacacttctggtcccaagcattctggatacgggatactcaaccggcattttatctttcatatttattgatattatttttatcaaaggtgaagaaaataacaatgatagaaaacagaaaagccacaatttatatttgtatatatagtcatgcatggcttaatgacgagggcatacatcatactgtttatagcctaggagccatacaaatatgtacagtatgttactgtattaaatgttgtaggcaactataccacaatggtaagtatttgtatacctaaacacagaaaaggtatggtaaaaatgggtataaaacaaacaaaaaaaatggtacagggcacataccatgaatggagtttgcagcacttgaagttgcgttgggtcagtcagtgtacaagtagtgggtgaatgtgaaggtctaggatattactgtatactactgtagactttataaaccctgcacagttaggctatgctaagttaattagaaattattttcttcaataataaattatccttgctcactgtaacatttttacttcataaacttaaaattttttaaaattgtttaactcttttttaataacacagtttaaaatgcacattgtacagctgtgccaaaatgttttctttctttatatccttattctataatttccttttttttttttttgagacagagtcttgctctggtgagacagaggctagagtgcagtggcacgatcacagctaactacagcctcaactcactgggctcgagtgattctcccacttcagctttctgagtagctaggactacaggggtgtaccaccacacccctggctaacttttttattttttgtagagacaaggtctccctatgttgcccaagctggtctcaaactcctggactcaagcaatcctcccaccttgaccaaagtgctgggattacactgtgcctgatctataaaccttattctagtttcaaatttcattttttcaatttttaaattttgttaaaaagtgagacacaaacacacacattaggctaggcctatccagggtcaagataatgaatatcactgccttccacctctacatcttgtctcactggagggtctttggggcagtaacatgcatggagctctcatctcctatgatgacaatgccttcttctggaatacctcttgaaagacctgactgaggctgttctacagttaacatttttttttaataagtaaaaggaatacactctaaaataacaagcatagtatagtaaatacataaaccagttacacagtcgtttaatatcattaccaagtattatataattgtgctgcactttcatacgaatggaaacacaagtttgcttctgccagccttaccacaaacacgtgagtaatgagttacactatgacattacaatggctacaatgtcagtaggcaacaggagtttttcagctccattaaaatctcataggaccaccactgtacatgtggtgcgtcatttaccaaaacatcattatgtggtgcatgactgtgtatatataaagcaaatattgtcaagcttagcatttcgtggttcctatgctagagatgcagaaatataaataaagacattaactaaaatgtccaaaaccgccatggtagtagatatcaaaactggaatgagaattgacattctaatactttgctatcaagctatgatgacacaaaatctatcaatccatcatctcttcactaaatgacaaaagtgatcaacacaaagtgtatatcaagggaggaatgtgggaagagaaaggggtacattaatcactgaggcagaaccatcctgggccaaagaatggtattcttagttttaaaaaagttgtccttgactttgaccatccttcttctcactaagggtttttaagataaggtggccaactagaaacagaaaactataggggaaaaagttaggagaaaatcaagcgggagaataaagaagaaaagacaaacaggaaagcataaatagcaggttcacataaaattacttttgcactatttcctaattatgagtttactttaaaagctagtaagaaaaaatagtattataagatttcgtttgcactgtattttaaccactaaatgagaaacaaaatggggagttcaattcagtaatggtaaaaatgagataatggacaaaggtgggaaaaaagtttgtcatttaactaatctttacacagctcaagacattttgcactctaccaatttcacatgcacataggaaaaaacatataaagtcattagaaaagagcaaggtaaacagaaataacaaatattcaaggtgtagtttcaatcatcgacaaaagtgaatgaaaaggaaataccaagataattacataggtgagactccaaataactaatactgccattttacaacctatgttttagaataaaaatattacaagctacagatttgagactacactaatgagctttaaggaacctcatattattacaaagaaattaagtatcctatccaacactacatagttaattagtggcagaacaatgcctaaatcctagttcttacaaatcccaaatctgtgctttctatcatacactacagactgcaaaaacgattttacaacttacgtgtaattaaatattttaaattcatgctcttaagcatgaatttaaacatgctttaacaaaccaactcaacccttaaaaaaaatccaagtattatacaaagtccatatttcaaccatcaaattgttaagttcagaaataattttcatagagatttaaattccggccgggcatggtggctcacacctgtaatcccaacactttgggaggccaaggcagggggatcacctgagatcacaagttcgagaccaggctggccaacatagtgaagcccccatctctactaaaaatacaaaaattagccaggcgtcatagtggacgcctgtgatcccagctactcgggaggctgaggcgtaagaatcgcttgaaccctggagacagagattgcagtgagccaagatcgcaccactacactccaacctaggcgacagtgcgagacttcgtctccaaaagaaaaaaaaagtatttgcctttatacatcattaaatgctcattaagaaaaacagcgacaatccagtaagcaatgctagggaacaaagtgattactttcttacttgctgtatctactaggatacaaacagaaggtaatttttaatgaaacattatcttaatattaaagaatctaggatctcaaatgaaaaaactgattcctcaaatttatgttagctggatatggaaatcttctttaatcctaacatatgtcttctattactgacaatttcattcattcagcaattctttgggagcttcctatgttccaagcctataccagatgttgaaattaaaataaaacagaaccttttataaagaagtcaatatgtaatatttgtttccctcagtagtcaccaataatttcaaaacatttttaatggttaaaagtaattctcacaagttgtccaagaagaatataatccagaaattgctaatgtaacgtccataacaaaacaaaaggtagtaaaggtcagcctttaacgatttctcctacatgattgtaataagagaagtgatacatacaaaccatacagacccttacataagaaaatctcaagacagaatccataaacatgtaaaaattacatgtaaaatgtgttatatttgtatgaatttatcaaggttagattctcaaagagtccattagcccaaaaaaaaaaaagaactattaactcaaaatataaagaacagaacatttcacctaatatcccatttttgagccagactaagtggctcatgcctgtaatcccagcaattggagaggccaaggtgggaagatcacttgagtccaggagtttggaactctcctgcacaatatatagcaagaccccatctctacaaaaaaaaatttttttaatgttagccaggaatggtgaggcacacctgtagtcccagctaaccttggaggctgaggtgagagggtcacttgggcccaggggtttgaggctgcaatgcaccatgatcccaccactggacttcagcctaaaccacagagccagacgccgactcaaaacaattatgtgtgtattttatatttgttttatattatgaaatagatacacaaataaacactcataataaaaagcctaaaatgctatgtgccaaaacattgtcttgcctcttggtggggcaaagatactggagaaggttctctttttattattatcattattattattattatttactgttatatttttcttcttttctttgctacagtattctccagctcaaaaattaatgaattaaaacacaaaaagagccactgatctaaatcaaatttttcttaggtcagggtatttcaggttaaccttctgggaagtacctgaattctatttttaaaagaatttttgatttcatttatataatagtgccaataacaatagatttgggcatatctacattatacatatatagaagcatttcatatgcttatagttcttatacaaacacaatgaaataaattacaaaataagttgaagcagcagcacagaatttatattttttgtgattgtgtaaaatgaaatataatttgtaataaattgataatcactagattggactatcatgtaaaaatagcatcaaccaagccatgaaaattgttaaattcagtctatttaacaatgataattgataatgacaattaatgacaaaatttcttttgcataataagaatatgtgactcaaagtcatttttatagactaagatttcagtatttacttaacacatacagcagattctatactacggaaatggcttgttgtaccgagtaatgtaataattgtaatattgctggttacataaaaaaatgaattcacatgaagtgatgtatcatgtactacatgaataaaaatttgacagaagtttaaaaatagaaaagtaaaggcagattatggcacagacttcaagttatttgcccaaatcctcttcccccttcaatagtaccaggggctcctgattcttaagagccggtaaccgtctagaatgaagtgtatatttcccaatttcataccattttgcttttattaataaagctaatgaaaatctgggaaggaaaaacaatgaatttaagttttagacaaagtgaatataaacgggtaagaagacacctaggtaaagaaatatggcagatttttgaaaatgtgaaactggaaatgaggtctgcattatagtcagtaacattaaaggtgaatcccaccaaacctttaaaagagggtaattccaatgctacccaccctgtctctgggcatgaaaaaagaatggaaattgtaaagttattcacaagaggcaagtataacactgaagctaaaacctcacaaatgactaagattgcatagaaagttaaaacaaccacaacccaatttaagaatagaacatgacaattacaaacaaaacattagcagatacaatctggcaagattaaagaaaaaactaagaccaaaatatattggcataatattgacatatgtaacatcaaaaaaagtatactatgaatatcaactccactgctccacttaaggatgacaaaattgaacattcttcatttacagaaaaactccataaaaagtactaaataaatatttcattaaaatgataaagcatatatatatacttcagatcaaaggctatgtcatacttagtagggaaacactgaaacacctctgctaaagtcaggaacaagaaaaagatgctattattttttaacatcacactggtgatagaagtcaattcaattagacaaggaaacgtaattacaagaattaaagttggtaagttgataccaataaaagttggtaaaactatcaatatctgcagaagatgtgagtgcatgcctgaaaagcccaagagcatcaaatgaaaacactcttttgaatcagacgagctgaatctaatgttagattaacaagccaaagaattttgaaaaaagaaattcaaaagggcaataagaaggaggaagaggaggagaagcaagaggaacatagacctattagtatcaaaacacattgtaaagactcaataattaaattgattaatatgctagcttgacactagtatatgaaatcacacacagactaatgggaaaaaaatcaaactcgaaattgaccccaaacatacaggcatttagtatataacagtagcatcttaaatgaaaacttagactaccgggtaggtggcatagggaaaactaggtaggcatataaaataaattgaattaataacacaatctgtactaagataaattccaaataaattaaatatttaaatttaaagcaataaaactatagaaatattagaagaaacatatgggaattcctttataatctatgtgtttctacccttccaactaccaaacagaaattgagatccatgagagaaaatatccacacatttaacaaaaaaaaaaaatttaacttctgtaaggcaacaaaaaataccatcataactaaacaaacaaacaaattggtaaaaagaaagaaaaaattctaacatatatcacagagttgattccttaatacatgcagagcttctaaaacaaaatcaataagaaaagagacacaatcaatggaacagctgcaaaggacatgctcacagaaagggaaatactaaggttcagagatcatcaaactcactcataaaaaaccaaaaatgtagtttaaaacaacactgagaaatacaaattaaaactctacactaccatatataacctatgcaagtgacaaaagtccaaatatgcttcataacacattctataaggaaacattcacactttgttgatcaaagtataaaaattcttcagaaaataatattaagtttaaaaagcaaaatacagaacattatttataatatgctagcattcatacaaagaaagataggaatatgtatctctatttgagtgcatatgcataaagaaaccctgaaaaattcatctaacagtggttttctgtaaggataaggggtggaaggcatcctggaagagattagaaggagatttttcactgtgtgctttcttataattttttattttaaattacctatagaaaaaactaaatgaatagattgaaaaattttaaatacttaatatcttctatataaaagtttcagataaggtagacatgagattgttaaaacagcacagaaaagttaaaactacaaagaaagtattcctgtgaaagacctatacttttaaaaaagcaaaagaaattggatgaaactaataaaagattcatgagaaataaaaaaccaatcagaaaaacatcaagaaagtcaagcaaaaaaggagtttaaaaatggaagggtctgtcatcagtgtcaaaaactgcagagaccaaggaagataagaaataaaaaaggaccactgtatatataattagtagatcagtaatgatattgaaaacaacaagtttaatccatttgtcctagaattggggatgaaaaggagaggagagaagccaaactatgacactgaacagtggaagggggtgagacaataaagaccattctagcaaaaaagtctggtagaatcaaaaagcaagagagaaaatggaagcttgagaattccagcagcatttaaacaaggttatcaagctctagcatatgataattagacagaggcatgaatatataaatagtgagaagctgcaacatacttccagaaaggtcatttaaaataaaaaaattttcagtgtattaaataataacttcattcaaaataatacacaatttgctaaagaaaaccagacattagtcaataaatacaaaaattacctatgacatcaagtaaaagaaaataagtcctttcaatcaaaactactcttaacaataagcagcctatttcatacttaatgagggcctgcaactgatagttcataatattctggaaacaggtatcaaggcaaatctcacaagtaacaggcgcatcatctaaggatctttttcacattaagaatcctattagaaagaaaacactaaaaggtaattgaatttccctcagttatcttcatctctgtcagctcctgctacaataacttactctccagagcagagataactcaattctgttcagcaagcatatgttatgaatctccaaagcaaacttgtctaaatcattctggtcttctatcaaggttgcctgtggatatgaactctgacagaaagcaaacaaatttatttttatcttttcaataattcacttctttatgccttgatagaagaaatcatgagataaatatatggtctacagttatgttataaagtcgggctgaaatggtttccatgacttaaataaaagacttaatgaataatccttcttaaacacaaagaaaatggtatcaaaaaatagaattggtaaattacctgaagtttcaatttgtttatactgttgccagatccttattatgatctcacaaatgctagtttgactatttcatttttgaagctttatagtaaaacatgttttataaaatgctagaaaattgaatttttaaaaaagataccaacaaaataaataatagttcatatgagaaaatgcatttcttatcggtattttaagccagctggcattttataacagaaaagaattaaaaaggctatataatagagacaaaaattctatgagtgtgagtttcttaagttggggtatacatagatcattgctattcagaacaaaaaacaatccaaattcaaattgttaatgaatacaaccctttcagtcataatccctttcctttaacacaggttaaatttctcaaagattctggcttggctattcatgacctttaaattctacactagtggtcacaataatagcaacaatgataatcactaacacacttcataatgtgttttaacctacattatataattttactctccacaataaaccttttattaacgtttcattatatccatttcatagaagggaaattaagactcagagaggttcaatgaattttatccaatattctccagctaataaattgtgaagcctagaacccgaacatgtttttggaaaccatgttccttctatcacattgtaacacactgtttcaaaattaagttacccttaaacagcagagaaaatgtcaaaaaatgtagccaacaatgcgccttgaaattttgatgtaaagtgtgctaacttgtatttcataaatcaaatggcttatttcttcatttcaagcacaatcagtatgtttttggattgaagacctaaagcaacccattgcagtaatttgagacgctattattaacctataactcctgctaataataggctgaaaataattctaccttggcctttctcatgcataatccatttgtttccatagagaaccatccttactacttttaatcaggtaaaaaagaaatcaaatgtgtggactgtaattagtactcatttattgaataattatttactgagcacctactatgtataggcaatgtacaagtctctatggatatgttatgaatagacatagagttcttaccttcatgaagcacacaaaagaacgaggcaggaaataatcagggaataaaatatataattacaaacaattattaagtgctatgagatattataacagaaagatcttagttagatttacattgggtgattggtgggggtaaaggatgagaggcagagaaggcttctgtgtaaaagtgacacttgaaggaaaatctaaaagatgagtagaagatgaataaaagggtattgtgactaggagcaaaggtaaatggagaatgaggttttgtggttgatattaaggattgtaggtttaacctaagagcaatgggaaggaactggatgtttctatgcatgaacaacatatactaaatttcagaatgactacactggctattctgcgtaaaagaaagaaaatataggtggggaagaaaaataagacaagagattactccaaatgttttgaactatagatgtgatggttaagataacaaaacacagtattgataacaaatgtttttggaggcaaaataaacagaacttgatggtggacagacattaagtgtgtagtaagggaaaaaatgggtaatgggtgatttatgtaagcaagtaagtaaatggaagtgatatttctcagatgggaaaaaatggaggagtagttaacaggggaatatacagttttagaaagtctctccccaaaagtggggcttcttataagaaatttcaagtggcaattacaagtatacagtggtatcacacaggtttgaagctcggaaaagaagtcacaaagacaaaaatcagaaagttttagataataaacaaatgctaacaaaaatagggggaagaggtcctcagaaatattgggtcaaagtgaaaaaaaaatactatatttaattaccttaagataattttccattcacagaaaaaggatatattctggcccagctcttgattacaggtagtaaacatgagccaaagagacgtaccaaattccctatttttcttctttttcagataattagctaatctttatatattacttacatgtgaattactttgaccctaaacaaggcagtgaagaatgagtgctttacctcctacagctatctatcttcatgtaccaataacgtgaggaaagatgtagactcattaattagaagaaaaagaggcccttgtttattagaactacactttacgtctctgcttgcaaactcaacatatcagttcggttggctaaaggatactattattcaggctaagtttacagttctatctctgactgagagctaaatgtcccccaaaaagcaagttcatgaccacagattgcaccactaattcccaggagctatctcataaataagtaacagacgtataaaagaaagctacatcaaaaaaaatttgaaagtttcagtatgaaccccaatgaaaaaaaattgccttacctgaatatcttattaactagagggcagtgatatttgtatgcacagagagacccttttgtggttaaaaatcacaggtttcaggtataacataggaaacatagtgacacaaagaagtcaaatctaagaagttaattttttttttttttttgagaaagagtctcactgtgtcacccaggatggagtacagtggcaaaatctcagctcactacaacttccacctcccaggttcaaacaattctcctgccccagcatcttgagtagctggaactacaggtgtgcaccaccacacccagctaatttttttgtatttttagtagagaaggggtttcaccatgttggccaggctggtctcgaactcctgatctcaagtgatccacccacctcagcctcccaaaatgctgggattacaggtgtgagccaccacacccagctggaagttaaatttgcaaccacaatataatttcaagagttgtatttttaaaatagcattgtcaggtatgtcaaagcaaagtgccaagtttatttagtaagattcactaccttctagagaatatgtaagaaaccatcaataactataaataactattaaaaaacccatcaataactataaaggtacttatgtccagcagttgtaaaaattacttttaaacacatttctgtgtaacttctcctaccagagtaatgataattgggacacaaagtgccaaagtaaaaattatttgtgcaatgtaaaaaatacaggaacagaggcaataatatcaataaaagaccttttaaaatgctcagtatcatcaatgggtctcttctgaattcaaaagtttactcactgatgtttccaaggtttatgaaggtactcatttagaagagctcatcattatataatgacaccctatctagtccatttcttatcattaaggaagagaaatcattttttactcaattcttctggtgcaactcaaggacaggcagtatactgtagcgattaaaagagcagaacataaagttttgagttgaaatcactgagcaatttattaatcagtctttgtcttttcttcatctgtaaaacagagataataaataatgcccacctggctcatgggttatttattgtaaggattaaatgaatcaatgtatacctgacccataaaatgtatgcaataaatcatagctactattaatgttattagtatccccatcctcaacgtttgagtatccagttagggccaggccttgtaagtaatccttaaagatttaatgactacaaattccctaagttctaagatagtccagatacattaacatgttgatgactatattataggaataaaaaaataatgtgctcacaattgtttgaactaataaaaaaccctttagctgtctaaaggaatgccaatgtcctaatcaaaacataaagtgaggtaaaagtttacaattttttctccagaagtaatattttcatgtcatgttctctcctcagaaaattccttaacttgtcacctgacaaccaaatttcacatttactggcaagaacgaagcaccaaaaaagttcctgaatatagcaaaatatttactgccaaaaaattacgctacgattacaattctactggacaagacatgtaaaggagagaaaacagcaacatccctaaaaagcctttatcaaagaatactaccaagctacaaaacggcaaaacccaaagagattcctacttaataagcaaaataaggagtggttcttttccaatatatcacacacacatttaggaggaaacacaaaaacacacagaaacattatgtttcgaaaagccacaaagaaaaccagttttttggttttttggattttgtgtgttttgagatagggctttgctctgtcacctgggccatggtacagtggcccgattacagtgcactgcagcctcaaccacctggactcaagcaatctgcccacctcagcctcccaagcagccaagactacaggcatgtgccaccaagcccagctaatttttaaatttttgaagagatggggtcttgctatattactcatgctggtctcaaactgctggggtcatgcaatcctcctgctttgacctcctaaaaggctaggattataggcatgagccactgcatccagccacagttctttataattcaatcacaaaatgttgttggtatgatcatctgtaccataaagaaatataatcaatgacatctcagttcatcagccattgtcatacaaggcactgtttgctacacataggtagagaaggaaagttggcatattacattattctgtcctatgttcaggaggcaacattccttacaatttttcctgtgaagaggatttcaggaactcggaaaaatcactcaacaaaaggaaatgacaagcaaaaagtccaggagattgattttcaaacttttggttttggcagtactctttttgcctatgtaactgtaacgtggcaaagtataatgaaacctattcttttaaatttgtgttttaacaatatttgtctaataagtgaagtaaatttttatgcaagcccaagaatgtaatacagataaaatcatgtggcctatccctgttcacagtattgcctgagataccgtaagtgatgatctaaagcaatgagttttgaacatatcacttctagtttgatgaaattagggaggagttaaagggatttacaatgctaacagtgaaatagagacacttttattaaatcgacaaatacaattatcacattttccccatataaaaccaaagacatgaggaacagaaggatctctgggtaaatatgaaataaactttgaccatttgtggctgctgatggagatcagatgagtgtgctcctaacaaaaatattcaattagtttgtgagccagtctgatagtttagaggtgtgctattcaagaatggtcgatcaacgtttctgatgcaagtctaagtaccacttctttacactccacaatgagataagtatagaaattgagggaatttagaaaggtttatagcaagtagacatggccacagcatccaaccacataatcagtggactcatctcaataaagtttatgtcttactgaattccctttatgtggatactagttatgtacagtacaaatacattatgtctaatatttcaagaacagtttataatttgtaactcaaatgtacttgtttatataacatttttacaattattttaatgaaagctattattttaaatttatgttttaacagtatttgattaatatgggaagtaaattttttattatctagttttaacgatgtttacaattagcaaaacaaacttcactagacttatttgacaaaaaagacatgccttttcataatgtatcaatagtagcaaacaaatcataactgaagtaattacaagaaaagattccaatctaactaaaattttatatcctaaatttcaactaataggaggaatgagttcaagaaatctattgtacaacatggtgactctagttaataccaatgtattgtattcttaaaaattgctgagagtagatttcagtgttctcaacacagaaaaatgatatgtgaggtaatgcatatgttaattagctatgtttagccataatgtatacacacttcagaacatgttggtataatatttaatttttgctcattaaaatatatttttttccaatagaatttataccagttttagtctaaattaagattgctaatatagtgagttcagttttgagaaacaaggccatccacattcacctaacaagcagggttaaaaactgagacaccagagtcaatattatttcaccatttgtttcaggaaatcctaccccaggaagataagattgcaaagaacaaataacttcactgtttgcttcaggaacaccaatgtatttgaataataaactgcttatttagacaaacagtctcattttcagaacaataagttactcaggaaaaaatttcacttaccaactgtttactaatcaacacctacatcagaaccgttgcctcactttctcccaatcctaaaatcttctatgataaatttatacccaaccacaatcagacctcgtattgaaagacctaagatgtaaaccatttgagttcatacctagaaactctataaatacccaccccaacctctcaccctgagatccttctaagatactgtcaaggttgcattctcatttagtgcagtatataatcaacttagctttgccaggctattctggtggtggtcctgaacagttgagagatggcagtagttttgtagccataaataattaagaattaaaaagaaagtgtggctatgtgcaaagatgtaataaataaaataataaaaacaaacagtttaaataaaaactgcaaagaaaaatgttcaaagtcaaatgaaatattgaaaagaatactgaataagccaacaaaagcagacatttaatatttcacataaaaactacattgtttggtgtacttataaaataccacatcaggttgccaaaatttaaatatgtatattttatttgtatgttttgtgtgtgcacaattgccaagtgttagtgaaagactacatcataagcattttcttcaaaatgttggtgagttacagacacttgccaatgagaccagaactgaatgtattcaggaactgattaatgaacaattactaatagaacccaaaaactagctaagtacttttcattacaacttaaagactgcattgatattgctaagagaacattttgtttttaagaataagtgatatttgaacatgataatatgaaggaaaaatccttatgttttttagatgcactagtgacaaacacaactacattgctctgaagaccatccatacacccaagaagaattatactgtgagcaaatatgatttggagtctgactttcgtttaggaaatgttctgatgatatagctcgaaacaaacatcgtgtggtggttaagatttaagaagtggaaccagtttccttcatcaacaaagccttgataacaacaaaaaaaaaaatcacttacagtgtattagtgacaacataaaaattgctaattgggctgggcgcagtggctcatgcctgtaatcccagcactttgggaggccaaggcagatggatcacgagctcaggagttcaagaccaacctggccaagatggtgaaaccccgtctctactaaaaatacaaaatctagctgggcgtggttgtgggcacctgtaatcccagccactagtgaggctgaggcagagaattgcttgaaccaggcaggcggaggtttcagtgcataaaaaaaagaaaatagggtaaaaaataggtatgacctttgcattaccttcgcaacttgttttacatctatagttatttcaaattagtcaaaaacaaaaagcaaaatccaacgaagataaacagatgttcaagctaaacaataaatgactttcactctttacattttttattttctaaattttctatattaaaaaatacttcatttttataattagaaaaataaacacgtttaaatttaaaaatcgatcaatgaggagaaaagcagctacttaagaggaaaattgaataatttctcatgattagctctaaaattggtatatacagtaccctaaaatacataacactaaaatatgtaattgttaaaatgtttcacattcctttagaactgtcaagaatatgttcaataatagaatatattattacaatagcaaaacactgccatgaagtcgacagaggctatggggacagactgtactgggttattgttatgaaacctgggttctaattcagaatcatggatttaattgttctgtgatcaaagctaaatcacattctctcaatctaccttgcatacatacatcaaagatgtgttgtggtactgaaatgagacaatgtgtactaaatcacttaatagatgacgttaggccacatagcaaagagatcaccagtttatactgggtatcagactaccctggttcaagtccaagcttcatcatatactagctatatgacctaaaacaaaccactgagcctcgctgtagttttcttatctgtaaaattgggctgaagataataacatttacctcagaggactgttatgataatttattttatatttgttaagaattcagaaaaacaagtggtactatagaagtgtttatttttaaaaatttataagtactcacaaaaatgttcactattttaataaaaatattttgcttgctaattggaaaaaaatctttgaattcttcacctaaaaaatatatagattgctatatttgccagacatagtggctcatatatgtaatcccaccactttgggaggcttgagctcaggagcttgagaccagcctgggcaatatgacaaaaccgatctctacaaaaaacaaaacaaaaattagccaggtgtggtggtgtgcacatgtagtgccagctactcgggaggctgaggtgggaagatcacttgaatccaggaagctcagtttgcagtgagccaaaatcgcaccactacattccagcctgggtgacatagtgagactctgtctcaaaataacaataatagtaataataataataataataataataatcagtgctttcatggtctttatttaataaaaaaaaatactccatttttattacttcaaaaaaaccgagagaccacctggtttgcagttccactgaagctagcaacaagtgagttctacagtatgttagataaaattcaaagcaacattggcccaaagaccttttgaaaattcttactgaagttgattttaactcacatagattcctaaaagaaaaatcattaagtgataatcatcagtacatatgttttacagatatatcacattagtttaaagaaactaaaattctaaaagacaaccttctttacaaaaatgattgccaggaaacttgtatattcacacatgcacaatgtttacaaggtatgatgtttctgcatgacataatttttttcataaatattctgtttataaccataagattaagaaacaaagttaagatgtacagctcatcaatgatgtcatgacattcatggaacctctctgtaaaccaaaagcataaaatgtcaaggatatcccactccaatgataagcatgcaatgaactaaatagatgcacattgcagatctacactgtcatcaatcctctgataataaatgaaacaagtcagctactttacacacaaatcgtacattaaatagatgacaacatctttttttgcagaagaaggtaattagcagtagataaaattcagttatattatttaagaatgtacagcttgaattcaaggctgaatacagataacctctaagatataagctgtctcaaaaaaaaaatgcctcatcctgcagagtattgtttaagagcaatacagttagaacatgagcatacttcaaccaattgaagtttgttgaaaaagggtaaagactagcagacataagaaaaaatatacgtttgctctcttaaaattgactctgatgtagaagagatgaacaaatatattttctctgctaaaattttaagtaacaacaatatttatttggaaatatttcttgttttatttagaaattttattataacaccttaaaatactacacaatattgcaaatctcatagcacaatgattaaaatgaaaaactatattagacaaaacataaaattaaatagcttagaataaagctgcaatgtattcgaggattagatcctattcacacggtctttagaaatctaataaaatttgaaccaaattcatagattagtaattgggaaacagattacctggatctggatccaagttgtaactctaggttatttctacttcatgctattttcaaacttataaaatgagggataatatcagtactatctcagaggtttgttgtaagaattagttgctacttatatatacctctaatagctactgaaatagcataaggattcatgaaatattagctactgttggcaccatcattcctcaccgaaactgaaaatatatatacttttcagatcaaatcaatttaatctctttcacaacagagttttagaaacatttcttcaattttcaattccacatttccaccttcctcgttctctctcattcatacaccaattccacgtttactccatcattctctctcattcacacacaaaagaacacacactacccaccaccacaatcactaaatttcaaatttaaaaaaagtgcaatcttaacccatagttacaacaaagaaagcatctccataattaattagaaagtacactaagaaatagattccaggttaggatggtaggctgatattgcaattacatattttttccttcctcatttcctaaaaacaaattagcaaaaaataaataaataacaaaaaataatttttaaaaataatgaaacaatgtaaggaatgtaccataaatcaccaaacattaaaaaattggttgccaaggggaacaaaaacaaactggttctagaactgagggagcaacaaagcttagttcttaatcatgtccccatgcccccaaagcaatattggtaagttgacaaaattctgataattttcttaacgccttcaaatacagagagaaacaaactgagtaggtaacgttacctctttcctcttctacctggagatgccagaaaaacttacagaacaaatactggtgaagcaagaaattgaaaaatgcggctgattcactaaaacagaagtaaactcgactctactctcttaaatgactgagggaaatgattcaaagcctaagcacatcttcccatgagaactgtctatagtctaatgagatagaatgaacttggtagaaaatatttaacaaaatcttagaaaaaaatgaggatttctaagaaagactcctcacctatttcaaataagctcttcctcttcatgataggccataggatattctacaaaaatcaaactgtagctcaggagagggaaatattagctttacacagagaatggagagggaaataagtcactaagatatcctgttgtctaagccaacagaatatctgcacagagcattctaagaatgaacacaatggaacaaaaaagtatggtagttatacaaacatatagcaccaatcaatcaacaaataagttaatacataaatttaaaataaaacgttaatatagaaaagacaaaacatctgatgaaaaagtatctcaaggagtaaaagaaaattattcatgattattttttctaatgaacaacataacaaaaacataatgcaaataagataaaactcaaaataaagtgactaaggaaagaggctgaagtcctaaataaacaaaattaggaacaaaacataagctttatagacataataaataaattacaaataaatatcccggacaaaataaaacattaaaaatgtacttactggtggaaaaataaggctaaggatcaaagaaagtcaagcaactaaggaataactaatagatgtgaaagacaaacatatatctaacatattattaagtgttactaagcaagaaaaaacaaaataaagtgaaagtggtatttcaaagtataatctaaaaaattttctaagaactgaaggaaaaatcagaatctgctgattataacaagaaactatgtcccaggataatttgataaataatgttcaatactgaaccatattcctcttaaagaattttttggacaaagaaatcacaggcagaagacacaaaaagcaaatcagaaattaagggaaaatatcagactgtcctctgaaagcaacattcaaagtcagaagataacaaagcaatgtctgcaaagttctaagggaatttaagtgttacccaacaatattaagtcaagcaaggcagtcatggcacagaaagagggagatgttagagattacaatttgactgaggaacagaaggcgatcaaggccaactatcctccagttaataggaattatgagtatttggatcatacagcagatgtccagttacacacatggggagatactctggaggaagcatttgagcaatgtgcaatggccatatttggttacatgatagataccaggactgtggagcctctccaaacaatagaagtagaaacccaagaagtttctacttttctttttcactttttagatgagtggctttataagtccaatgctgatgaattcttcataccctgggaagtgaaagtactttgtattgatcaaagacatttccaattacaatcaattgggtggagagaagaattttcattgtccaatcaccctcagggaaccgaagtcaaagttataacatattcagcaatgcaggtctataataaagaaaacccagaagtttttgtgatcattgacatttaagaccaaaaaagaaaagactcctaagaagaactgggttttttttttttcctcttccttttgggaagacaatgtgaattaaattctatagtatcttatgaaatacagaaattgtagaacaaaaacttataactttatttatttacttatttttcctgagacagagtattgctctgtcccccaggctggagtgcagtggcacgatcttggctcactgcagcctctgccttccagattcaagcgattcccattactcagcctcccgagtagctgggactacaggcatgtgctacctcacgcctggctaattttcgtatttttggtagagatggggtttcatcttgttggccaggctggtcgcgaactcctgacctcaagtgatccgcccaccttggcctcccaaagtgctggaattataggtgtgagccaccacgaccagccagaaatttacaacttgaactgtgactttccaaaatggaaaattagggcatgtccttggtctgtgttccccaaatagtcaatctttaaagaattcttcaattcctacggggcagttatggtccttcatttgttgatcatctgctgtggcagcaagtgcctcatgcccttccattgcaatgcaagccttccaccctcccctcagaacagaatgctgatgtcagcagcagcctggtgctaaatccaatttggaaaaaaaaataatttgagaaaatatatttccacacccagaaaaaaatatataaagttaagcagaatgccattcaaatataaagatagcaggcaaatattcttaaacatggaagaactttaagtttacaacacatataagccccttgtggaaaaagaataaccatgaaatgcagccaattaagaactgagtcaaaagaaagaatctggaaattaagttccaactaataaagttggggaaaatgaagagtgagtattgaattcacttaaataaagaacaaatactcaagtactataagaaatgtgattataaacatgaatgttataaatttagacaatatgaaaattaaaatataactaaaaattaggaggtgaggggagagaaaataaaaggaacatacaagtgactaatatcctcagcctccataagagagtgtgaattgacatatgtaacataaaaatcaacatcagaggagggcagagcacgatggcagaatagaggcctatcccgtttgtccaccctgctgcaacaccaaattttaacaactatctgcacatagcaaagcaccatcactagaaccaaaaatcaggtgagcgatcacagtacttgtttttaacttcatatcatggaaagaggcattgaggggggcaggagagacagacttgaatcactgatgccacctctgccccatcgcccagcagtggccatgcactgcagacagaaactgcactttggggaaggagagctcaacgactggagaactttacattggtctcagtgctgccctgtcagagcaaagaataaagctatgctgggctccttccatagagggagcatgaggaccagccctagccagaggggaatgacatatcccaggggacagaacatgagtttcttggcaagcctcgccacgcaggctaaagtacactgggttcctagataaacttgaaaggaagtctaggacacaaggacggcaatttctaggctcctcctagtgctgggttgggctcagggccagtgaactagggtggcacatgacctagagacacaccagcttgcgtggctaaggaagtgcttgcattagccgtgccctaaccccagggagtgaagctcatagcaatgaaagttactccttgcttctgcttaatgagaggagagcaaagagtaaagaggactttgacttgcattttggataccagctcagccacagtaggatagggcaccaggcagagtcatgaggccccgttccaggccttagctctcagatgatatttcatttctagacacaacctggaccaaaagtgaacccagtgccttgaaggtaaggatccagtcctggtaggattcatcacctgcagattaaagaactcttgggccctgaataaccagcagtgataacgaagggaatataccatgtgtcttgggctttgagacttactagcttcaggggtgacccagcatattcccagctatggtgcctacagtgaaatactactaatgtttcagaaaagcagagggaaaaataaagggaactttgtcttgcatcctatgtaccagctcggctacatgggggtagagcaataagctggctcttggggtcccaaagtccaggcttaggctcttggacagcatttccagatgtgctttgggacagaggggagctcactgacctaaagagcgagtctcaggcctggcagcattcatcacaagctgacagaagagcccctaggctctcagtaaacatcagtggtggcctgaaggaatcccctgtggaccggtggtgggggtggccacagggaaaggcagctctgcctgtggaaagtgaagagtaggaaagactttgtattgtggtttgagtgcaggcataatgacagtagaatagaatatcaggaaaattgctaagctgtttaactccagtccctggctcccagacagcactttggacattcccggagcctgtgggaactcacggccctgaagggaagaaactggggcaagacctagtgctgtgcaggtttcaggtctaacccagtgcagccctagtggtggtggccacagacttacttgcatcaccacacccccagttgcaggtggctcagcaaagagagacagaccctgtttgtatgggagaaagggaaaagaacaagagcctctggctggtaatccagataattcttccacatcttatctaagaccaccaaaatggtacctctacgagtcagcaaaaaacacagccttattggggttggggtccaagtcctttcaaatacctggaaagccttcccaaggacaacagtcacaaacaagcccagactgtgaagactacaataaatacctaactcttcaatgctcatacactgaagaacattagcaagtataaacatcatccatgaaaacatgacctcaccaatgaactaaataaggcaccaggaaccaattctgacgaaacagagacatatgacaactaagatagttaattcaaaatagctgttttgaggcaactcaaagaaattcaagataacacagagaagaaattcagaattttatcagataaatttaacaaaaggattaaattttttttttaaatcaagcagaatgagtagggaggtggagtttacagtgagttgatatcccaccactgcactgcagcctgggtgatagagccagaccctgtctcaaaaaataaaataaaataaatttaaatatatgtatatatatacatatatatatgtatatatatacacacacacacacacacatacatatagcagaaattctataattgaaaaatgcaataacatgctgaagaatgcatcagagtcatcagagtctcttaatagcagaactgatcaagaaggaagtagtgagcttgaagacaggctatttgaaaatacatagaggagagaaaaaggaataagaaaaaatgaagcatgcctacaaaatcagaaaacagcttcaaaggggcaaatctaagagttaatagctttaaagaagaggtagataaaaagagaggggtagaaagtctattcaaaagaataatcagagaactttcccaaccttgagaaagatatcaaattcaagtaaaagaagcttatagaacagcaagcagaaagaagattacctctgggcatctaataatctaaaggtcaagaataaagaaaggatcctaaatgcagcaagagaaaagaaatcacatacaatggtgcttcaatacatctggcagcagacttttcagcggaaaccttacaggccacaagagtggcaagacatatttaaagtgctgaaagaaaaacacttttactctagaatagtatatccagtgaaaatatcctttaagcatgaaggagataaaaagactttcccagtcaaacaaacgctaaaggatttcatcaacaccaggcgtgtcctaaaagaaatgctaaagggagctctacaatctgaaagacaaggatgttcatgagcaagaagaaaccatctgaaggtacaaatctcactggtaatagtaagcacacagaaaagcacaggatagtattacattgtaattggagtgtataaataaaccaagtagaaagactaaataatgaaccaatgaataataactacaaaaacttttccagacatagatagtacagtgagataaaaagaaaaacaacagaaagtttaaaactagagagacaaagttacagcatagagtttttattaggttcctttttgtgtgtttgtttctttatgcaatcagtgtgaagtgaagttgccattagttttacataacaggttataagattgtgttggcaagccttgtaataacctcaaactgaaacaaataaaatgggtacacaaaatataaaaagcaagaaattaaatcataccaccagagaaaaccaccttcactacaaggaagacaaggaaagaaaaaaggaagagaagtctgcaaaacaaccagaaagcaaataacaaaatggcagtagtaagtctctacttatcaataataacattaaatgtaaatggactaaactctccaatcaaaagaaataaagtggctgaatgaattaaaaaacaagacctaatgatctgttgcttgtaagaaacacacttcacctataaagttacacatagactgaagataaagagacgaaaacagatattccaagtcagtgaaacaaaacagagcaggagtagttacatttaatcagataaaatagatttcaagacaaaaattgtaaaaagagacaaagacggtcattatatagtgataaaggggtcaatccagcaagaggatataacgattgtaaataaatatgcactgtattagtccgttttcacactgctataaagaactacccaagactgggtaatttataaaggaaagaggtttaattgactcacagatccatgtggttgggaggcctcaggaaacttacaatcatggtcgaaggggaaactggcaccttcttcacaagttggcaggaaagagaagagtgaaggaggaatttccaaacacttataaaatcatcagatctcatgagaactcactattacgagaacatcatggaagaaactgccccccagtgatccaatcacttgcctcccttgacacatggggatcataggtccctccctcaacacgtggggattacaattcaagatgagatttggatggggacacagagccaaaccatatcatgcacccaacactggagcaactaaatatataaggaaaatattatgagaactaatgagagagatagactccaatacaataatagctagacacatcaaaatatcccactttcagcattgggcagatctcacggacaaaaaaaaaaaaatcaaaaaagaaacagcagacttcatctgtactacagaacaagtggatctaaagttatttacagaacatttcgttgtttttttttttttttttttttttgagatggagtcttgctctgtcacccaggctggagtgcagtggcatgattctcagctcaccgcaacctccatcttccacgttcaagcaattctcctacctcagcctcctgagcagctgggattacaggtgcatgccaccacactcagctaatttttgtatttttagtagagacggggtttcgccatgttggccaggctggtctcaaactcctgacctcaggtgatccacctgcctcagcctcccaaagtgctgggattacaggtgtgacccaccacgcccagccagatatttacagaacattgcatccagtagctacagaatacacattcttctcctcagcacatgggtcattctcaggaacagaccatacgttaggtcacaaaacaagtcttaaaacactcaaaaaacctgaaatatcaagcatcttctctgaccacaatgaaatataactacaaatcaataataacaggaatattaaaaactatacaaatatattgaaattaaacaatatgttcctgaatcaccagtgtaatgatgaagaaattaagaataaaattgaaaaacttcttcaaacaaatgataataaaaacacaacatactaaagcatacaggatacagcaaaagcactattaagaagagaatttatagctataaatgcccgtgtcaaaaaaaaagaaaatcttcaaataaataacctaataatgcatcttaaagaactagaaaagtaacagtaaactgaactcaaaattagtagaagaaaagaaatacttaagttcagagcagaaataaatgaatttgaaatgaagaaaacaatacagaagagtgattaaacaaaaagttggcttcttgaaaagataaacaaaattggcaaccttttagtgagactaagaaaaagagaagatccaaacaaatgatatcagatatgaaaagggagacattacaactgatacggtagaaattcaaaggatcattagtggctactatgagcaactatatgtcaataaatttggaaaatctagaagaaatggatcaattcctagatacataaacctaccaagattgaaccattaagaaatctaaaacctaacagaccaataacaagtgacaagagtgaagccttaataaaaagtatcccagtaaagaaaagcctggggccagatggcttcactgaattctaccaaacattttaagaactaataccaatcctactctaagtattccaaaaaatagaggagggaagaattccacactaattctacaaggccaatattaccctgataccaaaatcaaagacatattaaaaaaagaaaactataggccaatctcactggtgaatattgatgcaaaaatcctcaagaaaatactagcaagctgaatttaaaaatacattaaaaaggtcattaatcatgaccaagtgggatttatcctaggggtggaaggatggttcaatgtatgcaaatcaatcaatcaatgtgatacatgatatcaacagaatgaaggataaaaaaatgatcatttcaattgatgctgaaaaagcatctgataaagtacaacatccgttcatgataaaaaccctcaaaaaaaaaaaacgtgatacaaatggaatatgccttaacataataagccatatatgacagacccacaaccagtatcatactgaatggagaaaactgaaagcatttcctctaagatctggaacatgacaagaacatgtactttcaccactattattcaacatagaactggaagccttagctagagtaatccaacaagagaaggagataaagagcatttaaattggaaaggagtaagtcaaattatctttatttgcagatgatgtgatcttatttttagaaaaacctagaatccaccaaaaaactataagaactgataaacaaattcagtaaagttgcagtatacaaaaaccaacatacaaaaatgagtagtggccagacatgatggctcatgtctataatcccagcactttgtgaagataaggaggtggactgcttgagcccaggagttcgagaccagctgggcaacatggtaaaaccctgcctctataaaaaacacaaaaattagccggacatagtggcacatgcctgtagtgacagctactcaggatactgaggtgggcagactgagcccagaagctcaaggctgcagtgagccatgactgtcactgcaacccagcctgggtgacaaagtgagatcccatctcaagcaatcaatcaatatcagtagcatatctatatgccaacagtgaacaatctgaacatgaattcaaaaaagtaatcccatttacaatagaaacatacaaaattaaatacctagaaataaattttacaaaagtggtgaaagatctctataataaaaactataaatcactgataaaagaaattgaagagaatataaaaaaatggaaggatattctatgtttatggattggaaaatcaatactgttaaaatatccatattaaacaaagtaatctacagattcaatgcaatctctatcaaaatactaatgacattcttcaaagaaataaaacaaaaccctaaaatttatgtggaatcacaagagactcaaaatagccaaagctatcctgagcaaaaagaataaaactggaggaatcagattatctgacttcaaattatattactgagttatagtaaccaaaacagaatggtattagaataaaaacagacacataaaccaatggaacaaaaagaggacccagaaacaaatccacacagctacaggaaatgaattttcaacaaaggtgccaagaacaaacattggagaaaagacactctcttcaatatatggcactgggaaagctagttatccatatgcagaagaatgaaccttgatccctacacctcacaccttatgtaaaaatcaaatcaaaatagattaaagacttaaatctaagacttcaaactgtgaaactactacaaaaaaaactgaggaaactctccaggacattggtctgagcaaaaatttcttcagtaataccccatagtcacaagcaaccaaagcaaaaatgaataaatgggatgatatcaagttaaaaagctactgcagagcaaaggaaacagtcaacaaagtgaagagacaacccatagaatggaagaaaatatttgcaaagctacccatctgacaagagattaataagcagaatatgtaaataactcaaacaactgtataggaaaaagtaataatccaatttaaaaatgggcaaaatatttgaatagacgtttctcaacagaagacatataaatggcaaacaggcacatgaaaaggtgttcaggccgggtgcagtggctcatgtctgtaatgccagaactttgggaggccaaagcaggcagatcaattgaggccaggagtttgggaccagcctggccaacatggtaaaatcccatctctactaaaaatacaaaaattagctaggcatgatggcacaggcctttaatcccagctacttgggtggctgagccatgagaatcccctgaaccagggaggtggaggttgcagtgagccaagatcgcatcactgcactccagcctgcgtgacagagtgaggctctgaaaaaaaaaaaaaaaaagaaagaaaagaaaagagaaaagaaagaaaaagtgttcaagggccaggcactgtgactcacacctgtaatctcagcactttgggaggctgatgaaggcagatcacttgaggccaggagttcaagaccagcctgaccaacacagcgaaaccccatctctactacaaatagaaaaattagccgggtgtggtggcacaggcctgtaatcccagctacttgggtggctgagtcatgagaatcgcctgaaccagggcagtggaggttgcagtgagccaagatcatgtcactgtacttcagcctgggcaacatagcaagactctgtctcaaaaaacaaaacaaaacaaaagatgctcaaaatcattgatcatcacagaaatgcaaatcaaaagtaccatgagatatcatctcactcgagttaaaatggcttgtatccaaaagtcaggtaataacaaacgctgtcgaggatgtggagaaaaaggaacccacatacactattggtggagtgtaaattagtaaaaaccaccatgagaacagtctggaggtccctcagaaaactaaaatagagctaccgtatgatccagcaatcccactgctaggtatatatccaaaagaaaggaaatcagtatattgaagatatatctgtactctcatgtttgttgcagcactgtttacaatggctaagatttagaagcaacctatatgtccagcaaaagatgaatggataaagaaaatgtggtacttacacacaatggagtactagtcagccataaaaaggaatgagattctttcccatttgcaacaacatggatgaaaatggagatcattatgttaagtgaaataagctatgcgcagaaagacaaacatcgcatgttctcacttatttgtgggatctaaaaatcaaaacaattgaacttgttcagttgaactctgaacaattgaactctgagttcaaaacagttttactcagagagacagtagaaggatggttaccagaggctaggaagggtagtgagggtgtcacgggtaggtgacgatgatctataggtataaaaaaaacagaacaaatgagtaagatctaatatttgatagcacaacaggagacaatagtcaataataatttaattgtgcattttaaagcaactaaaatggtgtatctggattgtttgtaacccaaaggataaatacttgaagagatggatacccaatattccatgatgtgattattatgcactgcattcctgtaccaaaatatctcatgtactacataaatatatatacctactatgtacccacaaatattacaacgaaaagaaataataaaaaatcaatgacataattacactgaaaataattaactaaaatggcttggtggaattctatgtcaaaactcatgtttaaaaactgaagccatcaacctcttaattttttcataatttattaaccttctattctttcagaaaataattttcctttacttaaagaaacatttccttgttttttccataattattattttgctaaattttatacaatactgcaataaatagccatgtatacctatctttaaatactattatttttaattcctaacagatatattcacaaaaataggattactcggtaaatgggtatttgcatgtttgtgagtgtcaatgtaattttttaatagctatgactatactgctttcccttaagactaaaaatgtactttctgttaacaatacaaaagaacagcattgcccatttcatctctcttattcacttcaacagtacgttatcattctttttactgtctctcaaccgaagaacggaaaattgatagataataatttatctaatttacataggaatccttttcatatgtttactggtcacttttaggttcttttgtgaatttcttattgatatcatctgagtttctgtctattgggttgtttttcttataagaattattagtacagtgaatatattaatcatttatcagtcataggcattatgtttttccaagttgttgatggtatctttcctccacttaatgttataggtagtaatagatgtctacttttttatttctactttctaaatatcctacattttggttatcaaattcacacatatgcccaagttctacttttacagttttccaaatatgtttctgaagtatttatcatgtcatcttcctccctattgcttatttcatctggaagaattttaatatatgctgtctttttagtgatgttttaatttctggagaggcaagtatatcccattactttttcacaaattgtaggactacattaaagcatttattttcccacattaactgaatatttaaatatccaaatataatagttgtgtcttaaatttgttataaagaatatttaaatgtcaaatcaactctactgttattttaatggagtgctttactaatggatattgcactgagtttacatactgacttgagaaaaatgaacatttttgtgacgtaaaattttctctctttggctataaaagacagtgtggagtcttttttccagttggaaaactggaaaaatacaagtaatgttggtatattaagtaacagcatcctgccaatgttaattttctgattttgataactgtaccagattaagacagagaatgtgcttaggaaatttccactgaagtattttgaggtagaagggaatcctgactttaacttactctcaaaattcagaaaaacaaagcataaagagaaagagaataaatgtcgtaaaaatttaacaatcacaagatctgggagaacagtgaataggagttcctgctttattcttacaactttcctgaaagcctcaaattatttcaaaacaaaagactgattctgtctctctctctctctctctctcacacacacacacacacacacacctcaagaccccaagacagactatccagcatggaattagtttatattttatcttatttgctttaataaaattttgtagcttcattccaaagagcatgtgtacttttcttgcagaatttggcccaaaacattgtttttgtcatatttatgaatacactgtatttctgatttccattcttagctggttactgactgtcaaagaaaagctattaattttttgcataactatctcatacctaataacctcaccaaattctcttattaactctggtagaaaaatgttcaagatccaggtacacctcaggacacaggaattagattttcctagaccacagcattagaaatttgaaagtaatcttctttctttctttactagcatttatattagctgtatcttgcacttgcaagaacatcaaaaaatatgttaacaacagtgacagtaggtatcactcatttttcctgattttaaaagagatgactttaatcatttaaaatgatatttaatagtctttaccatatttgtattgttttcttatataaatctttttctgtgagttttaatacggctggcagctaacaatcatcatatgctttttttctacctttactgatatcttcgtgttttttctatttttaatttgttgatataatttattttgcaggtagatatcctaaagtaaacaattttgtaattccagtaaaaattttcagtcatcatactatataattcattctttatattgatgaattatgttatttaaagttatagtttaaattttgtacttatattcttaagtgaaattggtcttctagagttttatttttctagaataattttcagatttgctggttgtataaaattcacttggaagatttttcatcttttctaatgtaccagaaaaatgtcagcaacatatgagtttatctgttcttgatatgttagaagccatacagtgcttttaaatatttttccaattctatagcaaatgtactacttgtcaaattttctagttcaccttaggtgaatttgggtcatttctatagctacaaaaccattaatttcctctagaaatttgtatttcttatacatgttcaggcacaactactgagataagcaatggtcccaggatgagtttatcacttagtcctctcctatgagaatccaaggagagaggtgtgtgctccctcatttcctcagctacaaatactgttacgctctcaaaccctaaagacagagaaatttcacacccctgtgttcagctcctctctagaaacctggatgatcttacctttgccatagagattttcatttctggctaactagctctgttttgtccagaaagggccaactccttcaccagttttctttataggaaaaccatcagagccaagatttacctctgattattaagattagagcagccaaacaagaagcttctctgatcaagcttctgtggtagctcaactacaattgagacaagagggctaaagagacatgtactatctcccagaacccccatgactctcctataaacctagattttaattttttgatgacatatactatgtttctttggacctgccattttaccgggacaatttctcatgattatcattaaaaaacggtaacttccgcacaccaaccatatgtgtaacctacctcaaattccgcatgtctgtgaatatcttctgctctctgcctgctcaggataaattcagcttcatttgctactcttactagatgatccttcattgtctggctaagcaacctgtaagaaatgaatgttatcaaataaatatatgtatacacacacaacataaatgattattcactgcttacggtggagaggaaggaatacttactttcttcttttgacatcatacacaatgaggtaccattatttcatgctaaataattgaggaatgtaacaacagcaaaaggttacccttctggcaatagcagattagcttctatcagactagccatgtaacaaaagcaactaaaaatactggattaaagttgtgttttaatcttttaaaatgcactggaaagttaccaaggcagccaaaattaaccagtgaagatcacagagaagaaagcacacaaaggacaatcagtgtgactttttacattaaggcatttgctattcccaagtgagaacagaaaagctacacagacctgtcactagtctcacaaagataaatagaaaaaaattgaggttcacagtctgtcaaggtggaggagtcccggtagactacccaagagttacagcaggaatcaagtgtaccccagaaagcaagaaatagaccaggcctcaaaacactgaaacagaccttcagagatttggtgattggtatttaggttaactggcagccaaaaagctaagcaaagctttcagggtggggagaaaaaaatcagaaataccaatgcaggagggccatggcaaaaccccaggttttcagagtacctcagaagggctacacactaggagaaggcaaacaaaataggccaaactctcacaagaacttaaaaataaaaacccagccttgagtcagctcagaccctaaattaatacaatcggccattagtctaactgctaatcagaaaccaaaaggaagtcctttctaaaggaagataatatcatagagacttaaatttacccttgccattttaaaatacaattttcagcattcagtcaccaattaataggcacaagagacaatatcatacgaatggaaactaaatagaaactggctcacatctggacattgaaataaatatagttaatatgtttagaactaattgtgtaacagagaattccagtaaagaatgaaaactgtagaagaactgaaaaaaaataaataaatataaaaatagatttactgggttattaagctcagccaaaaaaggaaaaatttactgaaagataggtcaatgacaactagactgaaacatagtaagaaaaattaatgaaaattgaacaaaataaataacagacatataggacatggtaaaagaatctaatgtaagtgtatctgtagtataagaaagagtagatacataattagaaaaaagcaatatttgaagagataatggccaagatttttcaaaactgggaaaaaacactgagccatatgttgatggagtgctacaaaacccaagcagggtttttaaggataccctgcttaggcagtaatagtaaaactatcaaagaaaaaaattcttaatagcagacagcgggagaggccttcaaaagagcaacaataagcctaatggaagccagataagaatgcaatgacctatttgaaatactaaacaaaaatactacctaaaaggccaggccagtggctcacacctgtaatcccagcactttgggaggtccgggcgagaggatcacatgaggccagtagttcaagaccagccttggcaatgtagtgagatcccatctctaccaagaaagttttttttaattagcgaggcatggtagtgcatgcctatggtcccagctactcaggagcctgaggcagaagcatcacttgagtcaatgagtttcaagttatagtgagctatgatcacaccatggcacttcagcctgagcaacagagagagatcctctctcaaaaccaaccaaccaaccacctaagaattctatcctcttcaagaccagcctgggtaacatagtgaaaccctgtctctactaaaaatataaaaattagccaggcatgatggcaggtgcctataatcccagatactagggaggctgaggtggaagaatggcttgaacttgggtggcggagcttgcagtgagcccagattgcaccattgcgctccagcctgggtgacagagcgagactccgacagaacgaatgaacaaacgaatgaacgaacgaaggaaaaagagagagagagaaaggaaagaaaagaaaaaagaaaagaaaagaaagacgaaagaaagagagagagaaagaaaagcattctatcctcagtaagtatccttcaataatgagatttaaagggtcaagagtataccactgtgggaaaaaaaaaagagtatttttctgaactttctttatccacctaaatgaagaagctcccaaaagaatttagctttcatcaatcccttcccagggagttttgcaaccaaggaagattgactattgtcagtaaagatgagaagttagtaccaggatgagaaattatctaaatagacattgatacaaaactataatatcacttaactattctcctaagggcccacttactgttcacaaaatcattagctttcccaaatgtgcccttcattacttcacttttaccctattaaaatggtatgtatataaccccaaattctaaccccctcctcaagtcacatttttctctgaatcttttttttttttttttttttttttctgagacgaagtttcgctctgtcgcccaggctgggtataatggcacaatctcgggtcactgcaacctctgcctcctgggttcaagcgattctcctgcctcaacctcctgagtagctgggattacaagtattcacaatcatgccaggctaatttttgtatttttagtagagacggggtttcaccatgttagccagggtggtcttgaactcctgacctcaggtgatccgcccgccttggcctcccaaagtgctgggatttcaggtgtgagacacagcagccggccgaattctgacagacttatgactaaaaataggtcttttttcttgctaagctgtgtttgtctgtttaattcacaggtccccaaacaacaaacctaagagggtagaggaaaacttttcctcatcatcaaaagcaaaataagaacattccatgacaaataaaatagtgagaatttgtcaccagccaaccaacatacttcacaaggatgaaaaataatataagattgatacaagtcaaggaaaacaattggagcaatgaaaatgacaaacgtgggtaaatctaaaagtatactgaatgtttacaataattatgtaacttctagaattaaaaaatactgcaatctaaaatatataaccacagcatacaaggcaagagaaaccaactgaattagtgttataagtttcttgtgtcatacatcaattggcaaaagaatcagtttatgtaagatgttaattataatattcatactacaatctctgggtaaccactaaagttatttaaaataatatataaccaacaagccaatgggaaaaaaattaagcaacaaatacttagctcagaagaaggaaaaaaaaaagaaacacaagatgtggagcaaatataaaggacataaataataagatgataaattttaacctaaacatatcagaaatacatagaaagtaaacatttagtagtaaaattattgtcaaatcaattttttaaggcatatgatgcttgtaagtgacacaatttcaatataaggttaaacaaagattgaaaagtataatttcagaaaacatgaacaatttttaaaagctaaaaggtaataaactttttttagtatgagaagcaaacagaaataaaataaacctgttaaattaataaaaggataaatgaactagagatacagaaatttagtattttgagattctaaatttgtatgctcttaagaatatggcctactaccagatatagaatatataaagctatagaatattttttaacctgacctgactgacatatcgagaacattatacccagtaagtgaataataaatattattttcaggtaaacatggaacatattaaaaaaaacaggcaaaatgcggggtcacaaagcaatttacagtgaatttcaaatgatggaatcatactcagtatgttctttgatacatttcaattaaactagaaataacaggatacagatcactctgcaagaagctctaagctgaccactgactttcctaacctcctggtatccacagcattatgtaatcttcccctttagagtgtaagaaggagatggggcttgcctcgaagcaagaaaatatggcaacaatgaaggaataacacttcaataattacattaaataagatggtaacttgcatcttgctagcagactctattgacgctctcccttaatggcttagctaaagaaagctgtcatgttatgagctgccctgtgtaaaggcctccatggcaaggagctgagtagagccccagacaacagcccgcaaagaattcagactctcagtctaacgactcaaaaggaagtgaatcctgccaacaatcacatgatcatggaagcagatcctttcctagtcaaacatcaaataagactgcaactctggccagcacctcaattgcagccttgtaagtgaacctgaaggagaggcccagctaagccatgcctaggattcctgaccaagaaaaattgagataacaaatgtatgtttctttaaggctaagttgtgataatattgttaacacagcagtcgctaagtaatatcatttcatgtctaaaaattaaagaatgcacctctgaaaaaaacgcacacataaaagaatacatcataatggaaattaggaaacgtttgcagtaaaacatagtaaaaacaatgtgccaaaatctgtggatttagataaaccttaaaccaatgcttagagggaaattgatacactgaataaaaacactaaagaagaaaaaaattgtcaaaataaattatgcaagtattgaactgaagaaatcagaaaaagaacagccagtgaacactgaaagttaaataaggataagaacagaaattaaatagaaaataaaaaatacactttagaagataaagttaacagttagttatttgaaatactgaaaaaatccaaaagaaaaatgtaaacaattaaaagtaataattgaatttaggagggtcactggatttaaggcaaatacacaaaaatcaactagattatatgtataggttactaacaaagtaaaaatggtttttaaatactattttgaaaagcattcaaaaccatcaaaatatgtaggaaaaagaaacaaaaatgtgctagaattctgcatgtcaaacagaaagaatggtaaaaaaaaaaaaaaaagttaaaacttaaagaaaaaagtataccatgttcatgaaagggaaaggcttgtattaaagatatcaattctccacaaagctatttatagatacagtccaatcaaaatcctagcaggtctttctgcataatctgatgagttcaaatttaattctaaaatctatagaaaatgtaaacaaacaagaatacatgagacattcttaaagaggggaagagagatgataataatgataatgatattaaaagacttataagtaagatggtcttttccaaaaactggtcttagatcaatcaactgatgctcatatggacaaattaaccctgacttctacctcaaaccatacaaacaaaccaattccaaatgaatcctagacaagacctaaagatttcaggaagtttaaaaagtttctagaagattacataagagagcatcttcctgactgggtcgatgtaaagacttactgcaccaaacaaaaatacacaaaacataagaaaaatagtgacaaaatgaactacatcaaaatttaaagacttgtgcttatgaaagccaccactaagagaattaaaagccaaacttcagagagagagaatatacttggaaaaattacaaccaacgaggaactgctatcttaaatatattaaaaagcctcttacaaataaaagaaaatgatcacaatttttaaaatgggaaaagtacacaagcacttcacaaaagaagatttccaaatggtgaataagattatgaaaagttgttcaggattactagtcatcaaggaaataaaacttaaaaccataagatatactatactccacagaatggctatatatgtttaaaaggctggcatcaccaagttatatcaaagatgtgaagtaacagggactcttataatcacaaaatcgattaataaaaatgttcatggcaattatttacaatagccaaacactagcaactacccaaatgtccattaaaaataaaactaatttttaaaatgttggactttcataaagtaaaatgctaagtaggaaaaaaaagaatcaatattatgcataacaatatgaatttcactaacaatatgaatttcactaacaatattgagcaaaagcacacaaaaaatataaaatgtatgaattgccttgtataaagataaaaatttttaaaaacaaaactatggtattagaagttaagagattaagaaatggtaaccttcagtgctacctctccatatgaggactcacacggaacactgataatggccacggagttctaaatattttaataaaatgtcttagatgtataaacaaacgacccattctgattagcgcttttataacaccatttacttataaacatatcaacagaatgattcactttatgtaatctggaacatttttgatatgtataggtcttctaaacttccttctttaataggagttgagaacatagagcgggcagggatagaattattattattatcattattattattattattattttttttttttagggacagagtctcgctctgtcacccaggctggagtgcagtggtgcaattatggctcacagaaacctcaacctcccaagctcaagtgatctgcctacctcagcctgctgagtagctgggactatatacatgtgccatcgtaccctgtaagttattttggtggtgttgtagagacagggtctcactatgttgcctatattggtctcaaactcctgagctcaagtgatcctcctgccttagcttcccaaagtgctgaaattatgggcatgaacatacatggcctgcaaggattatttttttaaatttatataacaaaagtggctaaactgccactagaaaatgcccacctacaaaagttacacctagcagtcatcaacaatgacatgaacttactcccattccacagggcacttgcctcactttgtagcaatgttttcatttaaaatataaataaggccaggtacagtggctcatgcctacaatcccagcacgtagaaaagagactccttgagccccaggagtttgagacaagcctgggtaaaataaagagacttcttctctacaaaaaaacaccaaaaacaacaaaattagctgagcatggtggtacacatctgtagtctcagctactcaaaaggccaaggcaggagaatcacctaagcccaggaggtagaggctacagtgaaccatgatggcatcactgcactgcagccagggcgacaaagtaagaacctgtctcaaaacaaaaaacaaaacaaaaacaaaaaaagagcaaacataaacttggatccaaagcaattgtcacaaaaattgtttttatttttttggagatagagtctcactctgttgcccaggctagagtacagtgacaggatctcagctcactgcaacctccgctccctgggtacaagtgattatcatgtctcagcctcccaagtagctggaattacaggtacatgagtcaccacccccggctaatttttgtatttttagtagaggtggggtttcaccatgttggccaggctggtcttgaattcctgacctaaagtgatccacttgctttggccttccagggtgctgggattacaggcgtgagccaccgcgcctggccagcagtcttaataatgcgctatatgaacatgttcccacaatgcagaaaaacatgtggaaaatattcctcatgaatcaattaatttcactacaacactatttatgaaagtgagaatcttaaagaatcaaaatatacaatcatataagtagattgttccaaattgacaaaataatgtccacaatatacattaagaggaaaaataaacctgaggaatattatgaacaatatgagcttggggaacatataaaagaaaatacactttcttttaattgccaataatctagaacaggggtcagcaaattaaggcctgtgtgccaaatctagcctgccaacattttttggttagtaagttctataagagcacaactaggcccatttgtttaagtgttatccatggctgttttcaactcaccatactacactgagttgaccagttgtgaaaaagaccatgtgtactgcaaggcctaaagaactatctggccttttacagaaaaagcatgcacatgtctgggctagtgagtgaggcttaagtcctcctccttacatgtctctgttctttgaagctttacaacaatcaataatcaaaagaaaggaaaacagaaaatccttaaagaaaataaaaaagctttctgccattctatcactttgtttcgatctctattaggctcacatacactattttaatttgactccagctctgtcagactctctcttctatccccaaactgtcttccagctactttagaagttaatgcaatttcttatctatgattttggggtgacatcatcagggtattttttttcaaatgctattaaacagtactcatttaggcattacagacaaaaaccatccctagtgtaattttaaaacccactaatgaataacttcctctgattctacgatagaaaaaacaagggctttcaagagtacagatgtgaaatactggtttgggttcttaatttccctctagagacctaaaaccacattgtgaatttaacatcaatatattgccttgtactttcaaacattaattgaattgattagtcaatggcacactatcctactagtccccaaacaagtaacctcaaagttattctagtctcttccctcttctctaccaccttccttcaggcccctaatcaatcaataagtcttgtcaatatttcctttgtaatattctcagctttaatttatgctgttttatagccaatgtcctaaaaataaaggtttcatcatttcatatacattataactgaataaatcttctgagtgctaattctgatcttttaacatttttgtgcctctgccttttaaaaacactgtccaacatctgttcaacacctattacattatagactaggctaagcagcaaagatgacctttcattatattttagttggggaaaaagagaatccactggagtcctttccagcttgaaactcatattaacataagtgctatggtggacacaccctaatgtgacctccagtgagtcgtggctttaaatgatcccaaccccttgagttcaacctgggcagaatctggcacttccttctagcaaacagaatatagtaaagataatgggataatcattccttaattagggtactttacatgccaacggtgatgggataatcactctggtacttatgtaataaagttctgccctagcatactgcagagattctcctgccacccctgaagaagaagtaagtggctatgtgtgaccaggccatgagacagggaagtatggacagcctgtaggatctgagagcatcctctcagtgacagtaaacaagaaaatgggaaactcagtaccacaacagcatggaactgaattctgccaagaaatttgtgaccccaagctccagaaagaaatgcagtttgaccaacacctttattgtagacttgtaaaaccctaaacagaagatccagctaagctgagtctagacttctgacccacagaaactgtaggatagtaaacataagttgctttgagctgcaaaatttgtgggaatttgttataaaataagcaatacaaataaaattagaacataagaatatgtttgctatcatatctctatagaagcaaagatcacaataatctactaaagatgaaaaaaagctccaatagaaaattagagcatgaagatgagccttaaagggcaaaagcaacaaaaagagaaagatacttcagataacagtatgaacaaagttataaagagaaaaaaacctttgttttttgttttttgtttttgttttggagatggagtcttactctgtcgcccaggctggagtgcagtggcacgatctcagctcactgcaacctctggctccctggttcaagcaattctcctgcctcagcctcctgagtagctgggattacaggcacgcaccaccacgcccagctaatttttgtatctttagtagagacgggatttcactatgttggccaggatgttctcgatctcctgatctcatgatctgcccgccttggcctcccaaagtgctgggattacaggcgtcagccactgcgcccagccgagaaaaaatcttgtgtgttctattttcaagagaaccgaaacatccctttctatcacttagttttcaagatgtccatttactgacatatacacttagataggtaggatatttctgtcttgatgtttcactcatttttctggttacatagcatttaaaaaccatgcaacactttaataatgaagcaacaagtgaaagctcccagcccccttccctgttcacttttcagaatacatcaccaccatgagtagtttatgttcctgtccttacatttatctaaacttatagaaacatatacagtatttatgtgcatatatatgaaacacatacagtatttatgtgcatatatacatatatacaaatgtacatgttcatgtgttttgtaaaaatatttttaaatacttaagaagtcatactataatacttgtatattttacttaaccgtataccattatgtaatcagaacagcttcaagtgactcatgtggatggaatgtaccgtaatttatcaaaatagtcccttatccagagatcattcattctttcattctttgccccattaacataaccattatttatccagttactgaagctagaaatatcagtcatatcttccttcttcatcatcctacagatccaatagaccaagtactgcccattctacctctgcaataactttaaaagttgtttctcttactttttttttttttttttttgtgagacagagtctcgctccatcgcccaggctggagtacagtggcatgatctcggttcactgcaatgtccgtctccctggttcaagtgattctcctgcctcagcctccagagtagctgggactaccagagcccaccaccatgcccggctaattttttatatttttagtacagacagggtttcaccgtgttagccaggatggtcttgatttcctgaccttgtgatccgcccacctcagcctcccaaagtgctgggattataggtgtgagccactacgcccggccaaaagttgtttttctttgtaaccttttccggtgcccttcactggaaactcactggaactcaggatcatgtctttgattatgataatagcctccaatccaacttctttccatgagtcttactattcttgcccattcttcactgggatcatctttctaaaatgaaaatctgataatcactgtattgttgacaaggtatcagccgtcagccatcttcccatgatctacaaaagagactaaacacctttccatggcttataaatcagtctcattgttgttaaacttttatactctaagaactccaggtcaggaactactctctcaaacattacaccctgttactgtacactcctttgcctctgttgctactgtcccaggaatgacctcacttcatattctatctaacctaccttcaaagctaaaccaaagtaaaggttcactacagaaccttttctgatcccacacctgctttccctccacagaagtaatcccctaccaacgtgtatcagtctcttctttagtacttattactttgaaactttctgtataacacaatttcaattatgtatttacaaatctgtcttccatttgacactgcaccaaccatttataatttatctttacacaaccaaagcatagaacagtgcctggggacccagcagtgcttataaggaaaagaaactttgactatccacttctgccagtcacttctaagctgctaactgtaaggaatacaaacatgcataacactgtccacaaagagttcacaatctaatatggaaagttataggactatatacaaacagcaagataactgtgaaaaggttcttaaggttcttaaaacattttcttctcttaacttttgcaataatacatagcactttcttggttttcctcctatctagctgctgcttcttcattgcccactttgctacatcctccgctgcactacctacaaatcttgtaatgtccaagagctcagctgtgtgttctttcctccctctaaattatttcatccagttctatgacttttaatctcacctacatagtactaattcctgtgtttatatctctaaccctatccttggtctcctatatttcagactcacagggccaactgtccaactaaaatcttcacgtggatacccaataaggcatttcaaatctaacatttccagagcagaactcttgattctacctactcactgccaataatacctcttccccatcactacctcagtttgtcccaccacaataaatagcgccaaagtccactcaaactcaagaaataatctttgattttgtcatttcctcacctccaaatcccattcatgaaagcaagttctactgctttaactattaaatacatcacatatatgtttatttctctccatcatcattgctaccacatcattctaagtcaccattccctcttttctagaatacttcagtaatatcttcactgacttatctgctttcattcttgccctgtataccaatcctatcacaattcattcttctaagaatgtaagccatggtgttgggaaagctggatatcaacatacaaaagaatgaaattgagccaggcgcggtagctcacgcctgtaatcccaacactttgggaggccaaggcaggcagatcacgaggtcaggagttcgagaccagcctggccaacatggtgaaaccccgtctctactaaaactacaaaaactagctgggcatggtggtgggcacctgtaatcccagctactcaggaggctgaggcaggagaatcgcttgaacctgggagacagaggttgcagtgagctgagatcacaccattgcactccagcctgggtgacaaagcaagattccatctcacagaaaaaaaaaaaaaaagaatgaaattggatgcttgttgatatggtttgaatatctgtatcccctccaaaattcttgtagaaacctaatctccaatgcaatagtattaagaggtgaggcctttctgaggtcattaggtcatgagggctccttcctagtgaatgtaattaaggcctttaaagaatagtcttcacacaatgtttagcctcttctgccctttcggcttccaccaggtgaagacacagtgctcaaagtgccatcttagaagcaaagacccagccctcatcacacactgaaacctgccagtgtcttaatcttggacttctaagcctctaaaactatgagaaataaattgctattatttataaattacccagtctcaggtattttttatagcagcatacagagactaaggcacttaccttacatcatatataaaattacctcaaaatggatcaaagacctaaatgtaagagttataactataaaactcctaaaagaaaacataaggaaaagcttcatgaccctgaatttggcaatgatttctaggacgtaataccaaaagcgcaggcaataacagaaaaaaaaaatagataaactggactacatcaaaacttctgggccaggtaaactggctcacacctgtaatcccaacactttgggaggctaaagcaggaggatcgcttgagctcaggaatttaagatcagcctgggcaacatagagagactccacgtctatttttaaaaagataaaggaaaaaacaacaaccttctgtgcatcaaaggacaaacccaacagagtgaaaagacaaccccagtgactcatgcctataattcctgcactttgggaggccaaggcagaagggctgcttgagcccaggagctcaagaccagcctggacaacatagcaagtccctatctctacccaaaaaaaaaataataataatagctgggcatggtggcatgtgcctgtggtcccagctactcaggaggctgaggtgggaggatcacattagctaggagtatgtagctgcaataagccactgcactccagcctgtataacagagagacgctgcctgtctcaaaaacaaaacaaacaaataagcagaaaaaaaaaaccctgtaagttatatcatgccactcgtctattaaaaactctgctcttactgaatatggtttaatccaaatttcttagcatagcttatagggccttatatgatctgaatattgaatacttctcttgacattcccaagccttactctttcttgctgattttgttccagccactctggccttcaatttgtttaaataatacacaatactattcactccttatggcctctgctcttgctgtttccttgccttaaaatgttgtgacatacatctcaaaagggttagctacttctcttcattcaaactgtttccccttcacaagatttttctaaacactccacactccctaaaagccagtatgtttactctcataacattatcctgctttgtttccttctaagcatttattactttctaaattgtcttattttgattacttgtttattatttgttctctcctttatgacagcacagacttattcacagctatatcctcagattccagaatagtacctggcacatggattataatcaataaatggatactgaatgataaaaaatgagtgccataaaccactcccaatctacttttttgtcctttccttatatccaaaaccttaacttccttatatccgtttcaatcctctttccctctaaggaatattctgcaattctatcctataaagacctttactttatgtcaatctttatttttaatatcatttttgtagagacaggggtcttgctatgttgtccaggctggtctcagaaatcctggcctcaaattcccaagtagctaggactacaggtgcatactacccaattttttttaaagagataggatcatgctatgttgctcaggctggtcttgaactcctgggctcaagcaatcctcccatcttagtctcccaaagtgctgggattacaggagtgaactacaatgcccaggttattttatgtcaatcttatccctaatgattactgtaggtacggcatatattatacttgtttatagaatatcttataaacattctattagaattatatgtgtattactctattctctcagaagatgtgcttccttaaccagaactgattaaggaagcagggaaggaaaaaggaaaaatctttaaaaaaaaaaaaaaaggactaaaaaaatcttttgcttctttttattttaataaacataacatctaagaggtactgttcaggtaggctataccccatcattatttgatgagtggacagtttgtaaaaatacttcaaaccaaatattctcaagcatctaaatttatctaagcaattaacagcaacaccatggagcttttagacttaactgtatcataaatttaagtttgaaatatttttgctggataatacaaaatgattaccatctaaccttacttatttaaaagaatattataaaaagtgattgggatgtatgtaaagtatttaataatactttcagagaagaagggaagcatatatatcttttccttcacaatttacaaaatgttttaaaatcaaagtttctgagaaggtcctgaatacatacctctgatttttttaaatattcacacaatgttatttgtcctttcattaatgaaaatattaaaatgacttcaaaaattaaactaataagatatctaaatgatttttttttgctattctaaggggtcaatttttcttatctatatgcctattttcctaaatatgcaaattacacaatatttagcaacagcaattttatctaatagctgtgtaaactattctttcaaaaaagaattaaaggtaaattaaagttttaattattataagcaggctcaaaatgttgggtttactgtagattaaatgtctaaatgcagagcataaaatgattcacatattttaatattaagaagaaaaaactatgtataatttacacctacagtgcaagaaggaagaaaaaatgcttgtgtcagccttaggaaacaaacagccctatcaagtaaccaactagaaaagattcatactggaggctcaataaataacagtaatgatgacaaccatctcccataactacattacagcccattgtccacatctgattatactagtctagaccttgggtaagcacatacacattttcaccaagagttttccaatattactgctctgtttcctgggctttctgtgacccccattagcagcaactgtcattttcactactaaacatgaccactgatgagaaaggaaagttactacttttctacactctaataattgagaatgtggaaataatgttcctgaattggcaatccttctaaatatagtaatttctttagaattagctacagagaagaggataaattgcttccaaagattttcttccataatatgagaactactaaagcctcacttttcaaaatatcatctccatatattaacatagcctttattcttatagtgaagaattattgcctaactctccatgtatctgcctccttgcaacatctatctctctctgtctctcacccagcacatccaataattcagtatcacaaaaatccctaaactgttatctctctgcacctttctcagttaaagctctcagtaacaactttgaataagggatgtaaaggttctaacatcacagaatacacatgcctggaacctcagaaagaatagattttgttggtaactgaaaaaattaatttaaattaaaaaaaaatttttaatgggcttcatacacatttaaggccagtctagatctttctcggttgaaatttagcccaggtagtagccactttttctggaaggcagtatccttgatcagagaccacaaggtatccatatgctttattagactttaaatggagatagcaaatactccataaagttatttcatcctgagaatataaaaccttagtaatttaatataaatgttacatcctcacatcaacctgtttttccaaacttactttgcatgataatccctagttgaacattttaaaacaactcatgatattacagaggctagaatggaagcaaaaagaccaggctgcaagcttttatctgattattttagataaaataatttcttaggactatgaaataatctattctctagaatgtgcaaataaaaagagacagaagatagttacatgtagaaaagcaaaaatatagagaaatggctctcctgactctccacttggaattcagtttatttggaattcagcagatttctctgctgcacagtatctaccaccttctatcttcttataactgcctttgtctcttcattgtcagtgacatttccttggcgattcatagaaattcatcttttcagattccactctgaccactcttatttaacactgcaatgtcctctgtatccgactgtacctattctcctcccctcgttttaactttctcatatcacttatctcctgaacatactatcaactttttaatttctttattgtctaactttaccaattaaaataaaccctattaggcaggcatttctattctgaccattgctaaattcccagagccaagaatatggaccagcacgtggccagtatggattaatatttgctgaacaaagtgaatgacgctattttcattttatttttattttactcttctcaaaggttatgagagttccgtttttcacctatccctaatacacatcccttttttctataatcattcttatttaataaatgatcctacgtacatagatgctgttgtagtttttttaaaatgtgtaaggctatgaaacatctatacaaacataagcatattctacaggcacgctatatccaagccatctttcctaaaagtcacatacatttggtcttggtaaaaaaatgtcaaacagcaaatcctatttagcaaaacatttaaagctctgaaatctagtagaatttagcatttttagggggtgaaaaagcacaattcaaacgcagcaccatttttttacataaatcagaacaaagcaagcttaaaaagtagccacagaccagtgtggtggctcacacctgtaatcccattactttgggagtccaaggtgggaggatcacttgagcaggagttcaagaccagtcttggcaacatggcaaaacaccaactctacaaaatgtacaaaaattagttgtggtgtggtggcgagcacctgtagtcccaggtacttgggaggctgagataaaaggatcacctgagccagggagatcaaggctgcagtgagccttgatattgctactgcactccagcctgggcaacaaagttgagactccatccaaaaaaaaaaaaaagtaaccattgaaaaatcatttaaatataaaatcccatataaagtgcacaaaacaagcctccatattcaaaacctattaaaggaagtatattaatgataagctgagatcaagctataaaattaaaaataaaaaatgacctgaccatgtcagtactttaagccaaaacatatgaataaaataaataagaaacatatgcttatcctaattaaggagagaaaattctaatcttctttgataagccattaaaccttcacaaaatgataaacattaatttaaataatctaatctttaagagcatataagagcatatactttattctaaatcacccagagaaacttctatactaatacaatccaggattgaagtaaacagagataaagacatgagcccaggagctaagcggttgcagcctgggtgacagaacaagaccctgtctcaccaaaaaaaaaaaaaaaaaaaaagagagagagagagataaagtctctgctcaattaatccactgttgatctctgactctaccctaaaaatagcatcatttccaaacaactgtttacaagatgtaattaagcagagcacagtaactcacgcctgtaatcctaccaacttgggggaccaaggtaggaagatcacttgagcctgagcgacaaggcaagaacttatctcttaaaagaaaaaaaaattacaataaaaaaatttaattggagtttttctataaagtatcttcccacatatataattttaaaactgaaaccagaaaaagcacatggctctttaagtaacactcaaggatttccaagtgataatctctacctcaattcaaattttatcttccactgatacagataagaatatattctagccacactgtttacttacgtgcaataaatacctttgtctttttatcaaaggataacccagatctaaaatacaagtgctaatggccaacagggtccaaatgaaatattttctggcctctctccctctctcccttttccctctccacctttccttctagtcattcttcttctcattccaccaacattattagtaatcgtgctattcagagaagtgaagaaaaaggatggagcggctaaatgaatgctcagaaagaagacatgcaatctaagtagatgaattttgaagacagaccagtgtattaatactcgaagcattatgtcttttatgtgggctatttatatatttgtatacaagtctgagttactgctgtaataagcagacactgactggctctagaggatgattaagcaacgtgcccaacagtatgcaggataatctgccctttctgtgctttccaaggatgggagaaaaagaagagtcacagcagcacatctaaaagtaaagttgtaagaggctatgaaagctcttaaaatgtgtttttattaaattaaacacaaaactataattataggttgttttaattatttatatatttaacaaattacaagattcaagatgagaatttaaatcttaaaatttttaccaaatattgtacctttaaactaggtttcatagtctactacttccctgatttttactatcaaacatttaaaaaattagccaataaaactatgccggtttttttatttaaagtataaatgaaatagaaacaatgaggagaaactaatagaaacattaataaaactaggaacaagaatgaaaggaggccaggcacagtggctcatgcctgtaatcccagcactttgggaggctgaatgacttaagtccaggagttcaagactagcctgggcaacatggcaaaaccccatctctacaagaaaaaaaaaaaaattaaaaattagccaggtgtggtgtcctcaacagcagtcccagatacttaggaggctgaggtgagaggatcacttgagccagggaggtcgaggctgaagtgagatgagatggtgcccctgcactctagcctgggcaacagagcaagaccctatctcaaaaaaaaaaaaaagacagaaaactctgatagaggatttgcacttatttttcaaaattctagaggttaagaacaaaaagagtaccacctaaacaaataaaatattcatcattctctctaagacacacaagtcataagacaggagaccaccaacaaatcattacaaatttcacaaaataatgtctcagaacagctgacttgatcactgctacctagaacaacatcaggagcttaaaatgctctaaaaaatatttggagggatcacaagcaagctggcaagaagaaaggaggcaacctagcagccagatctatttctgccagcaaaattaacatcaatactgagatactaaatttttttgcaagtaatatcaccaaaacctctaagaaaataagaataaaaggcaaaataagaacttgaagccctttatttatccaaataagaaaaaacattcaagattcattggcaaagaattgagttgaaaaatgtaagcaacagtgttatggaatgtaattaaatatatctttcaattcaattcaatttcaattaaatacatttgtaaagtgaagaaaaaaataactaagataaagacaaatcgaatacacaaataaatgaatttaggtccaatatacataacaatgtaacctacaccacatctaaatttagtataacactgaatcctcagatttcattcaacagggtcaaagggagtagtaataactgtacattattttctattgatgtggtgctacagcatcacagagactctaaaaggtggctttaatattctttaagttctttaaaactattagtttagagaaagttgtgcctttcaagaataagaaaactcttttagatctttcacttgcacatttaaaaagtaaacagaggtgctgataataatgattcaagatatcataaaacactcataaacaaaattagtattcaggaataacaatgttcttgctcataacttgtgaaaatttaattatttaactgaaatcttttattataagtatatgtatttttttctctttaaagtcatcaaggttgtaacaattacgtcagtgattatcaattattctagctctctaaaataaatttgtttaaaatggagtgttgtttacatgaaaaataccaataattgaactcaaaattaccaaaacaatgtatttaaaaatatcttattaaacaaatgtaagttaaagagaccatcagcaaatcactataaatttcacagagtaacatctcatcgagcagctgccttgatcatagctagaacaacatcagcagtttctaccaaacaacaattacttatgtctgaacttagtaattgatttgctaatgacactctacaagtctgttagaccttatgctgtagtctgtctataaaggtcttcatgttatttacacaaatacgacattaatcaagggcaaaatttatagcagctactctataaatgaggtcaaggcaggtcagacttacataataagaagaaaaaaaggttagtctttgcagtaaaaaggaaaatcattattattattcttcctgcccctgggattaagtctagtagtcaaacactccaaactatttcacaaacacatctactcctatgaaaactcatttaacctcaaggcactaaatatttataaaaggaaagccaaatccactgatttagaaaaataaaccactaaaattttcctttaaaatatattctacactgtaaataaagagagaacgaaaatttccaattttacctccactatttcactaatgaatcttagcttccaccactgtttatttcaaacacgtaaaagataaaggctgagtgttctctataggctaagcactgaagtaaagaagacagtttctaactatgggaagctaaaaaatctcaacagaataagaaaagcaaaggtaaaaaatcagagaaagggtactatgaaaatgataacagatgatataaaaataaattattcaaacaactgtttcaccaaattttcagaaatagcaatagcaggagtattagcatttgtgccagtacctccaagtctcagttccacagaataatacaggtccagtagacacctgtatatgcagtaaagtgtgttacaagagaggaactctgagcttagggcacttgaatcttctgtgacggccagtaggcccgttggtctttggcttggagaaagacattattatactagacagtaaacgatcctgctttgttctaaatgaagacactatttctatattccaaagctgtctgctatataaagatctttgaatgataatgcaaaacaaaggcatttggtatctcttcttacaaggccaaaaatcttaagagtgatgcctggctttctctcacaacccacatccaagccattagaatatcctgtcaggtcttatcttcaaaataggttcataatcctaccacttcttacctcctctactgctagcaaccttgtcccagtcaccatcatgtttaaccagaattactacaatagccccctaattgatctctttgtctttttttttttttttttttgagaaagggtctcattctactgcccaggatggagtgaagaggtgtgagcatagctcactgcagcctcgacctcctgggctcaagtgatcctcctgcctcaccctcccatgtagctgggaccacaggtgcatgccaccatacccaactaattctttttattttctgtagagacagggtctcactatgttgcccaggctggtctcagactcttgggctcaagcgatcctcccacctcggcctctcaaagtgctggaattacagacagaagccactgcttctggctatctcttcacttctatccttaaattcctacatgcatcagccatagtcattttttccccacgacagggtcttgctctatctcccaggctacattgtagtagcatgatcacagctcattgcagcctcgtcctcctagactcaagggatcctcccacctcacagctttccaagtagctggtactataggcacctgccactataccaggctaattgtttgcattttttgtagacagagtttcaccatgttgcccaggctggttttgaactcctgggctctaacaagtcacccacctcagcctccgaaagtgctgggattacaggtgtgagccactgtgcccatcccagagtgatctttttaatccataagggagactgtcttcctcttcttctcaaaatcatgcaatggctgtcatttcccacagaataaattacaaagcctctacacaaaatcttgccctatgttatctctctgaccttacttcctatttcattctactttaatcactcttttcttgctatattggcctcattcctcaaatacaccacagaagctctcacttgtacactggctgttccctaggcctggaatgcttttccatacatgcccctttaactgactccctgtgtgcttcaagtgcttgctccaatgttactttctcaatgagtcctaatcctgccactctatttaaactacaaaccataccaaccttttttacttccttcaaaaatttcattcccctcatctgctccatattttttctcacagtactaaccgtcattcacatattatataacttacttttttttttattgtttataatctgtcaatgcctatttgaatgtacaatccacgaaaaaaagaatctttatctattttgtttattgctgtatcctccgtagcaagaataattcctgggacatagtgtgtaataaatagatgaggaactgaagctcaaaaactaaaagcgcttgtcaagtatcaaagctgaaacctgaacccagggctatcttcaaagccaatgctcttaatcttaagtctatgttgcctcatctattaaatgtaacaataacatacataaataagggtagttacacttagtaaagtctacgatgttcaaaatcacctcatataaatttttctttaaaaaagccctggaattatacttcaataaacactaaaaattataaaaaatctgttcatgggtgttttgcattaagcagaacatttgtgtatttaatcgacagctccagtcacctctttttccatatataaacttcaatatcatccaatacctcagtgttgaaatcagtcgaaagctatttttcaataaatatacactttgaaatgtttactaaaagagtaaagaattagtcattatttcattaattgccctatgaattagtaatcactgatataaatctatatcagtttttattgatcacctactacttgccacactctacatgaaaatgtatctctatgtttcatatagatcactgtagtaaccttgctactgttcttcatttcaatcaggtcttccctccttcaacctatcctaaacaattccgccagttatctttccaaacccgaaatatcacaatgactcttttgtttaaaatcttccaaggcttcccacgatcttgagggatctagatgcccaattccaacaacacctctccaacacacacacacacacacacacacgaatatcctgtacaccttcccacattacaatgccttcagatattctgttccctgtgtttgaaatgtttttcacacaaatgtcctccaatttttccataacctccaattttctaatgtttacatgacaaatcgtactgatccttgaaatgcacctcaagaatcatggttcctggttaagttttaagcaccctgtacttacatatttctatcacagaatttagcatgaagtattataattgcaggttactagtctgtgagcacctgtaattatttctgaaggaaaggattttagtagtatttaaaatcaaataaagttacgaatactcttttcgcccttttccataacatttatgagagatagagagcaaaccttgattcctagatgcaagttcaaatagttaccaaaggactgatagggtcaatcttccaacaacattacctaaaacactaatcgaacattgctgaaacagtaagtttgttcagaatactatctcgaaggggagtcagtcacatcttttaatctatactctgggtcttcagttccattaatgcaaaatcagctactacaaatcagacaaaaagtggtccactaatcatttcctcaatttctttttaccttttaatgatttcactcttttacatttgttttctcccttttatctctcttttcatctctgtactttcttcccttctcttacccaccactgaattttctttccttgaattcttctgtttctgttctttaagtagaaaatatacctccttatttcctctatcacctttctcaccacatcacattgcgaaacttgtcccccctcccattatgatcagcgtgtgatataagaaagataatatagacatctaattctaattattggctctacacacataaaataacttgatagaaagtccaaataagtatggcttttccttatacctgcaaatagaattaacagtttacttttcccaaactcagccacactttttgaaaaataaaaatcagaaatgtatcagtaagcttgcatctaaagaaaattataaaatggttaaatattaacatatacataataattgatatatcagagctccattacattactgactgaacaaacagtaaatacagaacccaaaaatatcaatgcctataggaaaaacccaagattttaaagaaaaatacaaaatgaattaaaataaaataaattaccttccttcattgacaagttcgataaaagcaaggcctgcattcttctgaatagaattttgccactcctataaaaaaaaaagcaaaaatagctgaagaaatgtcactcagtaggttctttcttttaaaacaataataatgaaaaatatcacccatatcaatttcatgcctaactcttaaaagttatgttaaaccatatgaacaggtaatactgaaaagtatactgacactaaacaagttagcaacaatttgattctgtgtaaattaaatgagcctatctatatttatcttgcccttttcattacataacacgatatactaatttatctgaaatagttgggagctgggaaagaaggtaacaaagaaaaccaaggacaaatagacattttggttttggctttgtttttccatttattttaagatgtattacccaaaatgaagagaagaaagaattaaatagttcaataaccctaataaaaacagcatagttcaccataaaaattgatgactagcaactgaaaatgaaattagaaaaatcagtgaattgagctaaaccagttttgagttagaaactataattcactgccctatgaattagtaatatctggtataaatctactaactatattcttgatccatttgaaatttacccattaaactttatccactaaaaagcaatccattaaaaagcctaggaatgaaatcaatcaatagagtatgtacaaatgaatattttaatccttaaaacaaaaaatatatataataagcattaatacaataaggaaaggcctacatgaactgaaatatacctagatttgaaaaatgctcgtgaatgccacttgtgtgtatgtgcgtgtgtgtgtgtgcctatataaacacacacacaaagatttgcttttaaagaactggaaatacatacataatcttcatatttcttaatatttaaggagctctttgtattctaactacataatatccctcaactgatctttttttgttctttcataaaacccaaatcaaaaggccatgtctggctacttaccactgctcactataaaccatattcatattttctgagtgtaataactctaagactttcaaattccatgcaatttcaccctaatagctattccgttccactccaaattcttttctttttcattctcatcctttctcttctaccttctcttttccatgtccactttcatacttaccttcttttgtgtttttgaaaaacccaaggtggttcttaagactaaaacaatcacatgacatgattttgtcaaaggattatattttatgaatagtattagtataactatgctaacagaacaaatacagtagaataaaaattaaatagaaaatcagtaaaacgttggagggtagtcactggctagaactagcagagaagaaaaagtaacgtattctcaaggaatgagcaagaaacaaattcataaaatccatgttctcattctgatactaacagaatatatccttaggcatatcgtgctacatctgcaggtcttagatattatcttctaaaagtgtattctaggtataatttttattattctaaaatttactaacatttagaaattcatgacttgtaattgtacaatatatactctctaaaattcatactgaattcatattttaccaaaactgtaaaacagggatactaaattttttccagcgaggtaaaacaaaccaatataaaacagaaatatgaatctaatttaaaagcattttctttccatcaaaataaaatgaagacaagtagtccaaaaggaagcaatcaaattccacaagactatattcttgagagaagggcatgtgccacgaaaaggtaggagaatgatgacaaaaagcagaaacctcaaattttttttttattttggtacagagggtcccacacctaacttcccaagcacagcacagagagataagactcaaagacttaccctaaatctagtaatgcacaagaacagtagaacaggaacaaatttaaagacagatggacctcagctaggaagattcaaaaaattatcatggaaggaggcagaagcagcttaggatttaagaagatgaagagaacataaccatgacctctgtggataggcagcaagtgatcagcaagaagtacgatacttcaagagatgccacagccaaacaacacaagcatatgttcattcctcagctcttatacctaacataacattcttggaaacccaactagaaatttgacataatacaagaataggaaggaaagtgagacctcaagttgagtgagttttcacttagatcatttaacttacagaaaacttcaaaatagaaacttagttaaagaagaaaatgaagaaaattacctttcttgctagaaaaaaagaagtcagtaattacagaagaactaaaattctgtatataaatctttagattagtcattttacttttaaaagtatccactgtcaggaaaacgtcaagaatgtcccctctcaccactatctttcaacatcattctggaagtcctggctaatgcagtaagacaagaaaaggataaaaattgaaaaagaagaaataaaactgtctttgttgatgacataatcatctatatagaaaatcttaaataatctacaaaaaatcctggaataagcaataaatagcaaggttacaggatacaaggttaatatacaaaagtcaaccactttcctatgtatcagtaataacaagtcacacactgggataaaatcatttgtaaaagacatctgataaagaattgtgcaaaatatacaaataactcttaaaagtcaacaaaaacaaacaatcacattaaacaatgggccaaagactttgacacctcaccaaagaagatatacaaatggcaaataagcatatgaaagattgtccacatgtcactggggaaaggcaaattaagactagataccattagacacctataagaatggccaaaatccagtacactgacatcacctaatgcaaggatgtggtacaagaataaatgaaatctcagtcattgctggtgggaatgcaaaatgatacagtctcactggaagacagtttgatggttcctaacaaaactaagcctactcttaccacaagatccagcaatttcactttttagtgtttaaccaagggagttgaaaacttatgaccacttagaaatttgcacatggagatttatagcagctttattcataaatgccaaaacttagaagcaaacaaaatgtccttcagaaggcgaatggataaattgtggtacaaccagacaatggaatattattcagcgctaaaaaaaaaaaagagctatcaagccatgaaaggacatggagaaaatgtaaaagtatattactaagagaaagaaactaatatgaaaggttacatactgtatgatttctactatatgacattttggaaaaggcaaaactatggagaaatgtaaaaagatccgtgtttataggggttagtgggaatggaggggagcacaaaggatttttaggtcaataaaactactctgcatgaaactataatgatgaagacacaccactacacatttgtctaaactcacagaatgcacaacaccagagtgaaccctaatgtaaactatggactttgggtgataatgatatgtcaaaggaggttcatgcattataacacacatgccagtctcgtgaagaatgctgacaagagagaaggctatgagtgtgtaggggaaagggaaatgtgggaaatctctaccttttgatgaattttgctgtgaatgtaaaactgctctaaaaagtaatgtcttttaaaaattagtaataaaaaagtatttactagtactatttttctcaaatccatttgttctgatccaaaactgcaatgggaaaggatttttattacataattcagacaaaatgcaaaactccacatggatgaaatagataacagcagaaagacccatatattaagtaggcaggtaaagggtaaacatcatttagattttattttcattatatacagaaacttttaattacattgtcaaatcagaaattgtgccatttagatttcacaaagattttaagtagcattattggggttagactgaaaaccagttaaagttagtataactatcaaaacttaaccacactaaaaatttgtaatctaaacttatcttggtatgtcacaggaaatatttcttttcaattaaaaacaaattagacatgaaggtacatatataattgaagaagttcagtgttttatggaggctcagaaactcaaatttattactagtaatacattatgcttctggttttctcgaggatcatctataaacccatatttgttaaccttcagtaattattacataataacctgaaataaaatgttctcattaattttttcaaattggctaaaattaggaataaaatgaaaatacaaaccttatacttttggttattgttaaaaattatcacaaatctcaggaatatccttatgttttcatttctctataatacagtcctaattactaattattaccatttaataaaataccaaatgccagatatacaaatgcatactaaaaagaatagcctatataaaaagaatctgaagcccatgagaatattttttcaatttgtttataatccaggtgttagtcaaagccaacaagttttctccatactaaaacattctctacagtaattcacagaagttgccaaaactaaaaagaatattcctgaactatgctatcctaaaccatttttctccacttcagaaacaattatcaaggaaggtgttagtctaaacaatttcataaaccacagctcaatataacccttagtgagttttaatagttaaaagaaaagcttaatggtcatcgtctttcatgatcgtttcaatatttcatcacagtatttacaattatacagtgatgcaaaatgcatagtacatttaaaggtcttggttatccttctcccagaggtactgatgaaaaacatgttaaaagcctcaaatccaaccactaatgcaactaagtaatttcaaaacacatttcagcactttggagaggaagaactcaaaacaaaacaagagagtcaataatttcatacctgttcctaagctgtatttaattgactatcacttcctaaggccataattgttgactagtcaatttttactaaaatatactcttagcttactgatgcttttaagtcacacaacaaaaacagtgaagataatacatattagtgaaatctactacatagatctccaccaaatttcaagactgtattcttggtggtaaaagttagttagggcaacaaaagacttcattaacctaacattatctattcctgcctatcctcaacaaataaatataaagaaaaagataccaattaacacactatgcattcaaattattgtaataaaattctaatttctttagacatgaacttgacagttttctataaataatctcctagaacgtattttagtgacgaatacactaaataaatttatctcaattttaaaagtaattcccaaatattagcatgttctaaagcagaaaaaatcaggccacagattaaaaagattacatataatctactctgctatcattttattttgtcaagccatgaatactgattaacattaaatatagtagcatttgattctggtgggcagatctttaacataacttttagtattaaaaaattttttttctgtaatcccagaactttggggggccaaggcaggcagatcacgaggtcaggagatcgagaccatcctggccaacacggtgaaatcccatctctactaaaaatacaaaaattagccgggcatggtggcgggtgcctgtagtcccggcttctcaggaggctgaggcaggagaatggcgtgaacccgggaggcagagcttgcagtgagccaagattgcaccactgcactccagcctgggcaacagagcgagacttgttgcaaaaaaaaaaaaaaaaaaaaaatttggccaggcgcggtggctcacacgtgtaattccagcactttgggaggccgaggtgggcagaccaggaggtcaggagatcaagaccaacctggccaacatggtgaaaccccatctctactttaaaaatacaaaaattagtcaggcgtggtggtgcacgcctgtaatcacagctactcaagaggctgaggcagaagaatcacttaaacctgggaggcagaggttgcagtgagccaagatcacgccactgcactccagcctgggcaacagaatgagactctgtctcaaaaaaaaaaaaaaaaaaaagttttttttttcaagagaggtagataatgagtgacttcaggttaaacatagtaaatctgagaataaagagggggcaacagtacatgagatacattaagaaatttattttacaacctggaaacacatgagttagtagtaataaatgcacttagaggaccaaagaaaacaaaactctacacaacaaagtagaggaatcaacatgaggaaggaaatcaatgcttgtcacaaaaactccagaaaagctaggaattgaaggcactgagtacatacgaaggtggctgagggaaagagatgcaagttggcataaaaagaaagttagaatcccacatcttctccctatgctgtgtagccatcctaccatggtaaacattggaagtttattttccagaaaagttataattaaggaaattattaaaaagctataatgaaaaaggcaagataaattgaaagtatacaaactggactatgacattgtgagtgatatttgaaaacttttctgagaaaattgagaagctaggataaaaggtaatcctctacaaataacaaagggaactcatgcatcaccagtggacaactcatacccagacatatagattttctctgtgttatgcttaggaatgagcaaattgccaaagttaaccagacatttgaggaaaccctcttctgtgatgacagacaccaaagcaaacaggcagaggagaaaaacgactcatagaaaacagacaatattgttaagagggtgaggaaaagaagattaaagaaaagtataattaaatatcataggaaaatttttttaaatttcatctaaaatatcaagatagggattttatcaagtgctgtctccttttttttttttttttttttttttttttgagacacagtctcactctgtcacccaggctggagagcagtggcgcaatctcggctcactgcaacctccgcctctgggttcaagcaactctcctgcgtcagctttccgagtagctaggactacaggtgtgcatcaccacactcagctaattttttattattattatttttagtagagatgggttttcaccatgttggctaggctggtctcgaactcctgacctcaagtaatccacccgcctcggcttcccaaagtgctgggattacaggagtgagccaccatgcccggcctatcaactgctatttctatgccccggtattaatcaggattcttcagagacacagaacgaatgggaagagagagagacagagagagacacagacagagagacacagagacagagagagaaagagagaagagattataaggaactgactcacacaattacattggctaacaagtgccaatatctacaggatgagtcagcaagaccaatggcacagtctgaaggtcagcagcctctagacccaggaagagacaaatttgaatccaaaagtgagaaaaaactaaagtcataattagaaggcagttaggcagaagaaattctctctactgggggaagagtcagccttttggttttattcaggcattcagctgattggataatgcccaacactaacagggagggcaatcttttttactcagtctaccaatttaaacttaaatttcatccagaaaagactctcacagatacagctagaataacatttgaccaaatatctaaacagcctgtgacccaaatgacacacaaattaaccatcacaagtccaccccttgtcagcttggcactcatatacatctcctcaaaccacatttcattaccaaatgaagattaataacaaggttataattctacctaacatgatacaactattctgtatacaaccaaaaccattctaaacctgtgacagtcaattttatgtgtcaacttgacaggactaacaaatgcccagggagctgataaaacatgatttctggttgtgtctgtgaggttgttccacaacagatcagcatttgaagtggtaaagaagatctaccttcaccggtgtgagtcagcatcaatcacccgatttgttgagggcccgaataaaatgaaaaggcagaggaagtgggagttcatctgtttctgttgggaaagacatcctcttcacttgccctcacattagcactccagggtctcaggacttcagactcagactgggacttacaccattggttttcccgggcctttaagttttagacagcagatcatgggacctctcagcctccataattgcatgagccaatccctcataataaatttctttgtctgtatctatatatatcctattggttctatttctctggagaaccctaatataaacccattccccaccttagctgatatgtatactttcctaatatcccacaatttacatatttacatactaggatgtacagttaacaatatgatctacagttaacaatacttaaatactatggtgttgatattataaactcaatacatcttaagttgcatggtgagggattaaaagaggaaagaaaacaaagattttatatatatatatatatacacacacacacacacacacacaaacacatatacacacacaaaataagaaagaaatgtaacaattacatttcttgttctgtaaatggtcatgtgatcacagttggtatctacaactaccttttttcactgcctattctgtattccctttgtcttcagcaagcacctcagctggtcctggtactgtacctaatagggtgacccaaagcttcattcctgaagggtctgggctgctttagtagtcctacctggattgtattaccagtgctcctcaacttaatcacacagtatggtaatactaagatatgcactgaggaatctcttgtattctagacatactcttccttacttttattgtggtatagttcaatttccccacagtagtcaggatcaatcactactcttagcatgataactccatttttgcctgaggattcagaggcaggaggagcccaaagtggctgggaagcaatcttaacttccggttcaatggaatcattgttgtgcctcctggtggaagcatttctccctttggaagtaagacctctaggccagcagactgtaagatcacaggaacaggaagcaaaacttttgctattgggtcactagaggtaataacaagtggtaacactcccatttctacctgttgattcctggaccaatgaatcctacctgtggggagaaacagcaccatatactggatgctgattcagtacacatatatccttctggaaaaccttgtcccagccatataaggtattgccacctacattcagttctatcaagccagctgcttgaggatggtggggaacatagcaaggccagtgaattccatgagcattcatttgctgtgaaatagatttcttaatcagaagcaatgctaagcaatacaatgaaggttgataaagcattctgtgaatccacagatggtagtctgggcagaagtacggcatgcagggaagataaatttgtatccagagtgagtgtctactctgataagaacaaaatgctgccccttctatgatggaaggggtcaaatgcaatcaacttgctaccaggtaacaggttgatcatcctagggaacagtgccttatcagggacttactgttggtctccactgccagcagatttgacactcagcagtggccacagccaggttggcttgctgagtggaagttcaggttgctgagtccttggataacctccatccctgccaccatggccaccttgttcatgagctcactgggcactggtgggcggctggggaaagaggctgactagtatccacagaacaggtgttcccagccactttagtattaaaattatcctctgttgaagtcacccttcagtgagcattcacataggacacaaatacacagtattcagattttttctcccattcatagacatctatacacatacctcttcccctaaactttttttgtcaacaattttctactcatgtcccttccaagtctctgaccatccagacaaaccaatagccacagcccatgaattaataatcacatttatccttccaaaaaaagtaaacaatcaggtacactcctcaaagttctgtccactgagaagattattcttcactacagtccatcagggatgtcccaaaaaagggctgtagtgctccaactgttcactttcaggtggtgcctgcatattgtcagaacaatctatacaccaggcccaagtcttctcctctggcaactgatcacaggactcaccaagagaccataggtacgggctggcaaagagaaggtagtgtagcagaactgaggaccataggatatttgggccacttcatgcaacttacttgtgttttcaagcattgcttgggcctgatcacatgtacatcacttcgatttgatgacagagtgcttctgtgcatgtacaacttgatggcttagtaggacagataacattcagttcataataagcagctcagtcacttgttaatttggtggcccagtgttaactgttcagtctctacttaaacctagtgacaggccaagagttgtttctcaaaaggagaatatttgtctgggaaggatgtcagggccttgctccaaaatcctatgggtttgcattgcaatttacctaaaggggcccgtcaaaggctccaaatagcatccccatctgccactgacacttgaagcaccattagatctcctggagcctatggcttgcacagcagcctgaacctgttacagagccttctcttgttctgagttctactcagaactatcagcttttcaggtaactcagaaaatgggacagagtaacatatccaaatgaggaatacgttgcctctaaaatccatagagtctacagccataccaccctgaaaatgcccaatctcatctaaaagccataaacggtcactagcatgtacctttttggttataggaggggccagatacaacttattcttcacctaagaaggggtatctcgacatgtcccacaacactggagccctagaaatttcactgaggtggatttaccttccaacttctgacatgcaaatgccttaccaaaaagtctggtagttacaacttcttgctcactaagtggaaccagcataatgtcatcaatgtaatggacgactgtgatttctctgtggaagtgaaaagtgataaagatccatgcaaactaaattatgacatacagctagaaagccagatactcctgacatagagcagttaagggacactgctagccttgctagctgaaagaaaacgacttctagtggtccttattgacaagtatggagaaaaaaaggcatttgtcacgtctattaggtgccagggaatgtgtcaatttgctcaagcattgaaaccacatctggtacagcagcagtacttggagttaccacctggttatgcttataataatacactgtcattctcaaagattcatgtgtcttctgcataggccaaataggcaagtgagatgaatatatgctggaaattaccacacctgtgtcaaatccttgatggaggaaaatccttccagaaatacagtattgcttttggcttataattttcttaggtagaggcagttcagtggcttccacctggggcctttcccatcataataaccctcactcaataggtcaggaaaccaatgtggagacactgccaatttctgagtatgtctattccaactatgcattccagaacttgggaaataatgacaagatgaattcgaagactcactaggcctattgtgagagagtgctcacctaaaactctattgatcatctggcccccataagcttccctgatattttaggtctcttggactcattgtcacttcagagccaaagtccaataatctgattatttccttttccccagtgaacagtaaccctggtaaaaggtcacaggtccctttgaagaagagtgaggaaaagattaacagtataaattttggtggcacaccagtgtatagagcacccttgacataacatagacatctttctatcttagaaaaagactccattttatatttcatggagcattttgccaacaaggatgttttgtttaattaaaaaaataaatcaaaacctaaaaattgcatccaaccagatgaggatacaacagacacattcttccactatcagttctgaccagaggactctgtgactatgaaagattaggccttcaacatcttgcagtcacttgtgataagaatttggcatctgctgacaaaggatctaccacctcaaagacttgtcgttgtaagactgactgaccacccagccgagaccaggactccttttgtcttcttcgctccccaaggactggtttattaaccctttctcctatctcttttccctctcgatgttaaaatgttactttgttgtggaatgtttaacttataatatttatacattgattaaatatactattatgtatggtttgcaatactgactgacttgtagaatggcttcagcctgtgtgcccacagctctgactactgagtgaacgggaagtataaggataattgcctcattgagaaatccatgtagcttgtggcttttgtgattaaaatgcatcaataaaagcctgacattgtgaaaagacacatatatgtgtggacctggttacttctaaccttgtactggtcatgagaaaatgagtccttcctcaaggggacccagcttccccttccttcacaaagttctggtcctgtaaattggctcaacttgggaaattgattgaggggccatgactcactgcttttatgattaaagttaggtatttgttcacttgatctagaacttttctgcgtatacaggtaaaataaaaaaattaataggcatactatctacttctcccctacatacaccatgatcaattcaccaatgtcatagatctgctccagtcaaatcagcatcacagttctgcttgctgctttgactctgctgtccattatggtgaccacattcaacttgcctttggtgactgaatgccaccacttggctcctgccagctcaggatccaattactcccaatgcgttcaggttttctaattgaccagctgtagttcctaccataaggtctgatctacaaagaagggtagtcgtagagctcttcaagaaagctgagcctccctttaaaaatttatttctcacagtacacggaagtgtatcttcaagaccctgcagtgtgagtaagtaggtcttacattataaatctactccaaagttccaatctccccaaattattttatttatttagagacaaagccttactacatccccagtgctaaaacagtgaccagtacatatgaattagtgatccacaaatgttcaatcaacatacatttctaaaaggaagtctgcaatggaacacacacacacacacacacacacacacacacacacacacacacacacacagtgattgcagcataagagaggaaagagggaaattctaggctgatgataaaagaagcgtctaacataaaagcttcctatagatctaaaggacaaccagactagattggaataggaaaaaggggactctaggtgctatatttccaagcaaaacaattgaaccaataaatatccagtgggtttaaccactttttccaatgcgttttatgattacagagaaaaatttaaagatcaatttgtggtgagtgcacagaaatataagtaaaggaaaaaggacaaaatcattagttctacaagaaagaatgaaaaaaaaaaaaaaaaaaaaaagaccagcaagcaagagaggggagaggaaggacgagtaagggaagagaggaggagggaaaagagaagaaggagcagagaagagagaggagggcagaagaggagaaaagaggggagaaaaaaaagaaagaaaaatatgtaattcatagtacattttttagctctggcataaatacatgataataacgtaaatactaagtatggttttaacaaatgttattatgaaagtatattagaaagaagcaggagagtgaaagttaaaaggagaggagtttaagtactcaatggtcgtctttcacaaaagattaatgttcaaagtttaaaaatcaagaaacagtaattcatggctgggtgcagtggtgcacgcctataatcctagccactagggaggctgaggcaggagaatcccttgaacccaggaggcagagattgtagggagccaagatcatgccactgcattccagcctaggtgacagagccagactgtgtctcaaaaaacaaacaaaaaaagaaatagtaattcaagcatatcactgtcaacaaccaaaaacatttgaaagatgtggctgcttccaagagttaagaatcaatcacggggaagagggggaaaagaggcagagaactattgtttatctgtttcgtattatactattatttgggtgctttatttgatgaaaaataaattttaaattaaaaatcatatgcccagctgaacacactggctcacgcatgtaatctcagcactttaggagaccaaggccagtggatcacctgaggccaggaattcaagaccagcctggcaacatggtgaaaccccatctctactgaaaatacaaaaattagccgggcatggtggcgggcacccataatcccagctactcaggaggctgaggcagtattgtttgaacccaggaggcacaggttgcagtgagccaagatcgcaccactgcactccagcctggatgacaaagtgagactccgtgtcaaaaaaataaaaataaaaataaatcatatgccctaaatatatagaatagtagatgaataaaaaataaaaattgtaatacacacatatttttgtaactggacaacaggtatttatccaagattattcttgaaaatctctaaaaaatagaacatgcattcaagttttacaaatatgaaaaaaactatgaaaatacaaaagtattataagctaactattaagaatctgtactttttttaaagtcagttttttgaggggttttgttgttgttgttgttgttgttgttgttgttgttgttgtttgaaaaagacagggtctcactctctcgcccaggcaaagtgcaggggcatgattatagctcactgtagcctcaaattcctgacctcaagcaatcctcctgccttggcctcccaaagtgttgggaatattggtatgagccactgcaccggatctaaattcaatattgtaacctaccaaatggaatttgagtttatttccatttctactcgtagtaatactacccttttttataagttttgctctcagaaaccaaacataatttatattaaagaataaagaaaaaaaaaattttaaacctgaactcatgtcaaactgtttcattttccttattataaaaatataaaaatttaaaggtttaggttcttcaatgaaatatccacattgatttgttaagatgtagttatctatgcccttgtaaaacgaagcgaattggatggatgtacctccaattacctaaatagttgacagaaacactcctaggagttcagggagaaagccagggaggatagctcaaatgaggaagggaatgtattaacacaaaactgagaaacacattacacacaagactaaaggtcaaaactaggcaaaactggccaggtgcagtggctcccatctgtaatcccagcactctgggaggccaaggtgggaggatcacgaggtcaagaaattgagaccatcctggccaacatggtgaaaccccgtctctactaaaataccaaaattagctgggcatagtgcatgcctgtagtcccagctactcaggaggctgaggcaggagaatcgcttgaacccaggaggcagaggttgcagtgagccaagatcacaccactgcattccagcctggagacagagtgagactctgtttcaaaaaaaaaaaaaaaaaaaaaaaaaaactaggcaaaactgttcatgctcaagatacagtaatcttaagtgctcaaagtaaactatcattaacttttcaacaatgtttgcactttgtgtcagcactctctcaacatcatatctaacacaaacttaaataatcacataccacaaaagaatatagtgtaacaataaaggaaagattttattctattgtgtctttaatcactctgtgaaatagtaaaatagaatactgcccttcggaaagttttggtttcccttatttttgtgaacatattcatctaatatgtacctgtagcttgtataaatattacaggtcagttagtaaagaactgaataaagagaaagtaactattcatggcattcacaaaatatataaatatcttaaactccaaaaaattaagataaccatgcaaatcaattatgtaattactataaacacatttttaattatttgtaaataatcaaaaaatcctcttgcttttatgtttaggcacatgaaatattaatatatttgcaagtacctctaaaaatctgtatttacagtttttcaggtaaaacatatctccagacaataatgatccttccagtgacttccaaactggcatcaatttactcaagatctttcactaatcaatacagaaagcttaatttccataaaggtgacaaaaaagttgctctaactctttccagctacaagctctcaacagatgatcatcattaagtctgtatcagggctccacatttaggagccatataaatgtgtcctattagtacacggtcagtctgtttggcaactctagttcttcagacatatggcaattgctgccctttgaggtctgaagtcaagtctttagggaatctcaaagcttgcactgaaattacaaggagtgttcattagagacttctggaggggaaacatgaaagacttccattaaaactatataaaacagctaattatttttaaaagatttttaaaccatctaatgttctcaactataataaaaagtatttaccaactgaattatttttagaagcactacttcaggacatgggtgcaaacaggtttcttcctacctcctatctcccacctcaatacatacatatttattttataagaattatcaactcaagatttcaatacttttaatttagaattaaattatctcatacttctaaattctgtctacagaccactataaacattttctaaacaaagttattcttagagacaaatgtttgttttctaatatttagcttaggataatatatagccaacttaaacccagccagaaatacatatgtgtttctttttaaatgtttcttttttattcaaaagtctgcctctattttaatttttattttattttaaactaataatcataaaaaattttaagcataaaatgatataaagtattagtcaataaagtggcatttattagataatattatgcaaaacaggaaaacacatgaaggtttaatgtttactttttttaatatacttaagttgataaggaggagttcaaagaaatctcatatatttactgtcagaattttgaaaaacataaaaagtatattttctaattaatgattgcttccattttaactttttgaatgtctagacactttttaactcgagagaaaatcattatttattaagttttgcaataaaacaatcctactactgaatatttatttcagtaacaaatctttataaacttatataaaattcattagcttgcctcaatcatttcttgaatccacatatatgttggtttctgacagcgtaattccaaaaagtaattacaacctcaatccatttgtaaaaagacaacagaaaacaagtatgttacaccagtttaaaagaataaaaatctaaagaaaacagattacaaatgatttatatgaatgcctagtggtgaagttaattacaagtaacccaataaaatagtgcctttattattgtacagcaagtaaaagctctagatgtaaaaaccagaactctttctgctgacttctgcatgctcaatcccacagcacacaacattaagaattaaacatgtggtaaataagccatatagaaaacagcagtttttaagtaaaagcagaaaactttcctgctgtttaaccatttggggccttctactctgaataacaaccactgtaaactggcactatgtattcatggaataagtttttatggttaatatgaaaatgagattttaatttcagtgctcaaagtttaactccaaataaaacataaataactgtaaaataacacagcattcattttagcattcagtaggagcaaataaggtatcttatgtttatgctatgaaatggtgatatctacagaatttaaattttccaaacctcataatacatctacctataaagctttggtctctgaatttaaacatatattagcaaagacatatacactttatgttacagtaacttcttatggttgtcaagagtcacaacctaaagccagtcatagtatgcttaatgactttcctggtgtacagaaataagacctttcaatccagaacgactcagtaactcttatcaaatatttatcaatgttctcaatgagacaatagctgataccaactatatatatatacatatatatacacgtatatatatatatatgtgtatatatatacgtgtgtgtgtgtatatatatatatgcataccaagtataatacaaagtcctaatacatattatgcataaacatcatgatataagccagcagtccccaacctttttggcaccagggaccagtttcatggaagacaatttttccacagacaagggggtgaggggggggaatggtttcaggatgattcaagcacattacatttatcgtgcattttattttatttatttatttatttattttgagacggagtctcgctctgtcacccaggctggagtgcagtggcaccagctcggctcactgcaagcttcacctcccgggttcatgccattttcctgcctcagcctctcgagtagctgggactacaggcgcccaccaccacgcctggctaattttttgtatttttagtagagacagggtttcgccatgttagccaggatggtctcgatctcctgacctcatgatccgcctgcctcggcctcccagagtgctgggattacaggcgtgagccaccacgcccggccgtgcattttatttttattactacattgtactatgtagcaaaataattatataatgaaccataatgtagaatcagtgggagcactcagcttgttttcctgcaactagacagtcccatctgggggtgatgggagacagtgacagattatcaggcattagattctcataaggagcacacaacttagatcagctgcacgcacagttcacaacagggttcatgctctgatgagattctaatgccgctgctgatctgacaggaggcggagctcaggcagtaatgccagtgatagggagcggctataaatacagatgaagcttggctggctcacctgccgctcacctcctgcatggcctggtttctaacagtccacagactggtactgtggcccaggagttggggacgtctgttttaaaccattgtttgatctacaacataactgaaataataaatgatgaaatacttgataacttggttttgccccagaaataaaacaggactgataaacaatcaacagtgcatctctctagtggtattttattcctattaatttcacctccattagaaatcaatacaatattaatttattttgcacctttttttctgagtcaaaatcatcacaaatctgtctcctcaaccctcctactttaaaagtagggacctctaccctccttaagtcctcaacagtgcctaattcaattttccatacaacaaacatttgaatacttgtttttatttttttaatttttttgagaacagggtcttgttctgtcactcactgaaatgcagcggtgctatcacaattcactgcagccttgacccccctgggttcaagcgatcctcccatctcagcatcccagtagctaggactgcaggtgcacaccatcgtgcccagctaatttttgcatattttgtagaaacagggttttaccatgttgcccaggctggtctcaaactcctggactcaagcaattctcccacctcagcctcccaaagtgctgggatttcaggcgtgagccactgcacctggtcttgcttgttaaataaatcataacttaacactgttactgaaagagggagaaacacttcattaagaatactcagagactttcaaagcattactggatatattagtttcttgtagctgctgtaacaaattgccacaaacttggtggcttaaagtactataaatttgttttctcataattctaaaggccagaagtctgaaatcagttttactgagccaaaataaaagtatcagtagagccattctccttctggagactccaggggagactctgttccttgcttcttccagcttctggtggctgtcagcattccttggcttgtggccaaagaaaacagggtctctctgctccattttcacattgccttgtcctccatttctctgtctgtagcctcccactaacgatctctaataatgatacatacgataacatttagggtgtacccacataatccaaaattatcttttcatctcaaaatctttatcttaataagatctggaaagacatttttccaaataaactaacattcacaggttccagggatttgtcatggctatttgttggggagccatgtctcagtcaatcacgctgaagaaaccaaatgagaacagaaagagcaagcagacgaaaagtgaaccttaccagcaagtgcaaattcaaaatatgcaaaggaaacaaaaacttttttttttaaatttagtgctgtgtggcaagaactggaaaaaaaaattaaacaaatcaagtcaccttatgctccaagtgttggttctaataatgactgcattgtgactggttttgttttcaatgtcagaaattcagcttaatttgttaagtataaagcctatcaggctgcaataaactgaaaggtgggcagctgagcttcttgtgacaagctgatatcacaccgagcaatctaactgcctaatgccagagtacttaaggcagcagtccagatttgctaaggagactggttaagcaacagaaagcttcttaaaagttctccctcattattttactttctcactgcccctaaccaacttctttttccctttttaacttacaatactagcaaatagaatcctgttctcacgaattagtagcacttcacaaacaattataggataatagcgtaccgttccaatggatagaaatacaagacaagtctgaaagatcaagcaactttctaagtgctctcaagtaaagaaataggtaagcttttctgagaaaaagaaataaaaagaaaccaaaattaaatttaacttcaattttgtagtatctgatacactgcaacaagaataaactgacaagccagccagcaaacaaggcagtactgatgtttcaattaaatgcctaattataatctgagcttctaaatgaagaatttacagaaataaataattactaccaaaaagaatgcactgtgttgtatccagtattcaggaccttggtaaacagtttcacactcactatctataaaagcccactgtggaagagaaagtgtcaggagaatgtggggaacagatttagggtcacacagtttggggtttctggttaactacctagaagatagtgtgatatgcttaacacatatgtctcatatatggatactatttgtaagtcagcatggaaataagtataaatgaaaataaaacagctattaagaggccttgaaaataaggcagagaagtttgaatttgacaaaacagtaaacaactacagcttctcctggaaagaaaatataaagacactctactaggaaagtaaatttgttagtatgtactcagagataaaatcaggagaaaggaaaaagggcatttcactaattcaggaataaattggaccagaatctaattcttttatctcactctctgcccaagttttattaaggtataactgagaaaaagaaattgtatatatttatatatccaaggtgatttgatacgtgcataaattgtaaaataattaaatcaagctaattaacatatctatagcctcatatacttatcactttgtggtgatgctgtaggagttattaagaaattattttaggcagatagagaggaaaaggggtcctcgggaagttttcatttttaaagctgcttcagaaacgtttcttgtaaaagtcctggctctttgagcctgatggcaacctttgatatgcaaatttaggccatttgaaactgggtccacccaaacttggtgattatcgctgcctttttgcccttgccccacatgatcctggcaacacagctgcccccacatatccccatgtgtgtagaacatcatggtgccctgtatttgcatattaaaaggctagggtgggaggcccagcctttttgccctacgtgaatgacatgcctggtcaaaccaatcccctgagccctatgcaaatcagacaccacctcctccagcctctacatatacctgactggtatccactgcatttggggttccctctcttggctttggagccccgctccctctgtctctgtacaggggagctccttccttctttctttcccctttctatcttgcctattaaactctctgctccttaaaaccactccacgtgtgtcagtgtcattttatctaaactggcatgaggatcaagaaccctggtgttcctccactcatcggagtcatatcagtgagaacatttaagatctacactcttagccagaatctgattctttacagagggcttttgaaaatgatatttccttttatttctccccaatttgtaaccacccaatgggctcaccttgcccgctgcctagacagagccgatttatcaagacagggaaattgcaatagagaaaaaatcgttcatgcagaacctgctgtgcgtgagataagagttttattatcactcaaatcagtctccccaaaacctgggggtttgtttttcaggataatttggtggggaggaggccagttagtcaggagtgctgattgtttggattggggatgaaatcatagggagtcaaagttgtcctcttatgctgagttagttcggggcgggggcgtggggacagaactggttggcaagttcaggtggggccatctggttgtcagaaatgcaaaaacccgaaaagacatcttaaaggccaatcataggttcacagtagtgatgttattttcgagagtatttggagaagttgcaatcttatgacctctggaaaaatgtctggtaatatttagaattccagcccctctcatcctaacttggtggctggtggcctttcattcattttacaagaacagtctagcttttgggaagggctactatttaaactataaatgaaattccttgtcaaggctagtttggcctacgcctaggaatgaacaaggacagcttggaggttaaaagcaagatggagttggttaggtctgatatatttcagtgtcataatttccttagttataattttgcaaaggaggtttcaaattctactaggactcaggaatcatcataatgaacaactgttaatgataataatgtacttgaccagaaaaaaaaggtggattatcacagaactagattaactactataaaagtatttctcaactacggtaaaacaggaggtacgttgaaagtaacatagtataaacaaaaagcactaaagttgacaaaaggggcacttaaaaacaattagagtagtaatacaagtaacacgacatcagtgttacttgtattttggtacattttgtttagtatcccagaaagggcagtcattaatagctagcacataaaaaccacggaatcatctttgggagcctattgaaaaagtgaatgttatccattatccttgtctacatggaaatgaaggccagaaatggctaatctatgagacctcgtctagctccaccaggttaggaggatgagaagtgcctgaattctgttaagatgtaggcatagttatcagccattgttccagaggtcacaacatttgcaacttccctaattactcccgtaaataacatcactgttgtagaccctaaggttggccaccttttgagatgtcttttaagacttttgcattttgcatttcttttttttttttttttgagatggagtcgcctgggctggagtgccaatggcatgatctcagctcaccgcaagttccgcctcctgggttcaagctattctcctgcctcagcctcccgagcagctgggactacaggcacccgccaccacgcccagctaatttttgcatttttagtagagacggggttttgccatgttgtccaggctggtctcaaactcctgacctcagatgatccacccagctcagcctcccaaagtgctgagattacaggcatgagccactgctcctggcctagacttttgtatttctgatgaccagatcactccagccagactcaagattcatgactcaagggtcctgtagccctcacccagaagtggactcagcaaaagaggaccattttccaccatccaatgattttatccccaaactatcagcagcactctgaccaaaaaaatatgtttaaaaaaccctagtctccaaatttttagggaggctgatctgagtactaataaaactccacagtcttctatttagccagctgtatgtgtattaaactttttccctattgcaattccccagtattcataaattggctctaccttggcagcaggcaagaagaacctattgggcaattacattggaaataccgaataaatgaagaggattttgagtgctgttaaaaaatactcagattcggccaggtgtggtggctgacgcctctaatcccagcactttgggaggcaaaggtgagcaaatcacctgaagtagagagttcaagaccagcctggccaacatggtgaaaccttgtctttacaaaaataaaaaaaagtcgccaggcatgatggtgggtgcctgtaatcccagctactggggaggctgaggcgggaagatcaccgcggaggttgcagggagccaagattgcgccactgcactccagcgtgggtgacacagacagactccatctcaaaaaaaaaaaaaacactgattcagaattcagtaactttaatttacaacctactttgctctgtaaacagtactgcatagttttacatgcactgcctaataagatccttttttaaaattgtttcgagaaagtagtgttagaattatatgtggatcgtaaaaatgtaatttttaacacgagatatagaaatattaatttaaacattaaatttataacaaaggatatgatacgtttaattttgtttaacaccttttactagttaaaaacttcctagcatcttctatctcaatactttttgtttttttctttttaatctttctgggtacataggagtatatatttatggggtacatgagatgttttgatacaggcatgcaatgcataataatcacatcctgtaaaatggggtatccatcccctcaagcgtttatcctttgtgttacaaacaatctaattatacttttttcattgttgtaaaaatgtacaattgaattattattgaccatagtcacactcttgtgctatcaaatactattattttatttataccattaaccatccccacctctcctccatcctcccactacctttcccagcctctggtaaccatccttctctactatctctgagttcaactgttgcttccaaattttgcctattgtgaacagtgctgcaacaaacacggaagcgcaaatatctctttgatatgctgatttcctttcttttggatatatacccagcagtcagattgctggatcatatggtagctgtatttttagttttttgaggaactaaaaaccattctacatagtggttgtactaatttagattcccaccaacagtgtctgattaaatctttttgttgttgttttgagacagagtctcattctgtcacccaggctggagctcagtggcatggtcttggctcactgcaacctccgtctctcaggttcaagcaattctcatgccccagcctcccaagtggctgggactacaggcacacactaccacacccggttaattttttttttttttttttttttttttttttggtatttttagtagagatagggtttcgccatgttagccaggctggtctcaaactcctgcctgtgataatccatccacctactcctcccaaagtgctggtattacaggcatgagccacgatgcctggcgctaataagatcttaatatacccatttcacttaataagaaactgagactcaagaaaggaaagtaatttgccaaggttacacagtaaataagtaatagaataaaaaacatttattaaaattcaaaatctaagagacgggcaaatcacctgaggtcaggagttcaagaccatcctggccaacatggtgaaaccccgtttctacaaaaatacaaaaattagccgggcatgatggcaggtgtctattaatcccagctacttgggaagctgaggccagagaatcacttgaacctgggaggcagaggttgcagtgagcagagatcatgccattgcactccagcctgggcaacagagtgagacttcgtctccaaaaaaaaaaaaaaagaaaattcaaaatctaggtcaggcacagtggctcacgcctataatcccagcacattgggaggctgaggccagtggatcacctgaggtcaagagttcgagacctgcctggccaacatggtgaaaccccatctccactaaaattcaaaaatgtgccagacatggtggcgtgtgcctgtaatcccagctactcggaaggctgaggcaggagaatcacttgaacctgggaggcagagattgcagtgagccgagatcatgccactgcactctagcctgggtgacagagtgagactctgtctcaaaaaaatatatatatatattcaaaatctatcatcacagtattttcctggcctcagccttttcttaaaaacccacctaaggcatctttttccttcttcctgttatgacccatgacagagacaagagccacctgtacatagttgacctcaaacagctgaggaattcagtactagaaaaccaaataaattgcatcaagattctgattcttttattcaggcctaaatcaaagttcaagcctcaaattttgctaaaactgtatatatatttctgaattttcatattataaaataacagcttgaataaaaataggtgcctgactaaaaaatgtacaatagatggaatgtttgtgcaattactcaaataatcattccctcctaaattatactatgtcctattatgtatgtcaaggtatgtaaattactaaataataattttatcgcagcactaagttaaacactgcaaataccataaacatacagcaagatttaaatctggatcctgagaagctgggatgcctaatatgaactctgactactctgactaaaatccattaaattatatactattcatcaaaaactatatagtatgagaatatagctaaaacttctaaaagttatcagagagtttggtattaaacaaaggcaatctcaaaatttacacttttaacctagcctctctataattccttaacttcagtagattgattagaataggaaaaaaaagtactaagtaaaagcaagcaatgatagctgagaaacagagacactgatctgtattctttttttttatacttcaagttctagggtacatgtgcacaacatcattaaaaccaaagaaaaatgttatgctcagaatattcccatttgtgtatttctcccttttcctaactctcttcttaatcccaaatttaaaagactagttgtaaaacagtagggtgccaaattaaaacacattttattttcagatgtctccacactcacaggctgacttcctgtcaggaagagttccatttcattgaataccccaatcagcagggaacttgcagaattaagtgccagttgatattactttgttttgcatttaccacccttgagaataatgttcaaagatctagttatatagtcagcatggtatcatccttctgactagactgccaagccacagggtgtactgccagttccacaaaatttacctcaaaggttgtgttttctaaatcctagtgtgctggtgaatccataggacgcctgtatttcaggtcaaatcctgaatctaaagttaaattatgtttttctttggttgtaacagcacttttaaatcaatattatggaaactcaaataaagatcaattaatgctcaccaacccatcaacctattttatttttgaaaagaaaaaaaaagtactttactccgatttattttgtattaatgtttttgctattgtttcaagacaaatgtttccaccttataatagaaagttatctgttataaaattttgaatcaataaagcatgtttgcatatcagcaataaagtacagttattgagctgattttaaatattttaaaatagttcatgcatctaagtttttcatgaccaatttatatagcttgaatcttcacctaacctctccaactaccatagacttcctatccagtcctcacaagtctatacttccttcttttaaggtcaactgtttttactgcgcacaaaatgaattctgagcatttcagcaaagaatacctactttctcgggctttgtatattataagaacaaagcattcacagcagctctaaagcaaaacaatatgagtgtattagaagcctaccctattgattctcattccatctgcaatcaaaaggtcataggtagtaacaataacaaagctcagggacaatcaatttatatccactaattttttataagtacgttctaaggataagttacaaacacatcaagaaggaattaaaaattcctttttgaaattgaaattaaaatgtactgaaaccaacattttccaaacttatttaacactgtatattcttttcatggaacaatttcttttgagactgggtctgctcatgttgttgcccaggctggtctcaaactcctggcctcaggcaattctatgcttcagccccagtagcggggattacagttgcaaaccaccacactgggcagaacacctactattattatcacaaggtactcactgtggaatttgctgtattgaaaaagtcagatagtgagagttgatcaaacaagcacatggctaccacaatttcaaccaaggaaaattgttaatgtccgtttaaaattattatcttatattacaattatttgtctcgctcactaattgtctcttctactgcttaaggaataatagatgatagtttccttaaaggaaggggcttgtcttaaaagcatacgacacatgtttgctaaataaatgaataaataataccagaagcagacataaagaaaaggacttgggcaaggcagatatattcacacaaagctctgtagaagagacagcatttgaactgagcctgattgaccataaaactgaaaattctaaatgtacagaataatggcctcctcaaactgctatacaaaacttcgtatcataggatttccttataggtgaaagaaatgcataatgaagttaagaaggcttggccgggcgcggtggctcatgcctgtaatcccagcactttgggaggccgaggcaggtggatcacgagctcaggagatcgagaccatcctggctaacacagtgaaaccccgtctctactaaaaatacaaaaaaattagccaggtgtggtggtgggcgcctgtagtcccagctgctcgggaggctgaggcaggagaatggcatgaacccgggagatggaggttgcagtgagcagaaatcgcgccactgcactccagcctgggcgacagagcaaggctccatctcaaaaaaaaaaaaaaaaaaaaaaagaaggcttatttctattttgattaagcaaagcaactcatagtcaaaatttctattttttggttggcaaaaaataatcctttatttcattacctcaattatttctttgaaataaatacataattttcctaataccggatagtaagttttagttaaaaaaaaaaaaaaggttgaagcgtaccctaaacacagcacactatgaatagctaaccactccacttaaaagaaataaatttctatttatattaagttcagcagtaagtaaaactaatccacagtaatagaaatcaaatcactggcaacttgaggtgacagaggaggggattgattgaaaagaggcacagggaaatttgaggattaaaatggttgggtatatgtcaaaattcactgaacagtacacttaaaatgtgtgggtatttactgtatataaattatacctcaataaagttgacgttttttatttatttatttatttttgagacagggtcttcctctgtcacccagactggagtgcaccagtgcgaccctagctcactgtaacctcgaatctttgggctcaagcgatcctgctgcagcatccagagtagctaggtctacaggcacatgctaccaagttcagttaaatgtttttctttttggtagagatagggtcttgctatgttgcccaggctggtatcgaactcctggcctcaagcaatcctcccacctgggctaaattgttttttttaaaaaaagaggtctaggctaggggccgggcacagtggctcaggcctgtaatcccagcactttgggaggcctaggcgggcgaatcacctgaggtcaggagttcaagaccagcctggccaacatggtgaaaccccgtctctaataaaaatacaaaattagccaggcatggtggcaggcatctgtaatcccagctactcaggtggctgaggcaggagaatagcttgaacccaggaggcggaggttgcagtgagccaagaccacgccattgcactccagcctgggcgacaagagcgaaactccatctcaaacaaaaaaaaaaaagaaagaggtccaggctgacaaacataaggagaccctatctcaacaaaaaaatcaaaaaattagccatgtatgctggcatgtgcctgtagtcccagctacttgggaggctgaagcaggaggatcacttgagcctgggaggtcaaatgcagtggaccatgattgcaccactgaactccagcctgggcaacagagcaagaccccgtcttaaaaaaatgaggtgaatctgattaagtcacaagaaaatgaaaaaccaaaggccctgctcataaatgaacataactacactatttggtaatgataaaattagttgtcttaatgaaaatgaagatttaatataaaaactaattaatacaggaaagtatggaggtatttcctaatgaaaaagaccaaaagacaaagtccaaaatatggtgacttatgatccatgttaccattgatttatcaattatacaagtacataaacatttatatggttgaacagtactatactggacgctggggatacaatagaaaaaaaacacagtgcttgtcttcaagaaatttgcagtctacatggaagagaaaggaaaacaacaggcaacttaaatatagaatgaaattaactatgggtgagtgttctgcacaatacctcatttaggcgtagagttgtagggaagagagggtaaaggaaatctttccaaaagagattgtaatttatctaggagctagctaactgattcattttttccataaatattcactaagccataatgtgctaggtaccagaaatactttaatggacaaagcagaaatagctgttaccttcatagcatctagaaaacaaagaggaatactaacagtaaacaagtaaaccaattagcatatttatacttacaatttgtggtaaattctataattggtgctaagattaagacaaaaagataccaattatagatatgatcctcgaagaatgagataattaagctgagctctgaatgataagcagcagctaacaaaagtcaccaagttagaaagaggggcagcttagggaaagaaaaagcatgtaccaagacacagaaatataatggcatatttgggtatctttaaatagttcagcatggcttgagaataagtggtaagaaatgaggttcaggcattaagagagacctaaatggtaaaggacaccttgtgccatgtatggagctggtttgccttttttgggggtggtggaagagaggtattttaataatcttctcatactgaaaatattcatctataaaatcataactatagaaaagaatattaatatcatatattcagaaaaaataaactcaaaatggagaagaaacttgggattagagaaaagaaagtacagaagaacaaaaaataaagaaacgttttactgaagattcaggaaaaaaattcaaacataaaactgacataaaataatcataagaactatctcattcttattataaattattataattttaaaattaataattcagaggtacagaaagaaatacaagtcaaaaatgaccaaaccttatatcattaccttcatgtaaagaaaatatttcccaaaacagcaacaatctacatattttgttgaaaaattttttaaagaataatcagcctaaaatagtattttaaattaacttttgctgctaattaattactcagacaggatgccagtccagactacatggtgcttctagtttttctatatactgtatgcatttctgataaatgggaaaagaatagatgacctggcagaaggctcagacaataatatgtgatttacaggacaagaatgcagctaccacaagatttatctgacagccctctccgatagtggactgttgagtatccgaaggaatgatttctagtctacaaagtctactactgagtagccatacacattatttatttattagatgttttgggttgaaaccatttttaaatgatgcacttcacaatgcacagtcataaatttagctttaaacccaagaagggaggtagtgttattggaatgtatgtcagactgaattaggactagcaacacaacgcttttataaagtggccttgaatgcaacgtcaagtctttcaaaaatgatattaatgtcaaatgaacaagatacaaacactttatataatgctggagtaatattacttgaaacatttgcttaacattttctttaaattcatatatatttaaaacaggtttatacacatatacaacaaatttggcacacaagtaagttgcatgtttgtgaaaaaccacctgaaacacagttgagaacttgttcaatttttgtgtatttgcaacagagaacatacagtttcctgaagaatgtaagcagtcttattttaagaaataaagaggatttaaattgatctttggaacttcagtcattcttgaattattctacatgggattcaacagatgaataaatctatttttacaaacctcatattttaattatactcaaaaatataatgctgagtattatgagaggtttccaactctaattaataacattttgcctaaacaatattaacatttaaatagactaaaatatgaaatggtgcctaatcaactattatatatagcctaatcaactattggtaaatgagtggacattgaaaatgacaatcttagtcaaaacaaatatatagtgatctgtttggttttattgtcagctaaccaaatgtgatcatttcctcatttcttaaatttaggctctaaattctcttttacaaataaaatgcagttaaacaccttattaaaaataacacaaaaagaatataagttttgaatggattcaagaaaaataatcagagcatggctgattgtcatgaaattaacaccaactaatttgtaaagttctaaatcaaatttgcagatgttaagttcataagcatatcccattatttacgtgattaaaaagtagtttttgacctgatctttcgatctttggcactccgtcctctccatctcctcttaaaaaattaattaaaattttagcaagatggtagcttttgcttcccaccctatctcagaccaaaaaaaattatcaatcaaactcaagccatccccacccaggatctgtaaaatgtcgacttgaaattcaatttcatatctcttaagctttcatgtagaaaaagacagttcacttcttaacaaaataaatcacttttgtgattgccaagttgacctctttgaattaggaaaattcaaagtgaaaaatgtaattatcaccccagaacaatctgtatacatctggagctaattctagcttcatttttcacatcatttttcacactgtgctacatcttgtagagatgccatggaacttttgaagaactcacaaaaaatgttaaggacttcaaatacccaataatgtattttattcaaacaaaaaccttgacaatttctgacttgaaacttactgtactatatgatcttcatatcccatttgattgcattagtattaaacagtactgtgacatacatgataaataggcatattaaaacatgtcattctttatctttgcagctcctaacattaaaatatgcaatatactatattggaaatagcttccatgtaccaaaaatacattcgattcttctaaactagaaagtaaaacttcattgtgaaaattcacctatgaaataattatatcactatgaacaataaatttatattcttgtaaggaaacatccaaaaccataagaatgctcttttaaagtgagggcaatttcatgtagacataagaatgctatatggcaatttctatccaagaaagaaacaattatttctaatcaaatggcttaatgagaaattttatctagtcagcttttgaagaaatggagttttctaaatgagatgattaaattatagaacatgattctcagtaaatctaagaatcacaagcctactaagtaactacttctcacaagttcattacaaaaatccattaggtgtaatctctagaagtaattgttcttatcgcaccttattgacaatgcatagtattgatttttcacaccttctatgattctttaatttatattcatgaaatgtccatcagcacagtctaaataaatttggcatataggcactaaaacaaataaatcgatgcaaagaaacattaattttgcattatccttattcgttaggcaagtaaaccatgagagttgtaaatgaaggtcaaaggttttgaaatgggtcaaaacccttgacctctagaccaatacctttcctattaaaaaaggctattttaaagttttaagtgggggaatttactaccaccaagatatcactttaaaagactacaaagaaaactctcaataaaaacattcatctgtttaattgcaaaacagaaaagaaaacctcacaggatacatgatttttatataagttttttttaaaaaaatcattaaagtttaccacatgaggtacaaggttttggaacacctaaaataattttgctcttaggaatttattttctacatcttattatgatagctgccacatttttgttaatgttttcccaaatctactgtgcatgtcaaaaataattaccaatgacaaggattcaaaatcatttatcgctcattttataacctctgcacaaaatggaagtaaacccataattcccagtggagtcagcgtggcactccacaagatatagaaataaatctgtttttataaccttaatatatacagcaaagaaattatcaagatcatttgatctggacatttttaaagtgactctaaaaacttttgtttctcacttcctctcatgcttgcttcaaaattatctgcaagtatcaaaaataagaagtaatccttttgcaatacaaacaaaattattttaaaacagcaaactcacaattttattataccaaaaatttcagtaatgcaaatataaaatcccccatgaaaacaaattcatgtgataatctacttttaattcaacatttattcttgccactcacctgagaacacagtagcataaccaattccacaactgaactactcgacttcatgcaaaccagacctattttaaagagaattttaaaaaagaagttataaagaaaacaaatgaggatttgttacaatttcatccaaactgtttcttcaaattattttttcagactattaatagtgcacatttaatcacatgatcaaataaggtacactatagttagttcaaagctggcttcaaaactaccaccatttttgtaaagtatttcatttcagctttcaaaatactaaaacatttattacaacttcatatataatgacaattcacaatactcatagaaatgtgcacaacatatgccatattgatcaatatcatctacattttgttttggagagagttgatcgttatacatgcagagaagggaaatggctccctgacctttgctttctccactacactctctcccttcaaccctctagctatcaatcaagtttccattttgtttcatggcagcagacatcccaaacactcttattagtaccttgacctctgacctcacactaaaccttaacagaaatgcaagccgttgtctgttatatattcttgatttcttataaattaattcatttacttttatgtttcattttggttcaccaaaaatatctttagaatggatattttatataattaatacctatttaaagaagtctttggttttaattaccaataaaatataaagtagttcattagtatcttaacaaagcaatgccaataattaaagggactaaattattaaattgcattactagtaatcaaaaaaattacaatttttttattcgacatttttctaagcaaacacaggcttaggttccagggtataacatctaaaataattcctgatggctcttaaacatcctattgccttcttttttctcccgaagaaaactcttccaggtaccctatccattccctttgtctttttattctttagttctttctccttccccgtttaaatacgaatgcttccaacctaatgatagcgcatgttggcattttttagctttataaatagcattcaagttaaaagggctgttcacccccttcgttttttaaaaaatgttagaaccatttttctcaatgtctgaaaaaatatgtaacatagaaatgatggtaacagtgtcagcactggcaagaaaattagctatagaatgtctctatattgtattaggaagcaaattattaactacagtgtgatttctgtagggcgaagatgaacatggctcttcaggctaatgctgtcaaggccaaaagaaaaggcaagcaatactccctctcttactgcaggtgtagccctctgctggtctgaaaccttgccatttttccttaaatttaacccagataataaaagaagttcagttttgctccaacttcaaaacccattatttccagaaagtaaattcagatctttctattattaggtcattaatccttattgctttattcgagagaaactagaattcctgccattgggccctgatgggcccttttattatacatctcttcagataatgaaaaatagtaattttaaaaaagaccttaagctatccaaaattagggagatttataggtgctcctttgtccctcttaccacacttatcatatttcatacatatacatatatatatattttttgagacgttgtctcgctctgtcacccaggctggagtgcaatggcacgatctcagctcaccacaacctccacctcccaggttcaatcaattctcctgcctcagccacccgagtagctggaattacaggcgcccaccaccacacttggctaatttctgtagttttagtagagacggagtttcaccatgttggccacgctggtctcgaactcctgacctcaggtgattcgccaaccttggcctcccaaagtgctgggattacaggcgtgagccaccatacctggcccatatacctatatagtcttaagaaaaatttcacacatacacatttctgtttatttatttcagtcttattttccaataataaaggctaacaaaccagaagaaggttcatagctactttctagttggatatgaatattcaggaaaaaatatattcactgacaaagctagtaaaaggtcaaataacatttcatagttcggtttgaacaattaaggtggaggagagtgatggtagatgtattgcaggggcagggtggaaagtatgttcaattcgaatgagtaagggcttcagaaaacaagagagacctgataacagaccttaagttccctgtctaaaggacactggtactgtaaacacaaaaataacattgggagcaaagaaatagaggatagccccaataaggaacttaacatcaaaatgtagaacttacgtcacttctatttttgacctaaatttttgccaatggatgacactcatcacatgtgcaaaaaaacaaataataaacctgtaaatctctcttcagatttagtcatactctaagaacatccaaaggaaggccctaaaaccttaaagtcaagttgtaagttactgccagaactatcattttcattttatacacccacaaacacacacaccctattactgtctcaatcaaaagaaacgaagtactgcaagcttacagatttgaaccagctcacaatctgacctctctaaaactctcagtagaatagtagaataatagggtttggtttgattattttttggttggcttttcaaaggtagaaaatgttagtcttttcaaaaggacaaactcaggataccaagccaagagttttatatctgcactaatctggaattttatgatcaaagaccactgtaatttcttcagtggagactcacccagatatatcacttcagtgaaaggattaaatgactcaccagacagtaagccagtgccacctaaacccatcgatctatctaaatcctcaagtatacaatgaaaaaatagtcatgactatttactatctggaatataagagccctcttgttttttgtatttaagtcaccttaaataatttattttttaaaataggatggcaataaacattatgagaaactttaataagaatttaaggataataaactcaagaagttttactccatattttcctggttttgaaggtatatacatatactccaaatgagcattatcttttagataaaactaaatgctcatgatgaatctgaaacacaaccatcttgaaaacactaagtcgaaatttcaaatacatgtttaataggctctagcttatcataaattctggttttccttcctgaatttatatcatccaatccaacattttggaaaaattggatgactaaaaattttgttaaagaggacagacatcttctttgcttgagacttgcaaaatattttcttgtacagatttgcaaacatttagaataatcaatccactgaattttttatttccatataaacttttccttctagtcatcattgtatgcacacctgcctttagcatttatctacttagaaactgtatcaagtaaactgtggtacataatcatcccacaagacggaagaacaccgccacacgtctttttagaaaaatgggatggcccaggttcttgtctcaagttatcacacaaactaagcacaatgaagtccttcctgctaaataacatgctcatagagtgtacagagatactgtgaccctttggagggtcacaaaccattgtaatatctaagatattttttgcctaccccaaaaaaagtttttgccccattgagactgcaagtttatactttcttaaaacacagtgcaggcagagtgcagtggctcatgcctgtaatcccaacatcttgggaggccaaggcgggtggatcacttgaggccagaagttcaagaacagcctgggcaacgcagcaaaacccatctctataaataaataaataaataaataaataaataaataaataaataaatcaataaaattttttaaaacattagacgagcatggtgacatgcgcctgtagtcccaactacttgagaggctaaggtgggaggatcaactgagcccaggaagacaaggctgcagtgagccatgatcacaccattgcactccagtctgggtgtaggagtgagactcagtctcaaaaaaaaaaaaaaaaaaccacagtgcaaaattttgggtaaagcaatacaacgacagaggctaataaacaagagtaattatttcttttcctattgcaccatcactccaagtgcaattctagcattcgtgggttttttttttttaattttagtccacagcatagtaaagaatagctgatgtgtaatagtgaaatagcaaaatgtttcaagatacagaaaaaataagatcactaagactataattaatcatatttataaaaaggatccagtgaactcacatataataattgtaagacataatttaaaattttcaagcttgtgttctctttgttctttggaaaatctctttagaaaaattaatccttacaaagggttataactacttgaaaaagagggttaattaacatcattacaattgagacaatcaggctacaggtgattccaggcatgatgtaatatgaaatattacatctaatttaacttttagctttaacttcaagtcttcaaaatatacagggcatatggccagacgcagtggctcaggcctgtaatcccagcactttgggaggcaaggccggaggactgctcggggtcaggagtttgagatcagcctgggcaatgtggcgaaaccccatctctacaaaatatacaaaatttagccagcttggtggcacatgcctgtagtcacagctactagggagactgaggcacaagaattgcttgaactcgggaggcagaggttgcagtgagccaagatcgcaccactgcactccagcctgggtggcacggtgagactctgtctccaaaaaaaaaaaaaaaaaaaactaaaaacaaaaacaaaaacaaacaaaaaaaaaatatatatacacacacacacacacacacacacacatatatacacacacaaatatatatatgtctatataaacatatatatttcttaaagataaatatgggctgggtattagacgacattaagaaactattactattattaggtgtaatagcagcattgtgattatgtaagaaaatgtctttttttacatgctattaagtattcaagggttgaatgacatgacatctaagatagttttaaatatctaagatagttttaaatattaaagcaaaataaagggaagtagagatatcaaataattatggaaaaatgaatatggtttggatagctggtaataagttcatagatactatacttactacttttgtgaaaatttgaaattttcattaaaatatttttaatactaaaaaactcataagcatttttttaaaaattaagaagctttgtaatgtttggtcacacagctagtcactggcaaggacagaatgaaaaccaaagtctcctgccttttatattaatgctttttgtacagtattatgctgcttatacagtactatggcacaatcacctctttttaaatcctttctgttttacagtacatgaaaccacaatccaaaacattcctcacaacataaaatacataagttacataagaactcttagatttgtttgctatttttatgaacatcatcaatgaataggcactgctcaaatttatacatgagcaatagtacaccttcttccttcttacaattttaccaaaatttattggtaaaaaatcattctaaattaaattttgttcagggatatagaagtgtccattgctaatgcttctgggtatttaacatgatcctatcttgttatctgctataaaattcaaagaccaataagcaacaatgtcttgcaatactgagaggctgtatttaatacatacatcttactcactgtaataaaattaaacatagttcataagttgttacaccatttaaaaaaaaagtttcatatatgaaacataaattagggaaaagccctgaaatatagactcttcaatttttaaaattcaatttttttccaattatattacttcataagtaaaagtcattcattacttcatcaaatagttcatagctaaataaattatatccttcaatagatctaaggaaattgctattccaaacttaagtacttctaaaatctgaactttctttttcaaataaactcattgttactttttgactgcatgaaaataatatcgctcatcaccaactccatttacatctatagaagagatgaaattcctaactaaagcttcatatgtacctactgatattgtaagggtcaaacgaagtgctcatattgcacagttaatactcaaatatagatatcttaaactattagcctacctataaccttgcatttccattatatccttattgctacaagagagatgctttttcacaggtttttaaaaaattcctcagaccatctcctagctactgttagtcaacaaaagattacaataactaaagctgccagttgatacttaaagacactggaatacagatgggagtgtcattcccatgatttttcagtttgaggagaatacaagtatattatcctaaaccatcaatcacgggcccaaaaaaagccagatttagcaaccacctaatccaagcacttttgaatgcaaaaattaattctatatcatcatttataaaaagccctgtagcttcaccttaaaaaatcctagttatgaggtcaggtgcagtggctcacacctgtaatcccagcaactcagaaggccaaggtagggttcaatcttgccagtacactgcactccagcctacacaacaaagcaagactctgtctcttcaaaaacaaaataaaataaaaaataaatcctaggtacgaagatgaagattggtattttgaagtcagtctgataaactcttcaactcattatttaagaaattatcctctattgaactgcaatctgttttctgaggaaatttacggtaaatctactttcacttggttaagtcactctctctaatattcgaaggcactcactacatggcaatgctccatgcgcaaaaagaaaaaaaaaaggaaggaaggaaggcagaaggaaggaaggaaggaaggaaaggaaaggaaaggaaaaggagaaggaaaggagaaggaaacgagaaggaaaggaaaggaaaggagaaggaaaggaaaggaaaggaaaggaaaggaaaggaaaggaaaggaaaggaaaggagaaggagaaggaaagaaaaggaaaggaaaggaagggaagggaaaaggaaaggaaaggaagggaaaaggaaaggaagggaaaggaaaggaaaggaaaggaaggaaagggaaaggaaaggaaaggaaaggaaaggaaaggaaaggaaaggaaaggagaaggaggagaaagagaaggaaaggaaaaggaaaggaaaggaagggagaaggaaaggaaaggaaaggaaaggaaaggaaaggaaaggaaaggaaaggaaaggaaaggaaaagaaaggaaaggaaaggaaaggagaaggagaaggaaaggaaaggaaaggaagggagaaggaaaggaaaagaaacgaaaggaaaggaaaggagaaggagaaggaaaggacccattattcctcatccactccataaatagcatggtttccaatcccctcagcaacctacctcagcatgctatctagtttgacaatctcaaagtacactacctagaagagacccaggaatctatgaatgacgtaagcagtatagagtaaaatgctgttatctctatttgtaaaacagaattctacaaataacaatgcattccttatctgtgtggcaatacattgttgttcatatggatctaagttcaagtaaaatcctgtgacactagtctctccaattctttgctctcaaaattaattttaatgtatcaaaaaaaaaaaaaagtcttagttctttggttcaacacataattctacgctccatccaaatcactgataaaaatcttgaagattacaacataatagacatgtgacacagtcttcaaaagatagcctatgagaaaccttgtcaaaggctgacaacacttaaacaatgaaactccatgttatttcattatccatgtaagtttttaatcctgaaatataaatacatacaaataaaataaagaaaaaccacttacttgttccttctataagcagttcttgtccatggctacccaaaagtgtccgagaaagaaaaggtgcaaaatccacaaaaatctcacgaaggagaggagctgccttttccaaagcgtgttcaagcctctctgtaatactaaggaaaagacattaagttacttgaactattcaacagattgtatcaattttctagttttgaaaataaagatgtatttccatatatatatataattatttaaaaaaattaaaaatcacctaaagagacattactgctatgcatagcagtccttctgccaaaaatattcgtttttatcctgatctatcttgcccctacaatctccaacaaacaacctggttaacaaccactccaagcatcagtacttactacaagtctcacctggccagttaagagcagtttgtttttaggcccattataatctaaacaaactctcatcaagtcttcaacaaatttttctatttaccactaaaccattagcacactgagttcaagaaccatgacttcattttaaaattcacagttatagcatatagtatagactcaacagacgttgagtgcttataaattataaaaagcagttcttttttattgaagtcaattattcctttctaatgcaatgtgaatgatttttctcctgaaaataatatactttataggcacattataacaaaactatcatttggttgatagttatatttattaataaactgagatagttgtaaatgtacctataaatatataaaaatatattaatatatatttgtgattatatatacatgtattcatgtatacatacacagatacatttaatgagggttttttttttaaggtccccagcatttcagataattcacagatatccacagctttagtttctaacttacaaattaaacatatacataaagagccactagttatctactattaacactaggagtacttcctattcatactaccaagaagacagttgctactgaaactatcaacacaaacatatataaatttttgctgtgaataaccatctcctcacaggcactgctctaaatactattttcttccacacaactcatagaacttgttatccctgaagagtatcacaaatactagctatactcgaagcactcaagtacctacatttgtagtgtctaatggatttcccaattgtggtaaagaaaatcaaggactctctggacactaagtctccagtggtggaaaatacactcaaagcattcgaaattaaactctgaaacccaattaaacaaggtaagtaacaataaaaatctatctacaattcagtattattgtggctttggctgactggctatcacttatatcagcattttgttgttgttgttgttgttgttgttgttgttgttgagatggagtctcactctgtctcccaggctggagtgcagtggtgcgatctcggctcactgcagcctctgcctcccgggttcaagtgattctcctgcctcagcatcccgagtagctgggactaaaggtgtgcaccaccacacctagctaattttttttaatatttttagtagagatgagttttcaccatgttggccaggctgatcttgaactcctgacttcaagtaatccgcctgcctcagcctctcaaagtgctgggattacaggcgtgagccaccgcacctggcctatatcagtattttatagaggagaaacaacaaattccacactttcaatttgcaatcatttgaaagaaagtcataagcttatgtaaatatttgttatgcatgcagcaattatttttttaccacaaatagtcacttctcatgaagtgacttgtacatcatgaaatgacttgtacatcatcaaatgacttgtacatcttataatctttcaaaagaaaatgaacttctaaaatgttcccaagcctctaaatgtcatatatgttgaaagaaagaaatgaaatgaaatgaaatgaaacgaagtaaaataaacctagatagcttaaaaagtcatcaaaaggtataaatcacaatattcaagttagtagcttaaatacctcatatttgaaaccggatcttgtgaaactgaatcaactgttggaactgagggcaattttgcattagatgatctactgcctataaaagaaaaataaccatctataggaattttctgcttttagatatgaagatttaaataaaaagaatgtcattataccagtcaataaaagcattataacgtatttttatgtccattactatttggataacattaaaatctaacaattaacaactaaatgctttcatatataaacctcagctacaagctcaattatcatgccagagcaatctttctatccatgagctgaagaagcaagagaaaagtaaattctgactccctaaataaggttcacaattccttctactcaacaccaagtgtcaacagaaagttacaagtaaaagcattttcttaacatagcaaaaacacagaaacagctacattccaaatttagctttaaacctccattaccatgaaaactatccgtattcagttatcaaatcactactaaaggactaaattgtagcaataaatgtaatcagggttagaagcctagatctctgagaatctgtaatcttgtatcacaactattatcagttattttccccttatgccccaaatacaaaaacactatgctttaaagagaataagggccctctttcccaaagattgttgaatctttcagtccaaaagtgattagaaacacatcaaggaaagcatctgcatcaggctggaggttgtgttggcccagagaaagttattggagccagtgtgaggaggaaatccaaggaaaagagaaaactgagaattgtagaattcatatctatatgaattcatggttccaataaaggatggaaataatatgtgaatgacagtatatatttttatagacttttatatacaaacatacacacacacaaacacacacactgcctctagctctgtccactaagaggacacggaagcagcagcatcttaacacttggtgtccagatcttggtttctaaatactatactccactaaaagaaagaaatggctgattcaagatctgtgtaagaaaagcacaaaatgagtttgaaacatctagttatgctttgtagaaagcaaggaatgataagatatatacaaggaataaggttatgtcaaaggacaatgaagccagcttgaaggggctcccactgatcaaataccattgtactccatcctgggtaagaaagtgaaactccgtctcaaaaaaaagaattgccatttttggccaggtgcagtggctcacgccagtaatcccaacactttgggaggccaagacaggaggactgcttgagctcaggagttcaagattagcctgtgaaacacagcaatgcccgtctctactaaaaatacaacaaagtggccaggaatggttgtgtgtgcctgtggtcccagctaggtcccagctcaaggatcacttgagcctagagggcagaggttgcagtgtgccaagactgcactactgcattctagcctgagtgacaaagcaagaccctgtcttaaaatacgatacgatacgatacgatacgatacgatacgatacgatacgatacgatacgatacgatacgatacgatacgatacgatacttccctctgcttcacaccactcccagaacttcctcaagctcacttcaattgtatctaggaattctgattcaatgtgctctttttggtaaggcaaataaggttaattctggatatagataagcatagccaggacctaatcagaagatttgtggatataactgaataaaaaacagcaaggatctgaggcaattttgaactttcctgaaacatgcttggtttttaggcagtacttgatcaataaccctcagttctgattaccaggtctcagtcaaatctaaggatccaaaaatctagacaatttggccccccaacaagcttggttccttttggaaagcaggcaatgcagcaatcttccacaattaacctctggataattactgagcccaccccttagagtgagcacatacctagtacaaaatgaacttaactgtagttaatctttcttttccacaacatatttcctttcccattcccttgataatcaaagttgactttcctttatataccggaagttttgtattgcttacagtcctgccttcctcaccatcctgctcaactgagatctaactgtacctaaaaactctaaccaagtgactgttggtcaggacgcataggattcgtttaaaaatgaagctaaagcacacacttcatcatgctgacaattattttttatttttctttttttgagagagggtcttgctctctcacccaggctggagtgcagtggtgtgatcagagctcactgcagccttgaactcctggactcaagccgtcttcctgcctcagcctcccaagtagctgggaatataggtggatgccaccacacctggctattttctattttttttgtagagacagggtctcattatgttgcccaggcgggtctcgaactcttggtctcaagcaatcctttggccttggcctcccaaagtgcgagggttataggtgtgagtcaccatgcccagcccattgtgacaatttttaaaagcataaatatcaattcacatttcatcataaaaatattgctatttttgtgtttttcacaataaaatttcaaattagagggcaagaccagggaagttcaaaaacattttttcaccctttggtatctggcacttctaagagtcaggtccaatcctaaaatcatatacaacactcagtaaagtacttcacagacccaatggctttattaaactcagtaaatgacacctgcaattttctaagttcttgacaactatatgatcactgaatcacagtgggtcattgactgttaccagtgattaattaaatagttctgttttcttaattggtgatagtttttgaagaccatttttattgcaatgtatcagacattttctctattaggattattgatggattttcttgagcttttctgaagctaatacaaaggaacacataaggacccatttacttaaaagtagaaatggaaaaaataaatccctccccagaaaacatatgcatgaggctttaggaaaaaaaaaaaaagggggtgtgcatgaggctttaggcaaaattagtctttactgtgttaactggtttattgggttttttgttttttgttttaagagacgaggtcttgctctattgcccaggctggagtgtactggtgtgatcatagctcaccacagccctgagttcctggactcaagtaatcctcctgtctcagccttctgagtaggtgagattacaggcatgtaccaccacgttcagctaattttttttaatttcttgtagagataaggtctcactttgttgtccaggctagtcttgaactcctggcttcaggtgattcttccaccccagcctctcaaagtgctgggactacaggtgtaaatcaccacaccctgcccactgtgctaaatgatactaattttaatgagaaatgcatattagaaatgtgaaaaagaaaagcaacattgttacttctaaataaagcagtaacaaaaattatttcctcacactaccctagaagtaatgccaattttcaattctaaaagagaatatagcagaaagagattttttacagtgtcttaagtcataagaagacactttaccaacacggataataaattaaccagcaatagttataagaaaaaaatcacatgaaagaataaactaaatacaccagtaatttcacactaggttgtcctccattcctgctgtggaaaaaaatgtaatatccaaacacattctgtattttttcaactcaggtaaaaatataaactttcaatcaatttgttttaaattatcattaaatatttccagcaaatgatcacaaatacataaatgcagaagctacctcctacatgtggaatgatactcacttatcttttccttatcctagcactgataaactggctccttctaactgacagttttccagacattcaaaagaacaaaaaggaaaatgcaaatatatcatctgtctagcatctatctggggagtaggcaattgtttatttaaggtccctgcgggtctaaataactaatgtcccttgcaataaagaatcattaaaacaaatgccaatttttaacccctaaacactttagcactgcatttctctctctcttttctgaaccagttaattcagcctgggatagtctacatgcccagtaaaaactaattaaacaaatcctattgaatgaataaaaataagcctattggcctaaatcttacacaaagcaaagatggttatgactcaaatatttccctaatattaaaaaagtactaattaataatgtatatggctctgataaacagatactgtctaatattctagtaagtggtagaattactaaattttgcaaaatagcaaacaccaggcatataaattagtgaacagtatacttagttccactattgagctagtttcaattttgatttattcatttatgctttgcaatatagagaaacagcatattggaaaaagaataatgatattttaacatacaagaagggatatgggtgaaagtggaaggatcacttgaagccaggacttcaaggcttgtctgggcaatagaacaagactctgtctctacaaaaattttaaaattagccaggaatggtgacacacacctgtagttctggctacttgggaagctgaagcaggaggatcactcaagcccaggagttcaaggctgcagttgagctatgattgtgccactgcactccagcctgggaaacaaagacagaccctgtctcaattaaaaaaaaaaaaaaagaaagaaagaaagaaagaaaagaaaaaagaaaggatactgtattctaggtaatcagatctttgctgatgactataaaatttctagattttgatatatttactaaaatcactttcgcttttctttgaaaacatgcatatacaaggatatgccttatcctctgatgaatatcttttaatacttattaattagaagatacaattgttgctcttagactagtccttttggttgataaaatgctgcataagctaaggtatactattcaaattaaaatttgaaatttgaaatttgtacaccaaaaaagttttgtatgttaattacagtcttaataatgtatactatttcaaaatgcaaacaaattctcaatttttatgggttataaaatttttcagtgataatattttcatagaaaaagcttggacctcatataaagctggcaagttttaactctgtttctgtgattattatctatctagtactagtttctctttaattgtaccacatgtaaaatgtgtctcattttgatatcaaaatttccaaatatccacaaatgggaatttccttgaagatatcatgtgaatatataacagaaaatatgaatgtcacagaagaaacttcatattttctatcaagtaaattttttgcccaactgtaggataatgtaagtgttctgagcacatttaagatagggtagattaagctatgttgtttggtaagttaggtgcattaaatgcattttcaattttcaatattttcaccttacaatggtttatcatgatgtaaccccatcataagtcaaggagcatctatattctaagtcacaaatgcatttaacagagcctattttataagaaggtattggatatatcacataatttactaaatattgtattgaaagtgaaaaatagaatggtcatacggatacttgaggtacagtttttactgaatgtgtattgctttcacaccattataaagtcaaaaaattgttaagatggaaccatctatatatttatctacttattttaatggcagataacttaaatcgagagacccaccaaaaagaaaacaaaaatttaacagttaaaaaaatactgacaagggaaagagaactatttgggaggttggggtagtttccatgtgaaaatgagtactaacaagtacaagggcaagtatagtaggcaaaagcatgtaaagtggggcggcagaagagtaagaagcaggacaaccaaaaacactagattaggttagatttttcttatcaaggcagtaatgttcatggcatcaattaacggaataaaatagaagcaatacactgaaatagagaacccatatgacagtaacaagaacacagtgaaagaggaaaaagaagagtcagatgtggaaaccaaaacaaatggtaaacagaaagaccatcatcacaaggaagacttgaaataactgaaaaagcaataactgtttttttaaaaatggggggggctaaggaggggaaaaaagtttaaaattctagctcaagatggaaaaaaaaattggtaactatttgagaaactccatcacaaattatacaaaatttaaacaatagaaaaataagatacattatgagctggatcaatggtatagggttttgtagattttgccaataaatgtaacagtcttcaagatagcaaattgttttataattctgcatacagtttttcaaagtgaatattttaaattacaatgaatttattggaaaaaatacaatggtttcagagagaaatgtataatactgttacatgtaaaatattacccatatgtctcagctgtttcttatctcttctgaaaactccaagacttaaattttaaagaatagacttaaaagcaatcaaagggtcctatttcctctgttcctaaactgaaactagagggcagtataagaaaatattttactcaatgtactttgaatttctgaaactacatttgattttggatgttaatgaaaaatttactatacctgaatttaaaagacggcaggtaaatcatttcatagatattaataactattgcatttttcacaaaagggactactctagaaaaaccacagttgattctttttttttaaaggactttggatgggggtggagaagcggaaatgtgcatacccagctccaaatgaattaccaaattatttcttctccaaaggaaaaaaaaaaaagaggcatcagagtataatggaacaataaagatgaaaaatttgctagagtttcatgcccattttcctttgtaattctcactgggccaggggaaaccagcgagggagagaatgacagggtatttgagaattctctgtacttcaaactcaattttcctgtaaacttaaaactgatctaaaaaataaagtctattaatttttggaaaaaattataaaataaaaagcaaggcagacaaaactctgctaccatcgcagcttttggtttcaaactagaaaaaaaattctaatcactatttttcctaagaataaaaataatacaagactattaattaaatgttagaaatgccacctaaagtaaatttcgaaaatcaaaattgccagtagcccaacttcatggagatccaaatgacttcataatacactttcttgcttttaccatgtaaagaaggtagataagtcacttggttgtaattatacagtacgtaaagaattgcatataactttcttttacttaacctactggaacattttctctattcactaaatactataaaatttgtaaaaaaattaaatacatttaaaacttcttataaaatgtatttttgttaacacaagcacaataacaaataaaagagaagacaaaagaaataaacatagtatttgtttctaggatacatgattacatagtacacatcaaggaaaaaaattcccagctactggccagtagcaatatcaagtttggaacaaaactctccaagatatgctaatttgccaaataaaggtggaacagcagaatagaaggcaaaccctggcctgagatatcccaaaagaagtaacggcattatttctgatctcaatataatccaccaggccattccttcaaaattcctttattttccgtcaatctcaacctagaatcataagatgagtgttttggtaggtacaatatcttgttattaactttaagaaacagcaaaatatccagaagaaaaccactgatacagtaacatcccttttgttatacttggtcattttaatactgcacattcttcacattattcaagtttacccagtatcaccattaagcttcccatcaatgtataggatcttgcatccatatatatgcttttatacatggaaataattttttatccatatatatgcttttaaacatggaaagaatgtagaaggagagatggacaaaaataaaagtgctataggaggaaatgaaccagtatgaccattgttagaatgatgctacacttcagagcagcattcctttccaagcctctaattcaaaaaaatatgccaaaaaaaacaaagtattggacactatataaatattttttttttgtacagtccaaaatatttgacaaccagtaaccacattaaaagattacatgtcaacaagactttcttatttaggccactatctatatacatcttcttaagtgcagggaaagaaaataaaggaaaaaaatatttttatgaatctatcattcatccatgcactcatctacccaactagcagcatctaatctaccacacactactaggtttgagtggagaaaatagtgaaatccttgacttaatttcttttaattttactcaaatttattcagaaaagtagtaaacaatcaacagtataaaagtacaatggtttctaatgtgcccccaaattttaagttaatcaaaaatcttaagcgttgctaaaatgagatctaaaaacatttttgttgaaatcactgataactaactcacctggtgattctcctcccatatctgaggcttgggctgaatctactgaggaaaccacactgacagcattggtaggtatgcttgtattaaaggtggaaggtgagactgctgacttttttgctgcaacaatgacacttctgtaataaagaaagtaaacagactgaaagatacaaattgatctcttgaattaattacatgaatttcaaaacagaaactaggtagctaacttatttttctaattttctttcttatttctatttgatgtacaatttagacttttcacccaacatgaaatatcttcaatactgtccatatttatctgcatttcactatgaaaatataataatctatttaacatttaagcttatatttaccacatagtatttttaaaatttaggatcatcttaattatctaacaaataaaatataaccaaaagtattaaagcagaaaattcaacgtttccacaagaattgtaaagcactgctaatctgaaataataaaaccttagaaatcttataagcttaaaaaaaaaaagcagatataagcaatttgctaacatgtatacaacccagtttttcatttttaaaccccaaagactatatcttttgataatatataaaaaagcaatgcataggaataaaaaccatacgcaaaaatatcaaatagtcaaagttctttatcttgtatattattcaaacacaggtatttatgatataccaatttcaattaaaatgtaatactttataccaaacagtaagtaaaagaccttgttaggcataacttaaaaggcatttttaattgaagttggctccataaacatgcaaaaactcagttaatgaggtaaagaggacagctgatatataatgcactcccacagcagtgcttacttttaattacctggtgttaaccataagcccaaagtcttcaacattcaatttatttaatcacatcttttgttgacagtactataactgcgagcttcaagtattcccttaatagctttaaagtattcagcttctaaacaaagtaacttaggtatttgatccctatacatgcattcaaaagtgaaaattatgtaattccaatattttaataatacatttttgtagttatttttaaaaacacacacacaaagcaaaataggtttcgttttacctcagtgcctatcatgtgagggcaaacactgttgccaattaaatcaaggtctcttgtgctaggcatggcttattcaatgtacttcagggtagctggtgtcacatcattataagggtgactgccaatgttaactatacactaaaaaatagaagcaacagccacctgagcccccaatccaaaatggtgtgcttaaatcacagcagcttatatcagatgaagattattgacttaagggggagtagatatgacgaatgtctgtgtgtgtgtgtgtgtgtgtgtgtgtgtgtgcgtgcacgaatgtgtgtgtgtacgtatgtattagtggtaccttcaaaaacaacgcaaaatgtaatttttgtatttcctactggagggagaaatttaaaacccattgcttaagaaaatcactgtcttctaccaatgtttttgcaggggagggaggagaaatatgaagaatttactttcacatttgttcacaaaagaaagaaccagcaagatctagtttactcatactgtaagtagggactgaattgagcaatagaaaagaatacttagaaaagtgcaattgctttttctataatcaaaatgtaagatatatacccatctatgctatgactcaacaattccacttctaggaatttcctcaagaaagcttatgtccacaaaacatgtatacagtaatggtcatacaggctttatttataatagtcaaaaactggaaatagcccaaatgtcctttatgcagatatagtaaatttttaatggtgctatgcttctagaatggaatattattcagcaataaaaggtaacaaactactgatgaatgaaatgaaaaggtaacaaacaacatggatgaatctcaaaagcattatgttgaatgaagtcttatactaaggagtatatactttatgggttttttttttttaacatgcatgtctagaacagacaaaactaatttatggtagaaaaaaatcagaataattgcctctgggggataggaacaggaattggctgggaaagagaactttcaagaccaatgatatcatgatggggacttaaggttacacaagtgtataaatttgtcaaaactcatcaaatggtacacttaagacctgtgtctttcattgtatgtaaattttagctcaaaaaaaaaaactgtattcatctccagttagagagctgcatgctggctgaaatatttaagagtgaagtgaactgatgtctacaactttgaagtacattacaaaaataagattgattgatggatacatggtgaagcaaacagagctaaaagctaattgttgaatctcagtgatgggtctacaggtgttcactgtgcaattctttcaacttttctgtatgcctgaacattttcataataaaacactggaaaactggtaacagaacagaatttactacagctgttccaaatatgcacaatccctatttattcaagatgacatagctaattaaacacaacaaaagaactcaacttcatttctaatcctctagcctcttgctgttaatgtttcagtcacaaataagatcttattcttttattcagttcagtaaatatttattgtccaagatctttcacctattgtcaggaatgatagatcagaagtacggctttctacatgaatttacattttacatgttcctcacacacttcttcaacatgctcttatggttgctaagcgtgttgtgtcatttcacaactccaacccttcgtatatatgcctcctctgccaagatgctttcttcttaatcctgcttgcttgttaggtaatataaaattataaattctaatagcagctaagataaatgcactgacaatatgccaacaattattattcaattctcaaaacaatcctaaggtacatattaattcaatttttagaaattttaaataaaaacctcagaaaggtaaagtaataaccaaagtaaatggtagaactaccatggaaatctaggtttatctaacagcagagccttgaatttgaaccgtttccccatgttgacctttcttaaaacttcagagatataattcacataccatttaattcactaaaaatatacagttaagagatttttggtatgctcacaaagttgtatatttatcaccacaatcatattaacatttaaacataattttagaatcatctataatcaacagcaataaagatctctaacatataaaattatttatatactaccataaaatcacaaaaatacatctgctcataaatttttaaaagctgaattatttcatatagctacataattagtatataatagagaaataaaatcaatttccaaattcgctgactgattcaaatcaattctaaggaattaacataacattgcttcagcttaaggctacacaaaatcaaagaaaaatcaaagttacaatgatccaattaaaaggacactaagcagtaggtagattttgaaatattttcattgtctttaccaatcattgtcattattactataaagtttcagtgtaaaagactaaaatcttcaacagagatctttaacctatcgtgtttatgttgttaaatataagtataaatctaaattagtaaagcatgttccacagttaacaaaaataatctagaattttaaacttaccaatagttaagattgatcatgcaaaaactaagcatttaatattacctttttatacaatgcattggaaaacacagaggaaaatgcaatatgcatttgacaaaactgagactttacatgacagacaatgtgctagggatatttctggcatctttctcaggctacagcttaagtttctatttaagaaacaaattgaaatcttttttaatgtttaagaacaattattggaactttttatatctacatcaattttagcagaaagtgcttcaaactttttagcataaggaatctgaaagatagacaaccaattatgcaagctggtttcccaaattgtcaattataaaccaaatattaaaagagataaaaattgttcttattatcatttttttctttatgaactcactatgaatacttaatatttgtggggcaccgtgcttaagaacatacacaaattatcatatttaatttatgacaacccttgagattagtagtacatattattatgctaattttacaaatgagaaagaagtaattttcctaaagtaccacacagaacaaatgaaaatactgttgctggattttttttttcccctgaacaagggatactcatttcaaagtttcttttaatttactggcaataggcaaatagcaacaatgccttcccgatcaataaagttgagaacttccatttcagtattatatcagtttcaaatatcacaaaccctcacacaaatgctattttacttaacatgcaaatagttcactaaaggaaaaaagagcatttcagcctaccacttcagtccctaaggatccagttgaaaagccaaaccagtccttgaactttatcaagataaatccctggcattcactaatcatcagagaggatcttcaaattagataagaacaagaattttggcatgggaatgaacacaaacacctttgcattcacaaaggcccacaacctggcagcctttcagcaaggttttattcatgtagctgttactctaaactttccagctattccttggaagttgataatacttaagatatgaggagagttgtgatttctgacatagcattcctgagataaatacatgatcagagggatgctttgaaattcccaaagatattccactagcccaaggcagcatgaaagtttttacaaaggggtctctaaataagaaaaaaaaagagggtaaaaaacagagcagtttccttgccatcagagactgttaaatgaatactagacatgttaaattctacagaacatcctggaaaatgctaccatcaaaattatctgttgttttctatttcaataaaccccttaaaatgtattacacctaagcatgatttcctaaatatgttcatgatctactcactgaagacatcagtaaggcacaaatttaatttctacactattttaaaaagaaataaatgctaaaatacataaaattttgatcattagtaaacaatgtaactatattaacatatattaaatttaaaagtatagcctcacatatttctgggtactcaatctaacactaacaaatctaaataaattataaaaattgagaatagacagggcacagtggctcacgcctggaatcccaatgctttgggaggacaatgcagcaggatcgcttgaggtcaggagttcagcaccagcctgggcaacagagcaacacctcatctctacaaaaaattttttaaatagctggacatgttggtcccagctactcaggggactgaggaagaacgatcccttgatcccatgagtttgaggctgcagtgagctatgactgccactgcactccagcctgggtggcagagcaagacaccgtctcaaaaataaaataaataaataaaaattgaagccaggcgcagtggctgatgcctgtaatctcaacactttggatcacttgaggccaggagtttgagaccagcctggccaacatggtgaaacctcatctctactaaaaatacaaagactagctgggcatggtggcacacatcagtaatcacagcttaaaccggtaagcacagtgttataaacacaaactagttctatttttagttgcctcgggaacctccaaactgtttcccatagtggttgtagtaattacactcccaccaacagtatatgaaggttcccttatctccacatccttgccaacatttgttactgcttatcttttggatataagcgattttaactggagtgagatgatatctcattgttttgatttgcatttttctgatcaatgatgttgagcatcttgtcataaaatcatttgacatttctatgtcttctttgagaaatgtctattgagatctttagcccattttaaggttatcatttcgtttaaaatgtagtaatatttttaaattattattaatacatttcttcctatagagttggttgagtcccttatatattctgattattagaacccttgtcagttaaccagaattataagtttattatataatccccagtctgtgggttgtctcttcaatttgttgattgttttctctgctatgcataagttctgtagcttgatgtgatctcatctgtccatgtttgctttgactgcctgtgcttttggggtattactcgagaaatctccccagattaatgtcctggagagtttttccaatgattttttttcagtagtttcatagtttcaggtcatagatttaagtctttaatccattttgaactgatttttgtatatagtaagagataaaggtattcattcttctgcatatggatatacactttactcagtaccactgagaagactgtcctttccccattgcatgttcttggcacctttgtcaaaaatgagttcacttgtagacgtgtggatttatttgagttctctattctattccattggtctatgtatctgtttttatgacagtatcatgctgttttggttaccatagctctgtagtataatttgaagttttgttctctttgctcaggatagctttggctattctgagtctctgtggttccatatagtttctaggaatattttttctatttctgtgaagaatgtcactggtattttgatatggattgcactgaatctgtagattgctttgggtagcatgaacattttaacactattaattcttccaatccatgaatatgaaatatctttcattttgggggtcctttttagtttttgcatcaatgttttatagttgtcactgagggatctttcacttctttggctgtttattcctaggtattttacttatagctattgtaaattggattactttcttgatctctttttcagattgttcactgttagcatatagaaatgatactaatttttgtatgctaatttttgtcatgcaactgtactgaatttatcagttataatagttttttatggactctttaggtttttctaaatactctaaatacaagatcatatcatctgcaaacaactgacatcttcctttccaatttaaatgccatttctttctcttgtctgattgctttacctaggacctccagtactgtgttgagtaacagtaatgaaagtgggcatcgttgtctcattccagattttagagaaaaggctttcagtttttctctgttccatatgatactagctgtggatctgttctttatggctttttattgtgttatgttccctctatatgcagttttttaagggtttttatcatgaaggaatagtgaattttatcaaatgcttttcagcagcaattgaaatgatcatatggcttttgtcttccatcctgttgatatgatgtatcacactgatagtttgtgtatgctcagacattcttgcatccccagaataaatcccactcattatgcatcaatttttaaaaagtttctttgagacaagttctccctctgtcacccaggctggagtgcagtggcatgaacacagctcactgtagtgtcaaactcctgggctccagtgatcctcccgcctcagcctcctgagtagctgagactacaggcacacatcaccatgcccagctaatctttttgttttaaaatctcaccgtgttgcccaggctagtctcaaattcctggactcaagcaatcctcccacctcagcccacaaaatgctggaattgcaggtgtgagtcactgcacccagacaaaaaaaaaaaattcataaaatgaaaaatctcagaagacacaaaaataagttaaaatatatcaaaacttacaaacacaaacacttagaaatagtacatggtaccatctacagttaaaagaaatgtaaacaatgtaaatttcaattattaaagcataactgtataaaattaacattaatgcatactgtactactgtaataatttcatagctacttcctgccacaattgcattgagcattggtattgttagcatcacttaaaatgctgtgtgacactagtcatctcagagcacgcagttcatctctttttatggggcagggggggaaggagttttgctcttgttgcccaggctggagtgcaatgctgcagttttggctcactgcaacctccacctcccaggttcaagcgattctcctgcctctgcctcccaaatagctgggattacaggcacccgccaccacgcgtagataatttttttgtatttttagtagaggtggggtttcaccatgttggccgggctggtcttgaactgctgatctcaaatgatccacccgcctcagcctcccaaagtactgggaagtttgtctctccagtaaactgtgtatcacggtaaaagtgctctctcccagttctcatatatttttcatcatgtttactgcaatattataaacctttgataacataatgggacccatacaaagtgccactagcaatactggacatgctcccaagcagcagggaaaagtcatgacattataagaaaaagttgaattgcttgatatgtactgtagattgaggtctgtagctatggttgcctgccatttccaaagaaattaatcccgcataagaactattgtaaagaaaaggaagttggcaaagttgtcactgcagtgacaccaggaggcaaaaaaacaaacaaacaaaaaaacaaaacaaaaaaaacttgcactttttgtgaaatatctttatcttgcactgaaaatgcagcttttatgtgggtacaggattgttataagaaaggcatacctatagactctaacatgatttgagaaaaactgaagtcattatatgtcaaatttaagtaaaaaagaatctaaggctagatttaatgccagcaaaggatgatcaagataacaggagaagcagcttctgccaaccaagaggcaacagatgagttcctagacatcaagaaaatcatttagaagaaaggaccagcccagtcaggtttttaatgcagacaaacgtaacctatttgggatgggggggaagccacaaaggatatttattagcaaggaagagaagtgagcactaggatttatggcaggaagagataggctaactctactgttttgtgcaaatgcagttgggtttatgatcatgactgcccttatctattaatataaagctgctaacccctgagccttgaaaggaaaacacaaacaccagctgcaagtctgttggttgtacaagaaggcctggacaaaaagaatcctttttctggattggttctattgatactttgtccctaaagtcaggaagtaccttatcagtaagagattaacttttaaagttcttttacaattggacaatgctcctgaccacccagagcttcatgagttcaacactgagggtgttgaagtggtctaactgccctcaaacgcaacttctctaattcagcctctagaacaggaggtcacaaggacctttatggttcattacacatggcattcttaggaaacaactgtcaacactatggaagagaacccaacagaacatcgtgaaagtctagaaggattataccactgaggatcactgttacagaaaaagctgtggaaaccatcaagtttgaaacaataaattcctcctagagaagactgtgtttctaggtgttgtgcatgactccacaggatttctgacagaactaatcaaggaaatcatgagagactatagatatgacaaaaaggtgaggggtgaagggtttcaagatatgaatctcagagaaattcaagaactaacagataccacaagaacagaaggatcaacagagggaaaacaatttgacggagacaagaacatccaaaccactattagatgaggaagacatagaagaagcagtaccagaaaatgaactgacattagacaatctggcagaagggttctaatgattcaagactgcttttaacttcttttatgacattcacccttctatgatacaggcactgaaactaaagcaaatggtgaaagaagggtttgtaccacatagaaacatttttagacaaataaaaaagcaaaaaggtcagaaagaaattccagtgcatttctgtaaatttacaccaagtgtgtctgcctctcctgcttcccctttcactttctccaactctgctacctcaactgcccctgagatactaaaatcaacctcttctcttcctcctcctcagcatactcaacatgaagacaagaaagatgaagatctttatgatgattcgcttcacctgatgaacagtaatatatttttttcttccttatgatttctttttttttctttttttttttttagacagagtttcgctcttcttgcccaggctggagtgcaatggtgcgatctcagctcattgcaaccactgcccctcctgggttcaagcgattctcctgcctcagcctctggagtagcctggattacaggcacaccccaccatgcccagctaatttttgtatttttagtagagactgggtttcaccatgttggtcaggctggtctcgaactcctgacctcaggtgatccacacacttcaacctcccaaaatgctgggattacagatgtgagccactgcacctggccttccttatgattttcttaataacatgttctttttttctagcttaccttactgtaagattacagtatataatacatataacaatcaaaatatgtgtgaatcaactgtttatgttatcagtaaagtttctgatcaacataagctattggtagttaagttctgagggagtgaaaagttatatgtggattttcggctacacagggcgtcatcatccctaacccccatgttgttcaagggtcagatgtagaaacataccaaaacgaaaaactattatcagtacctgtcaaaagatctgaactgcacgggttgttccacagatagatcaccaagggctccaaggcaggctggtggcagaagggcaggatccactgtgactccatctgctggtatgttaaccaagcttcggagaatgtctttcacattgacgttttttgaaactgaaactgacggtgtagccttagtgtccaagtcatttcctctatcatttttggtttccggagacttattgacttctaaagaaagagtagatagcacctcgctgattgcatctgggcctgcactgacaccaggaggtgctgtgtgaggagttacttccacatggcttcctaaaccagtggctgtttcttccccaatgcctgagtccctccttcgagcagatgatgtgctttcagattcttccactgatgccgtagttaaagtgctgaatgctgctggtgtgatttctatatcatacccagaaacacaagaaataaacaaacaaaagtttagaactaatttttaaaaggtatattctgttttaatagctatctactgttttgaattatgaaatacatcatgttctaaaaaagcaaaaactaattacgtattctacagaatgtactgagtgggtgcacctattatcaagacagatggtataataaaataaataataaaatacttgcaaaaatgatctaaagtaatgggtagcaacacaaggttgaaagtcattggcctgtaagaaaaagtctataatcttttttgggggtgtgtgtgtgtgtgtgtgtgtgtgtgtgtgtgtgtgtgtgtcagtctgttgcccaggctgaagtgcagtggtgtgacctaggctcactgcagccttgacctcctgggctcaggcgatcctcccacctaagcctctcaagtagctgagactacaggtatgtgctaccacgtctggctaatttttctatttttttgtagagatgaggtttcaccatgttgcccaggctggtctcaaactcctgagctcaagcaatctacctgcctcggcctcccaaagtgctaggattataggcatgcaccaccatgcctggcccaagtccgcaatctttaggataaaataaaaagctctacctcaaacatggttactgcagctggaaaacttgttaccccttctacgtgcataaataattcaatgatccttaaaatccagttcaacaaggaacacctccttttctctcttttaattctcactccctttaatcagggtttcaacccattctagcaaaaatagtcttatcaaggtcaccaaaaaatctgcatcttgctaactccaatggtcagtgttcagtcctaataggacttcacataacagcaacagctgattattccctccaactagacaatgcttcctttcctcggctttcaggacaccattctctttttgttttccttgtactacttcactgactgttccttcttaacatccttcacctctttttctccctgatttcttaagttggagggacacaaggttcagtccttgttcctcttatgttctctgtctgcatttagtcccttcgtggtatcattcattctccaagttttaaataccactatatttccccaccaaaaaactcaaactattaaatataactgctaccctacaacttatcttacatgtctaaaaaaacctctcaaactcaacatgctgaaaactgaatttcttctctttttatctttccctgaaaatctctttcacctttaatctactccactgtaccttgtaatcatttttgactacctttttcattcacaaaatgcacacctaatgttttaaaattctgttttttctaccactaaaacatattcagaatctgactgcctctcaccatctctagttaccaacctaatccaacccaccataacctcttgcctggattactgattactgcaatatcctccttcctaactgttgtggaagagggttgttttaataatcctactgccccatgtctcctggtatgcatcccttgacaagcccttgaatctggactaggcttgactgacaataacccacaggatctggcaaaagcagcagtgggccagtatttggcccacgttttaaggtctggcagctcttgcattcccagaatctctgaacatctctgtaagaagtgtggcttatttctgatctaccttgctggaaagaacatgtagagagacgatatggagacagagatgctctccaaactaatgaaggaaaccaggaactcagttgagaacaagtatcaaggctgcagacacacaaccccagctcagctgttttagtcagtcagtctcagctcttggagccatcccacctgaggcactatatatactattagaaaagtcatcttagattttccagacccagcaaacatcatctgaaacagggataaaccatgcccaccgtgccctatccaaatctaactcaagaaatcatgaaggaaagattaaaatggttatggtcttaggacactaagtgcagggtaaggtattaaacagcagtacccagccaaaaacactgattatccttgccctctacgctatatcctctacacagaatacagagttacttttttttttttttttttttttggaaacggagtctcactctgtcacccaggctggagttgttgtggtgggatctctgctcactgcaacctctgcctcccaagttcaagcgattctcctgcctcagcttcctaagtagctgggattacaggcacccaccaccatgcctggctaattttttgtatttttagtagagatagggttttaccatgttggccaggatggtctccaactcctgacctcaagtgatccagctgcctcggcttcccaaagtgctgggattactggcgtgaactaccaagcccagcccagaggtactttttaaaacataaattgtaactcctgtactcaagaccctccaatgagttctcatttccctcaaagagaaatccatacccaattactcctggtcattcctgatatttttaccatctttattactttctttttttttttttttagcactttcaccaccttctaaaatactacacaatctacttatagcatgtagatattttctatctcctcccattagaatataagctccataaggaaacagattttttgttttgttttagtcatgaatatatacccaagtatccagtagatattgaatgaatatcgagtgaataataaattgcctcctttgggtggtagctacttctataattgcaacagctacttaactaactatacttttataactggaagctacttttaatactccaattattgcagttacttgttaacaagtctgtctcttagaatatgagttagtgattcttcacagcaaatgaagtcaataaaatttttcaactctttttgtataacattttctgacttacatttaattagttcatttaaagaacaaaaaatatcccaattgcaattaattacattatatttaagccacaacttttagttaataataaaaatatatgtatgctctcccttaatttgcacagaaatggatttaaattccaatatcaatattttaaccatcaaaagtaagtaacatttatttgaactttggtacaaaggaatagaaaatgcaaacttaccagagagtgatacattctcattttcactgccagtttctgtacatgactggctatgcctttcattttggggttccaaaatgtctctgtacttggagaccataagaacagagataaagtatactactgccaaggctaaaaattgagcttgtttgctatcctcctgggaaaaaaaattaaaggagttgattatgtaaccataaaataacatcattatattttacatcacaatgtttaaatacaaaacatgttcacaaatctttcaatatacacagaaaatacattacctacgtaaataataaatttattaataaacttacttgagcaaacattaggcaaagactcttagaaaaatgtctttaaatgagaagctttatacttgcaaaacatggaaagagagaagttagctcatttttttaaattattcaatctaaagacgtatgtcctaatatacattataatgttaatcaaacaaacagtaattataattatatgaaaacaggtcagatgcagtggctcacacctgtaatcccagtactttgggggccaaaccaggcggatcacttgaggtcaggaatttgagaccagcctggccaacatagtgaaaccccatctctactaaaaatacaaaaattagccaggtgtggtggcacatgcctgtaatcccagctactcaggagcctgaggtgggagaatggcttgaacccaggaggcagaggttgcagtgagctgagatcgcatcactgcactcaagcctgggcgacagagtgagtgagactctatctcaatcaagcaatcaatcaataaataaataaacaatgatatgaggataactggttatttttatctgtaatcataaaaactaaaatacataaaatatcacaataaaagtgccaaaaaataaacatgcagaagaaaaaaactgaagctattagatacagaataggatgccaaaggaattccttcttttttttgagacagggccccactccattgctcaggctggagtacaatgacacaatcatagctcactgtacccttgaactcccatgctcaagagatcttcctgcctcagcctcacaagtagctaggactacaagaatacaccaccacatccagctaatttttgttttttaatttcttgaagagacagggtcttgttatgtagctcaggctggtctcgaactcttggcctcgagcaatcctcctgccttagcctcccaaagcactgggattataggtgtgagctcccacacctgaccacaaaggaattcttgagagtatttaaaatagtacaaacaattatatatcaagatttaaaaaaaaaggatctatgagaaagaagacaaactagactgacctcttgaagggcctaggctccattctagctctacaggtcacctatatatcactgacctctttatcttgtcaaattccccatcttcaaggagaacctacacacaccactattctactaactttcccaaatatgtttgaacttgttaatttaaagaaaaaactcaaatttatctatcaaattctgaaaaccaaaggctcaagcagaaggtaaatttaaaataagaacatgaagaacactgttccctatcagataaatccaggcataccatggagataccacaggtttagttccggaccactgcaataaagtggctatcacaataaagtgagtcacacaaatattttagtttccgagtgtatataaaagttacgtttacactatactgtaatctattaattgtacaacagcattgtatctaaaaaaaacgcacataatttaaaaatattttatagcttaaaaatgctaacaattatctgaactttcagtgagtcacaatctttttgctagtggaaggttgcatctccacattcatggatgtcgactgatgggtgagggtggtaactgtagcaatctcttaaaataagacaagaaactttgccacattaactgaatctttctttcacaaaagatttttctgtagcaagcaacgctgtttcatagcattttactcacaggattggagtcattcctctgaaaccctacaaaggttttatcaaatacatttaggtaatattctaaatcctttgttatcatttcaacaatgttcacagtatcttcatcatgaatggattccattgtaggaaaccaatttctttgattatccataggaagcaactcttcattcgttggagtattatcatgacattgtaggaattcaatcacatgtttaggctctgcttctcattctgattctcttgctatttccaccacatcagcagtgacttcctccatggaaatcatgaactcctaaaagtcatccatgagaattgtaatcaatttcttccaaactcctattaacattgatatgttgatttcttcccatgaatcacatgggtacttcatggtatctacaatagtgaatcaattccagaagattttccatttactttgcccagatccatcaaaggaattactatctatagcagctacagcctgataaaatgtatgtcttaaataataagaagtatttcttaaatagtaagtcaaaatgactcttaatccatgaactgcagaatgaatatttcactaaaaagcatgaaaataacatgaatctccttgtatatctgatcagagctgttgggtgaccaggttgattatcaatgagcagtaataatttgaaaagactcttttcttctgaacagcaggtctcactagtggccttaaaacattcagtaagccatgtcgtaagcagatgcgctcttatctaggctttgtccttccttttatagagcacaggcagagtagatttataataattcttaagggtccgaggattttcagaatgataattgtgcattggctttaacttaaagtcaccagctgtattagtccctaacaagagaatcagcctgtcctttgtaacactgaagccaggcattgacttcctggtagctaggaacattgtaggatggtatcttcttccaataaaaggtgttttggcttttgttgccattgcttttggtgttttagacatgaagtccttgcccatgcctgtgtcctgaatggtactgcctaggttttcttctagggtttttatggttttaggtcttacatttaagtctttgatccatcttgaattaatgcttgtataaggtgtaaggaagggatccagtttcagctttctacatatggctagctagttttcccagcaccatttattaaatagggaatcctttccccatttcttgtttttgtcaggtttgtcgaagatcagatagttgtagatgtgtggtgttatttctgaggcctctgttctgttccgttggtctatatctctgttttcataccagtaccatgctgttttggttactgtagccttatagtatagcttgaagtcaggtagtgtgatgcctccagctttgttcttttggcttaagattacattggaaatgcaggctcttttttggttccatatgaactttaaagtagttttatccaattctgtgaagaaagtcattggtagcctgatggggatggcaatgaatctataaattaccttgggcagtatggccattttcatgatattgattcttcctatccatgagcatggaatgtttttccatttgtttgtgtcctcttttatttcgctgagcagtgatttgtagttctccttgaagaggtccttcacatctcttgtaagttggattcctaggtattttattttttttgaagcaattgtgaatgggagttcactcatgatttggctgtttgtctgttattggtgtataggaatgtttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttctttctttctcctgacggattgccctggccagaacttccaacactatgttgaataagagtggtgagagagggcatcgctttcttgtgccagttttcaaagggaatgcttccagttttgcccattcagtatgatattggctgtgagtttgtcataaatagctcttattattttgagatacgtcccatcaatacctaatttatacagagtttttagcatgaagcgctgttgaattttgtcaatggccttttctgcatctattgagacaatcacgtagtttttgtcgttggttctgtttatatgctggattacgtttattgatttccatatgttgaaccagccttgcatcccagggatgaagcccacttgatcatggtggataagctttttgatgtgctgctggattcggtttgccagtattttagtgaggatttttgcatcgatgttcatcagggatattggtctaaaattctctttttttgttgtgtctctgccaggctttggtaacaggatgatgctggcctcataaaatgagttagggaggattccctctttttctattgattggaatagtttcagaaggaatggtaccagctcctccttgcacctcgggtggaattcagctgtgaatccatctggtcctggactttttttggttgttaggctattaattattgcctcaatttcagagcctgctattggtctcttcagggattcaacttcttcctggtttagtcttgggagggtgtccaggaatttatccatttcttctagattttctaatttatttgcatagaggtgtttatagtattctctgatggtaatttgtatttctgtgggattggtggtgatatcccctttatcattttatattgagtcattcgattcttctctcttttcttctttattagtcttgctagtggcctatcaattttgttgatctttccaaaaaaccagctcctggattcattgattttttgaagggttttttgtgtctctatctccttcagttctactctgatcttagttatttcttgccttctgctagcttttgaatctgtttgctcttgcttctctaattattttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatgtacccagtagtcattcaggagcaggttgctcagtttccatgtagttgagtggttttgagtgagtttcttaatcctgagttctagtttgattgcactgtggtcggagagatggtttgttataatttctgttcttttacatttgctgaggagtgctttacttccaactatgtggtcaattttggaataagtgcgacgtggtgctgagaagaatgattattctgttgatttggggtggagagttctgtagatgtctattaggtccacttggtgcagagctgagttcaattcctgggtatccttgttaaccttctgtctcgttgatctgtctaatgttgacggtggggtgtgaaagtctcccattattattgtgtgggagtctaagtctctttctaggtctctaaggacttgctttatgaacctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatctctttattttcagcctatgtgtgtctctgcatgtgagatgggtctcctgaatacagcacactgatgggtcttgactctttacccaatttgccagtctgtgtcttttaattggagcatttagcccatttacatttaaagttaatattgttatgtgtgaatttgatcctgtcattatgatgttagctggttattttgctcattagttgatgcagtttcttcctagcatcgatggtctttacaatttggcatgtttttgcagtggctggtactggttgttcctttccatgtttagtgcttccttcaggagctcttgtagggcaggcctggtggtgacaaatctctcagcatttacttgtctgtaaaggattttatttctccttcacttatgaagcttagtttggctggatatgaaattctgggttgaaaattcgtttctttaagaatgttgaatattggcccccactctcttctggcttgtagagtttctgccaagagatccgctcttagtctgatgagcttccctttgtgggtaacccgatctttctctctggctgcccttaacattttttccttcatttcaactttggtgaatttcacaattatgtgtcttggagttgctcttctcgaggagtatgtttgtgatgttctctgtatttccttaatttgaatgttggcctgccttgctaggttgggcaagtcctcctggataatatactgcagagtgttttccagcttggtaccactctccccatcactttcaggtacaccaatcagacgtagatttggtcttttcacatagtcccatatttcttggaggcttcgttcatttctctttactcttttttctctaaacttctcttctcacttcatttcattcatttgatcttcaatcactgacaccctttcttccagttgatcaaattggctactgaagcttgtgcatttgtcacgtagtacttgtgccatggttttcagctccatcaggtcctttaaggacttctctacactggttattctagtttgccattcgtctaatcttttttcaaggttttcatagcttcttttggatgggttcaaacttcctcctttagctcagagaagtctgaccatctgaagctttcttctctcaactcgtcaaagtcattctctgtacagctttgttccattgctggcaaggagtggcgttcctttggagggggagaggtgctctgattttttgaattttcaaatgggatctatttaaactgaagagcttctgtacagcaaaagaaactatcatcagagtgaacaggcaacctacagaatgggagaaaatttttgctatctactcatctgacaaagggctaatatccagaatctacaaataactcaaacaaatttacaagaaaaaaacaaccccatcaaaaagtgggcgaaggagatgaacagacaattctcaaaagaagatatttatgcagccaacagacacatgaaaaaatgctcatcatcactggccatcagagaaatgcaaatcaagaccacaatgagataccatctcacaccggtttgaatggcgatcattaaaaagtcaggaaacaacaggtgctggagaggatgtggagaaaaaggaacacttttacagtgttggtgggactgtaaactagttcaaccattgtgaagacagtgtggcgattcctcagggatctagaactacaaataccatttggcccagccatcccattactgggtatatactcaaaggattataaatcatgctgctataaagacacatgcacacgtatgttcactgcaggactattcacaatagcaaagacttggaaccaatccaaatgtccatcaatgatagactggattaagaaaatgtggcacatatacaccatggaatactatgcagccataaaaaaggatgagtttatatcctttgtagggacatggatgaagctggaaaccatcattctcagcaaactattgcaaggacaaaaaaccaaacactgcatcttctcactcataggtgggaattgaacaatgagaacacttggacacaggaaggggaacatcacacaccagggcctgtcatggggcggggttaggggagagggatagcattagaagatatacctaatgtaaatgacaagttaatgggtgcagcacaccaacatggcacatggatacatatgtaacaaacctgcacgttgtgcacatgtaccctagaacttaaagtattaaaaaaaaaaaaaggtgttttgtccacattgaaaatctgttgcctagtgtagacaccttcatcaatttcttagctagctcttctgcacctattgcttcaccttgtacttttctgttatggagacagcttcttttcttaaattttatgaaccaacctctggtagcttcacttttcttctgcagcttcctcacttctctcggcctttacagaattgaagagcgttggagccttatctgaaataggctttggcctaagtgtgcctggttggatcttttatacagaccactaaaactttcttcaaatcaacagtataaagccgttttacttcttatcagtcatttgctcactggagtaatcgtttacttttaatttcctttaagaactttgcatttgccttcacaacttggctaaatgtttggcacaagaagcccagcttttggcctgtatcagcttttgatatatcatcttcactaagcttaatcatttctagctttttatttaaagtgagagacatgcaacttttcctttctcttgaacccttagaggccactgtagggctgtaattggtctcatttcaatattgttgtgtttcaggaaatagagagacagggtaaaggcccctcccaaggagatggggagagacaggaatggccagtttgtagcacagtcagacatttattaagttcactgtcttaaatgggtgtggtttgtggtgccccaagacaattacaatagtaataccaaagatcactgatgacagatcagcatgacagataaataataataatgaaaaggtttgaaatattgtaagaattaccaatatatgacataaagacataaagtacatgctgttggataaatggcatggatagactagttcaacacagagttgccaaaaaccatcaatttgtaaaaaatccagtaatcggcaacatgcaatagcaaagcacagtaaaatgaggcatgcctgtaaatagaaactaatggtaaaaatgagactaattgttaatacttaatgtcaaaaattttggatataatcagtttcagaaaaatagaagataggctcaatttgaacatatccacttgatgcaattctttgacatatttgtgatccgtgatctgacaaaatctatgatattttgcaggttcatatgtaatgacttcttagtctgttggaaaaaacaaaggtacatttgtcttttttataaaccaccccttttctctagacatacccatgttcttctgccacacaattctgccatgttataataactgctgctaatgatattaatattcaaaatgcaagcaaataatttacttgttcttaacttcttagtctgttataaattagttatgccaatctaaatccttatttagcccattaatatgttcaatgtttactaactaccacatgaagtttacagtatatgcctgatttttggcctcaaataaaaaatatcccataaatcgtttacatttaaatcctaactcaagaaatagatttgctttccattgtagctgtcatttattgaatacttaccgtaggccaggcactgtgctatgtatttcatacatatttttattagcaaacttgaacaagataaggcttagagaagcaacttacttaaggacatatagtatgtaaaaaagcaaatctgaactcagattatggtgattaaaaaccttagctctttacctcaaggtagaaatttatttatgtcgtcgatcttaggtcatttccctttttttttctttttattttttaaatttttttattttattttttgagacagagtcttgctctgtcgcccaggctggactgcagtggtgtgacctgggctcactgcaagctccgcctcccgagttcacgccattctcccgcctcagcctcccgagtagctgggactacaggcacccacaaccatgcccagctaattctgcttttgtatttttagtagagatggggattcaccatgttagccaggatggtctccatctcctggccttgtgatccacctgcctcagcctcccaaagtgctgggattacaggtgtgagccaccgcacccacccagtgatttcctttttcatcataggttccttttgttccctaaagagactaaactctagcatgtaaaatatagtgttttcttttttctaaaactcctataaggtgattatataacttttataattacaaaacacttaaaattatttatgactttcagtaatcatatagtaaaggagatattctaattgtttgcagaatattgtaatataataactggttagaaggttcttcaagagccagatcatccagaggcactgtgaagagtttggattccatttaaccactaaaagatgatattagagaattctgaaagaaaaagagtaacatcatctattctagtttatttgtttgtttatgagacagggtcttgctgtgtcacacaggctgtagtgacacaatcatagctcacggtaaccttgacctcctaggctcaagcgatcctccccacctcagcctcccaagtagctaggactagaggcgtgtgctaccacatgtggctaattctattctagatttttaaggatcattctaggaaatataaagttatggacaatagactcagaacctgcccaatggaaaaaaagtgaacagaggagaaaacagcaacatttggtcctcaaactgaccacattcaaaggattccagggagaaaaaaagttgatggcttcttaattaaaggaataataacagctactagagaactatgatctaagaaggtagtatagccttttagttaagatcaaaatttcaagaatcagattccctaagtcctaaactcactttcacctcttactaattgtataatcttaagcacattacttaaatattgctaactccctcatagaattattgtgagaattaaacacacatatacagcattggtccccaacctttttggcacaagggactagtttcatagaagacaatttttcaatggacctgtagggggtaagaggcggggtgggggtagggggcatggtttcaggatgattcaagtgcattacatttataattagattttcataaggagcgcacaaccaagatccatcgcatgcacagttcacaatagggttcgtgctcctatgagagtctaatgctcctgcccatctgaccaggaggcggagcttggcttcactcctcaccctttgctcacctcacctcctgctgtgcagcctaagtgcaggtcagtggtctgggggttggggacccctgataagagcatccagtatcatgtttaatacacagtaagtattcaatactattaagtagtgataatactccaaattctacatatgcataaaaacctagtcaagaactaaagagaataaaactattgaaaaaaagggaggggaaaaagaaaaattgaggttagaaagtttgtaagaaatatatatgtaaaacatacagtaagtgttcaacaaatatttactaatgataatattccaaatgctgatgagtgcaattataaattatttttactttcatctttatactttctatatgactttaaattgtctacataagaattagcaatgttttctatcaaaatcagctgaaacaaaactgtttttcaactttaaaaaattagaaacaccaaactgagagcaacatttcatcatgcacctttttatcacattagtgtacctttgaggaaaaaatatccaatattcagtaaaataatatgccattcagaagttgaacattttattacattcagagcatcaattttagaattaagactgctgggtttgaatcctgattttatcattgtttatcaacactagcttggagatgttactcaagctttatgtgccttagattattcatctataaaatggaaattacaatagtacagctcaataagttgttggacttaattaatacatgtatatcacttagactgcttactatgtaataatgcattattccttttaatatcactatgctgatctgctagctcgctttatataaactatcttttctaatattctgtttctaaaatcattgtcaaaagaagtcgtttctagacctttctatctctgctccactatttgatatcacaaagaatttttaatctcaatacattaggcctaagaggaaatatgcatcagttaagagagtatgtgaaagacatattgtaacttactatgtctctgaaaacaactgccctaagccgattaatatccatgtcctgtagaagcctgtcaagatctcttactggagatataccgccagtcacaatgtccactgggctctatttaagattaaaaaaaaattgtatatatatatattcatatatacattacacagatattctttaaaaataaacacagtattcccagaaccagaaaagcaaagctatagcattcctttccccactttttttgtgtgtatgcttccttcttctttgaggggttggggagagaggtggagaaagatggcatgcaggaaaaaatgacatatttgaaggaaaaggcatcacagaaacaatcaaagtaaacactgggaaaagcagagaggtttaaatataaacaaatctttattgtgtatttaaacacaaatatttgaatgttatatgcaggcctaaagtaactattttaatctctgccagatttatttaactttatgttgaaatgaacaaataaaaatcttaattgtaaaataggagtatgctttttgaaaattaattaatctgtatacttaccttcgctgcagatttccctaaaggaataaggctatgcattggtttcaaggctttatctcccctagttttcagttgtgaatgctgttgacactccaagcaattccttactgcgactgcacaaactgtaatttattttaaggaaaagatagggaaagaaaagttaatatttaagattatggaagtgaaaaacatcaactacacaatatgatttacataagattttattcaaaacagacgacattcagcttattcctaaaatgtccctagactttatcgcctagtgttggttgtctgatattgttagcttccatgctgtggcccagttaagatttagggaggcagtatggcctagtggtctaaacgtttagggtttgctgaaaggaaatcagttcaggaatcttaacaataggctactatttcttagatctcaactaagctagctgggacaatctttagttaagaaaaggatagggaagaaaagaattgaaagaaatggaagaaaacagggaacaaagtacattaccatgaactagtcgaggtaacaatcttctattaccatcattaaagtaaattagttaaactggaaactttgatgttcttcttatattgcatcattacagcatgatattaattgagactaatagaggatatagcttttgaaagaagctttatagggtccagcatttactagctttcattaaaactgcttagaaaatgggagacaggaaagggaatttgattaatatacagtctaaaattacctaaggctcccacgaatcaggcagttagattacttagaaattaattttggattttaaatgatgaattacattatgtacccttcactatgaattgcttgataccatgtaatcatctaaattccctccaaatctgtagcactcaaggtacttgaactgagcaaaggagggagagcaaattaggaacaaaatagcaaacttaaggggggacttcacaaagaatcactggcctatcacatggctagcaggcatgagaatttagaaagaaagtgttctgaaaggtgcccaaagagagcaataaaagttgaaagaaaggaaggagggaacaagaggagggaagagagaatatggaatacagctttgtcaaatttgctatcagacccaagaaatattttactttatcaaatttgctatcagacccaggaaatacttttcatacaaactttttcacaagttgcataaaatcaaatttgagtctgtattacaaagttaaaaatcacacctcatttcctggtttcaatcagttactcttactgctgtcatcctaacttctaactccaacctcaggaaacaagaatgaggacaccagtgtccatcaacagataactagataaagaaactgtggtacatatacgcaatgaaataatattcagccgtaaaaaagaaagaaatcatgtcttttgcagcaatatagatggaactggagatcattatcttaagtgaaacaagtcagacacagagagacaaatattgtatgttctcacttataagtgggagctaaatagtgtgtacacatggaagtagagtgcgtaatgattgaaaatggagactcaggccagcggtgggggctcacatctgtaatcccagcactttgggaggccgaggcggggggatcacaaggtcaggagatcgagaccatgctggtcaacatggtgaaaccccgtctctactaaaaatgcaaagaattagccgggtgtggtggggcacacctgtagtcccagctactcaggaggctgagatagggcaattgcttgaacccggaagaaagaggttgcagtgagcccagatcttgccactgcactccagcctggcgacagagtaaggctccatctccaaaaaaaaaaaaagaaagaaaatggagactcagaactcagaaggatgagggggtgaggggggtctgatgatgagaaattatttaatggtacaatgtgtgttattcatgtgatgaataccctaaaagctctaacttcaccactaagcaatccatgtatgtaacaaaattgcacttgtaccccataaatttacacaaatacaatttaaaaaaaagatatcacacatttggactgttactttgtttaccatactctattaaatgatcttggacaagtcattttttaagtcccatttccatatataagaacagatggtactggggtggattaaattatctcttaattcttttccgtggctatgaaaaactaggaacatagagtatttccctagcctctgaatctgatgattcttgagtaaggctttgctagtatagccttgcacttttacttctagaaatgtactctttctaggaaagtgaaaagccttcgaaaatggcacacataaagcaataaagtctaaatattttaattataatactaatagattaaagaagtatactacaatagaaagagtaggagcactagttagacaaaagtatagtattcaaattctaccttcaccaattatagctttttagctatagataagtttcccaatttcttttatcttcaatttcctcatgaataaaaagaacaaaattgtcaccgtgaaaatcaacaatgacaaatgacaatagtcaataaatgataacttttattttgttatgcttacaattagaatgtctcttaaattttaaaacaactgtctataaattgttattccaagttacttagaatagcaagatataccattgattattaaatataaaatacttggaattttacatttaaactaatactattaaatactttgaatagcattttgagtaaaaattatacttgtggcaaaaagcacaggtatacattagtttatgtaacagacattcttgctaaatatgaaaaaatatgtcattaactacattttccacttccatgttatgttttcataggtgctttatctcttcatatgaccatggctcctaatggtttgcttccatttcttgtgccttctctcctcaccaccttctcttcacttaataatcaaatcatttaacaaagtctcgatatttacaactatatagaaggaaaattatgcaaaaaagggtttttttgttttgttttttgcttcacctaagaagtccagttaacattaaaaagtcatttcatgtatttttacttttacttagggaagaagtgtttccaggagaagaacagagatttcatgattttattaactgcattaacaaattaccacagcttttttgaataaaggctgtacttgaatgatgctagtttagaacgttgttattccagtgtgtttgtaagaaaagcagcatcaacatcacctgggacttggtagtcaattttaggccttaccctagacctctataaccctttttttttttgagacagagtcccgctcaattgcccaggctgcagtgcagtggtgtgatcttggctcactgcaatctccaacttccaggttcaagcgattctgctgcctcagcctcccaagtagctgggattataagcgtgcaccaccacacctggttaatttttgtatttttagtaaagacggggtttcaccatgttggccaggctggtcttgaactcctgacctcaggggatccacccactttggcctcccaaagagctgggattacaggtgtgagccaccaccccagcctagacctatataatctaatctgcattttaacaagatcatcaaatttatgaatcaccttgtgttttttaatcaccttaagtttatgtatctccttaaaatttcagaagcactactttagagcaaaaagagataggggagcacctctaattccagctactaggaaggataaggaggcgggatcacttgagcccaggattttgacaccagccttggcaagaaagcagaaccaccatttcagggagaaaaaagaaaaaaaaaaaaaaaaaagataggggagagtggaaactcctgaccaaaatcaccttagtaaatttttcaaaatacatcctccttcttgcccatccaacttaccaactactactatgtacattaaaaaaagtaaccatatgacaaattagctaacatatattttctcaccaacagaagacggataattttcaatgtcatctctgaattactgaaaaattttttttagtaaattcccaacggtttttagcagctcacctagtcggagacactgccgcaaaattcctccagatgacatacttttttcagcttcaatttcagtaaagccaagagaacttgcaaatataagcacatccacaaggctaattagcctctgcaaaaatgtcacagaggcttctattgaaaggccttgagtaggttcaatattttccagttcatgctgtaaagaataaagtttgacatttatatatatatattctgaaaaaaaaattttaccagatatagtcctaaaatttataaattgcataagtagtcagactttcagaaacctagtaacacagagtgatttatacttattatttcatctaaaaagggtgggggatgaggaggagcaacagaaccatacaggtgaaacatcatgaaccacattcttcactagctgactcatacttagggaatcaacattcttttaagttctttcattactagaacagattctaaggtcctctcaagtaaaagatcctattgttttttatttatagcacctacgatgcatagtaaccaccacatttaagttttagtcaataaagttgcataacactcatgttttcacaccaattttctatagtaattaagtccttactgtagccgatgtagcagctgaaagcaatggcagtatacccccacaagccatgaccatattgtccatcacttgagagatgagatgaattgtgttgtgtacaaagatgacattatcactgctattcacgaagtccataactgtctttgttgaatggctgtccaaagataaatgatatttactgataaagctaaagaaaggaaatcacagtttgcctacttgaggggaggaaagataagaaggtgcttttgcttcatcttgaaaactgaaggaagatgatgcagcaggcatttggagggtgtatacttcttcagaagaaacagaccattccatatcagtagttactatccatgccctccttcagtgctgaaacataaatactattcattttacactggatataaaaagttgaagaaaattatccttactgggaacaaaactaagaaatcatgtgacaaaaattaggaggtaaatactggtaaatgtgctattaaaaatgaattttcttctgtaatgcctataaaatgcttttaaacataacaagaatcttacacaaataaaaaaaaataaattaggtcactttaaaatcataaatcatacaatgggggataacttgaagtacacagattttttttaatgctaaaaatacattggaaatattgataatgttataacaattttttttttttttttgagacagagtctcgctctgtcgcccaggccggagtgcagtggcgtggtctcagctcactgcaagcgccacctcccgggttcacaccattctcctacctcagcctcctgagtagctgggactacagacgcccgccaccactcccagctaatttttttgtatttttagtagagacagggtttcaccgtgttagccaggatggtctcgacctcctgaccttatgatccgcctgcatcggcctcccaaagtgctgggattacaggcttgagcaactgcgcccggcctataccaattattttttaatacttctagtaataaaccaacttgataaacctaccttctggtgaattccgtgccataaaattgctacaggaaatctactacaaatttttttaaaagagaaacctctgcttttcacatttttgtaatccagataaggattccattcttataatggagaataaaagtgaattcagtaaaaccctaccatagaataatttctattctactttttaaccaaatgtctgaaattaattacaaactgtttctatggatttctttgaaaataaagactaggtttatacacatcttccataataaacatatagacaaaccttctccacatctgtatatctgtttctattgaaaataatagatcagtgagcaaacgttgatgcatctgagaccagttgaactcaggaatacgaaacacagtagatctggaatccctcctttgtccattaactgcatctggtgctattccttgccctggctgctcatgttgccttgatatctaatacagaaatttaaaaagtaataaaataggttcaacttcagcaggaggctttagcaaagtaaataatttagtagcttctatgcaattcatctaacacgtttttaagacactataagaaccaaattagagaaagaaaaattatcaatgagtaataacattaacattttagtacatgtaagcaaagctatcaaaagtgcaaaactaccacaatttaaaagtaattaacttggaaccatgttaagtattaccactatgtagcattttataaaagaatcaagtaacagttcttagtttttagccttagcctaaaagaaaggcagtatttagaatctaagtggcatttggattatgaagtggctagaatgaagaataaaaacagagataacataatgaagaaccaaccaacaaaaacaaaaaaaaggagggtgggacagaggataagaattgaataaagtggaaaatgacaacatgctaccaagcactgtctcatgggtcactctgagatatggacagaggagaaggctgtgcctctagatctcacaaagcctcctctctcttatagacttcataatacaattttaaatcacatgcttagtaactaaaattatacactggcaggtaggtagccctagagtttgttggaaaactaatgtactaggattgggttagtcaaataaaaggtaaaatgcaagtgtttccaatatttgttttataaactaaaattataccaatccttcaaagtggtaacttctggtgatactatggtaaaaatagtaataaaaactgtcatttaatgaactcacattaactgccaaacactgtgctaatgatctgaaatacaatcttcacattcattgcatttatttagttgtgaatagcatgtgaaccaaattcaaaataaaataaaatttaagtatatacacttgctcttttttaactcagtgcaaaagtacttgaataagacaatatataaaatcacctcaagcacatgtcgatgaggttgaggtgcttccacgttgggactggccttcaactccagcctctcagtatctgtagcaacattggaaacatccaacttcgcaatcttttgctcagaagaagcctcagagacactaccatgacaatcattaattaatttggtttctctagtgaggttagttgctttcttcccttcctccagcatctgaccaaggtctgattctacagctatttgggaaacagtagtttctggtgacatagctgaagaccctgatgctgtcatagtctgaattccagaatctttagaatcttgagtttcagtatcagtttgcttttcagtaacaggttttccttcttgaaatattaatttgtcatcattaccaaacatgtccagtttttcaccggcttcagatgcagctggagacaaactgttatcttggagctctgtgggtagattagcttcctcagtaggactgccttctactttcagttccacataatcatcatcttcctcttcctctactatagatttatccaagaattctggcatctctgaggcatcctcttctgaaggagaacttatagaagcagttacttcactgacagtcattgaatctttgccagttgttataaaagaattagaggaaatagccacagcttctattatgtcagaagatacttctaaatcatctgcattccttgtctcatttgtcagtgtttcttccaaagtgccttcatctggtaactcctgattttcttgctcagctttcatttcttcataagatgtattagtagtttgcagttcaatattagatgcagattctagtgaacttgtcttctctatacttgaattttcattaccatttgtggtgaaatgaggacagacaggagaatccttcgtatctggttgctgggatcctactgaaacattaatatcccttctaatgccagaggctgcttgaactgaagttgaagaacacagccctatttcttcatcaacttttccttgctgttccctaaatatattggcaaggttttctttgtgtatttcaaaagtgacctaggtgaaaaatgtacaatcagttaaaatatgcatgagaaatgaagacagaatacaaaatataaaactaaataattttcaaatacatagtttatataatacaataaaacttaattttcctatattttattttagtagaatgataaatgtaagtcaatcacagaaatctaaatattcattaaaaactacagccaattttaatgttaacaagtaacacagcatgaaaccacaagaagaacataattatttagcctattattaaacatgtataggaaaaggatacactattctactggccaccataacttgtaccagaatttaagtatgtaccattgggaagtgctttatgcactggataacacttgtttcaaccgctatgaataccaatttccccaggacttgtccgcaggagagattaaaaatatcaattaattatgctcaccattacagtagctctacagatatctattaagctacaaaaccattatctcactaagccaatgaatacaaattcttttagcaatgggagaaaaaagatccagcccttcccccaaaggttaaccataatttccaaagtttgaactggtcgaaaatagtctgaatgtttcagttgatccatccatacatccattcattccatttatatctgagtgactacaatatattaggcaccgtgaacattcctatatcatgctttgccttttacccaaatgggaaaaaactgaaaaagtaaatttttttttaaagagagtgctgtacttgttaatgtcacaagatttagaatttttaaaatctaaggattatcttatagccaccatcatatgatttccattggtgtttcaatggtaacccccatcaccccttgcaacaaaaatgccagaaaaacctataacacatgcagaaagtattagcctaattatagtttattaatcccaaaagtgtttgtttctgtaatctacattattatatagagtaaactgaacattcattcaataaatctttattgagccatagtataagaggatgataggacaatcaaggaagaaaagctgatttttttatccacaaaaatcaataggccttattgaatcacaagagtatacacacagatgaaaagcaaacaaaagtaaaaatgactctcaatgcaaaaatttccttctatcgacattaactcgcctttactcatgacatatacagaacattcatgccatgtgatatacctaaaaataaaaatgttcagggaatgaatattttcctgtgaatatttgtatttttcctaattgtaactatttccacattgtaactatgttcttaattctaaaacttagaaatctttttataatatttcaacaataaatgcatgtattcctcactaaacagtaaaatgacataatcacattaacaaaatatcaatttcttttacattcacaatgccaatattttatttgacatgggttctgtattttaattgaccaattcctcatattcattcaacaaaaatttactgaacatcggtagcaggccaggcattgtgtgatgaacacattgttcctgacttcatggagcttatattctaaagaaggtgtcagaaaataaacacacgaatatgtaagataatgtcaaatagtaataagagctttgaagggagggggaagtacagagtgaagaactgttctgaaagtctaggcgagaaggtgtatttactagtgtaactgcagtaggcctctctgttctatttgaacaaaggcaagaataaaagagagagcaagccatgtaaaaagaaaagagtttcaggcagagaagaacaaatgcaaaggccttggagctgaaataagcttggtatgtatgatgaataacaataaagcaataaactgagaactaaagaaaatgaggtcaaagatgtggccacgagctagattatgattgtagaacattatagactgtattaaagactgtattttattctgagagagccatttgagaattaagagtgtagggaagacaatctgatttccctttttaaaagatcagtggctgggcacggtggctcacgcctgtaatcccagcactttaggagtccaaggtgggcagatcacctgaggtcaggagtttgagatcagcctggccaacatggtgaaacattgtctctactaaaaacacaaacattagctgggcatggtggcacacacctgtaatcccagctactcaggaagctgaggcaggaaaattgcttgaacccaacccaggaggcagaggttgcagtgagccaaaatagcaccactgcactccaccctgggtgacagagtgagactctgtctccaaaaaaataagactggttagcctactttttggaaaactgactttagagagagcatttctccaccaacaaacaattatcattgtcaaaagaaagcaagttacatattaccaacctcacagtcattttgaaaataggccatttatttctacaatagcctgtgttatagaatgactttagttttcaataatcatttgctttgattttatttatattaaaggtttttagaatttgtattatacaatggatcaataaacatgagtatatgtaatttatatgtacaggttaagaaacaattttttttaatctcacatgcctaccacccatgtcaagaagtaaaacgttaccagtacctcacaattcccctatgtgccctgcccaaactgtactccctatttctccactacaatcagaaaaaaatcactatcctggtatttctatcgttcactgtttataaatagttttacctggaggtcagagctttgggagataattttaaaagatagttttactatctatatactaaacatacccattatgtttagtttaaaaaactaagtctaacacaaacctagccaattgtattttaaagagcaatactgccacacctgagctcccaagaaaagacaagatacacagaatctgtgagttgcagcagggcttcagcttatttgagagaatatgtaaagccatttctgggaagtcttataggcaagtcattaggaaatacaggaaatatagaggtcaagagaactggagaacctatcagaggcagtgtgtgccaggtagagtgtattggcatgaaatactttatatttttcaattctaagctcaccatggtgaacctctaccctaagaagtaggtcgaagcacagcatgtctttgtggagtgaagtgagaatcttcaggtgattcacattagacaggaaaacaggaatttaatcagcacatgatgaaggcaagcaagctaagtactcctaataagaatacaggtccacctctcctgagtgaaactgctccagtccagatggactgtcatctgcctactacatagctgctattgggatctccctttctacagtcctggagatccccttcatctctcttctatgttgtctcttgtttcttatatttcatttcttcctctttgtattattctctccttttgtgcaatatcctgcagtgccttcttaagaaaggatgtatataaatgttttgagatctcaaatcctgaaaaggtatttattctcgcttcatacttgattaatagtcagagtataaaaccacagatagaaaagcatttaccttcagaatctgaaatgcttttaaaattctaaagtcatttggtttttaaatttgcccttaatttaattcatccaatggtctaaaagctaaattgcaattgaacaactatcagtattatctttttggatgctgttttccttaagatatttgtgactttaaaactgataatttccaattaattgccagatattgttctaaattacccagctaaaagactagtcattaatcttcacaatcatttgatagctaatctatagctgtttgtaatgtttggaaagcacttctataaactactagttaaagatacttgtgagctaatgactataacatttcttttgccattattttcaacttaattggcactcaaatttactaattagtagataaaagataaacacaatacatccagatgttaatattatctttttaatctatacattaaaaccgtataacctgtaaaatttagacattttaaactgttaggcaatgtttagcaactgactttgtttttaagcaaaggcatctttttcagtgtctgttttcatatgaaaataccagctaaatatgatgttaacttctgattaagttaccaacctttgataaataagatatatctttaaaaacaggtggatcttcccatatgtattatcaatgagcataagtcaaaatgattgccaccacattaatgagatcttttataaagactctgatgtataacaatggtataggtaacagatataatggtaaaatcaagcattactgacataattaagagcaattctaaaggttggtagtacaatccccatttataaagataggaagaacactgacaaaagaatattgcagcaaataacttctaatcttttcatttttaaaacagtcattttgatcaattttaatttcttaaaaacagtctaaacagatgctttcatgcaaatctagcgtataaactggtacaaatttttagagggcaatttagcaatatctactaaaaactttttaaaacatgtacagactccttcctctggaaattccacttacaggaatttatcctacaaaataagggttacagtattgaaccaggctcatcattggtcaatgataaggaacagataaagtatgattataatataaatcaatagattttttaaatctctcttccatcaatttttctaaatacaattttggagaatgccagaatataaaaagaaaacttgaatcatttacacggtcactccttcctagaattttaagtggtctgataacattcaaatgttatatcaaagctgaatcttatgctctttacttctccataatgtcatataatatgcaggcattaaaattcatgtaagaagcatatcattaaataatactctaaaatagtaaaaatacgatcacattttgttagcaaataattatatgttatgtatagattcatgtatagaagagaagactaaaaggtctcgcactaaaatgttaataagttatacataggtgtttggataatggataatttttgttttctgtgtgtatgcatttctgctgggttcaagatttcctgtaatgaaaacttattattattttaaattttttaaagtaataaatgctatttggtttcaaaatgttaaagctaagaatacttttagccaggaacaaaggtacatgcctgcagtcccagctactggagaggctgaagggagaggatcacttgagccaaggagtatgaagctgtagtgtgttatatataatggcacctgtaaagaaccaccgcactctagcctgggaagcacagcaacagtctgtctctctctctttttcttttttttttttaagtgccatttaaatttgataaaaacacacacacaaacactcacacagaaatcaggtatttttaaagaattatttagcaattaaataaggtgcaaagtgctgataatccatgaaatgcggacattttgtaacttttttatttttgtaatttttgtgagatatctcctttcatcacccagactgaagtgcagtggcacaatctcagctcactgcagcttcagcatcccgtattcaagtgattttcatgccttagtccccagtagctgggaccacaggcatgcaccaccactcctggctaatttttgtatttttagtagagacagggtttcaccacgttgaccaggctggtctcaaactctggcctcaagtgatccacctgcctcagcctcccaaagtgctgggaggcatgagccaccatgtccagccaattttgtaacttttgaaatttcttcaaacaagtcgcttttaatcttatcatacagccaccataaacacatatacatttttgtatatgccagttcatatcttatgatttaaaaaataattttaataaaccaattagagaattctttaaaaaaaaatcttatttccacatgcttttacccaatctaaatggtagttttttcttatgtacagtgactgaaatgtatacttcagatatttcatttcttatgtacagtgactgaaatttatacttcagatatttcatcagtaaacagcaagtaaaatcttcagatatttcaaaaaatccaagataattaaggactttatcctcaaattcactatttaggaggaaatccaattcatattatacttttaactctaacatgactaatctttattcattttaagtcataaacccattctaacttatggcaatatgagtctagacaaaatacagtatctaaggtgttagttttatgtgtttagaaaagaatgtgtttacaaaattctcataattcagaatagtttaaatgccttaatttaaattttaattaatgagtaaaagcattttatcataccaagtgaaaaaaagtattacttaagcacagaaaaatgttcaatttgaagccaaaaacaaacaaaaaaaaatgaaaacctagacaacaaataagacaatgaaatcacaaacgttactaggtgcactctttaaaaccctgagatcaaagtaaccaacatagtgcagttatactagaagagcctattactgcttataaaacccagttcagctgctggaggagaggcatatagtgacaaacagcttccctgctacaaaggtggcaggaaatctatcaaactggacaataaaactgcaattgagtttctttggctttttatagcagcagcatgtatcctgatgtaactctgcaaaagctatccaattctgcaacattagttctttacacatcagttctttatcaagaaccatgttataaatttgggatattgagattcaaaatgactgcaaaaaggaaaaagcatcactttaacactgtatgtataaaagtattataaaatcttcagaacttatatttttagagaaaagaaaattttgttccaataattccagtggaatttttaatagctgctaaaaattgttcacctacttactgaatcactacagctctattctaagctttattaaataatgacttgaagagccttagggtataagtttctgtcttattttaaaaatagctataaagatttaaaattccaaaaaacttaacagcattcaaataaattactttgtataagcctcatgaaacagaaaagccttttaaaaatgaagaaaatccacacgaaggaataaaagacatgtatgaaacactaaaataaaaggtgaacaaatgtaagaaccaacttacaactttaaacttttgttttccctctcataagtaatgttttagcatgtatttttaaaagtatactttgacagcaaaaagtggtaggtctagttttactcagataaaaagactccatgattaacttagcattatcccatcttataaatgaatactaaaacttaagtcagtgtggttcttggtcaaaagtaggcactagagacctctccttaaagcaactattttcttcagaaaaattttaagatctgtttaaagccataagtcactggactaaagaaacatataggccgggcgcggtggttcacacctgtaatcccagcattttgggaggctgaggcgcgtggatcacgaggtcaggagatcgagaccatcctggctaacatggtgaaacctcttctctactaaaaatacaaaaaattagccaggcatggtggcaggcgcctgtagtcccagctactcagggaggctgaggcagaagaatggcgtgaacccaggaggcagagcttgcagtgagccaagatcgtgccacagggcgacagagcgagactccgtctcaaaaaaaaaaaagaaatatataaactaaacaaaactatagtcatgcatcacttaatcatgaagatatgttctgagaaatgcatcattaagcaatttcatcatgtgaacaccatagagtgtacttaagcaaacctagattgtatcacctactatatacctagactctatggtatagcttattactcctaggctacaaacctgtatagcttattactgtacagaagactgcagacaactgtaacacaatatatgtatttgtgttatctattttttttaatgttttaatttttgttttaacaaaagactgagtctcgctctgtgacccaggctggagtccagtggcacaatcatagttcactgttacgttacttcaaactcctgggctcaagtgatcctcccacctcagcctcctgagtagctagaaatacaggtgcatgccaccatcccagctaatggtgtgtgtgtgtgtgtgtgtgtgtgtgtgtgtgtgtgtgtagattgagactcactatgttgcccaggctggtctcaaattcctggcctcaagccatctttcagacttggcctcccaaagtgctgggattagaggtgtgagccaccattcccagcccttatattgtgtgtacgtaaggtttagaaatgtgtatctaaacaaatataaacatagaaaaggtatagtaaaaatccaatataaaagatttaaaatggtacctacataaggcatttaccatgaatggagcttataaaactagaagttgccctgggtcaatcagtgagtaagtggtgagtaaatgtgcaggtctagtacactacagaagactttataaacactgtaaatataggctacactaaatttatttttaaaaactacttttctttgttcaataagaaattaacctcagcttactgtaacattttaactttttaaacattttaatttttaaaactttttgactcttttgaaatcaaatttagcttaaaacacaaacacattgtacagttgtaaaaagatattttctgacaggcacagtggctcacaactgtaatcccagctacttgggaggctgaggcatgagaattgcttgaacctgggaggtggaggttgcagtgggccaagattacaccactgcactccagcctgggcaacagagcaagactctgactccaaaaaaaaaaaaaagttagaatggtgatcattaaaaaataaggaaacaacaggtactggagaggatgtggagaaataggaacacttttacactgttggtgggactgtaaactagttcaaccattgtggaagacagtgtggcaattcctcaaggttctagaactagaaataccatttgacccagccatcccattactgggtatatacccaaaggattataaatcatgctgttataaagcacatgcacacgtatgtttattgcagcactattcacaatagcaaacacttgcagccaacccaaatgtccaacaatgatagactggattaagaaaatgtggcacatgcacaccatggaatactatgcagccataaaaaaggatgagttcatgtcctttgtagggacatggatgaaactggaaaccatcattctcagcaaactatcacaaggacagaaaaccaaacactgcatgttctcactcataggtgggaattgaacaatgagaacacttggacacaggaaagggaacatcacacactggggcctgtcatggggtgggggagagggaagggtagcattaggagatatacctaatgtaaatgacaagttaatgggtgcagcacaccaacatggcacaggtatacatatgtaacaaacctgcacgttgtgtacatgtaccctagaacttaaagtataatttaaaaaaaaaaaaaaaagtccaggtgcagtcacgcacgcctgtaatcctaacactttaggaggtggaggtgggtggatcccctgagctccggaattcaagactagcctgggcaacgtggtgaaaccctgtctctactaaaaatacaaaaaaattagctgagtgtggaggtgcacacctgttgtcccagctactcgccaggctgaggcaggagaatcgcttgaacccaggaggtggaggtttcagtgagccaagattgcaccactgcattccagccagggtgacagagcaagactctgtctcatttaaaaaagacacacacacacacacacacacattctaaccgggtgtgtggctcatgcttataatcccagcactttcagaggcccaggcggggggccacttgagtccaggagttgaagaccagcctgagcaacacagtaagacctcgtctctacaaaaaaactaaaaaagtagccaggtgtggtagcacaagtctgtagtcccagctactcaggaggttgaggtgagaggatcacttgagcccaggagtttgaagttgcagtgagctatgagcacaccactacacttcacctgtctcaaaaaatattttttttcctttctctatatccttattctaaaagcttttttctctttttaaaattatatatttttcaaacttttttgttagaaactaagacacaagccagtcccggtggctcacccctgtaatcccagcactttgggaggctgagtcaggcagatcacctgaggtcaggagttcgagaccagcctggccaatatggcgaaacaccgtctctactaaaaatacaaaaattagccagttgcagtggcaggcaactgtaatcccagatactcgggaggctgaggcataacaatcatttgagcctgggaggcggagtttacagtgagccaagattgcgccactgcactctagcctgggtgacagggagactctttttcctgagcttacacagctaataattactataaatcaggattcacaccctgtctccaaagtccacattctttcattacttacacaaacggatttgaaaactggatataaatacttagtcataaatgctcacaagctcaaaacacctgagatatcacctaatccaactcctttattttgtatatagggaactcaaaaagactaatctattcatcctaaatatcctattattttctaagatagcagttctcaaactttttggtctcatgacactttatttatttatttatttattttattttttgagacagagtctcgctctgttgcaggctggagtgcagtggtacgatctcggctcactgcaactccacctcctgggttcaagcgattcttctgtctcaccctcacaagtagctgggactacaggcactcaccaccacgcccagctaatttttgtatttttagtagagacagggtttcaccatgttggccaggatgatctcaatctcttggcctcatgatccacccacctcaacctcccaaagtgctgggattacaggcgtgagccaccgtgcccgggcaacactttacattcttaaaaagtattaaggtccccaaagactctttatctatgtggattatatctactactgcttattatattaggaattaaaactgagaccttttagaactattaacccacttaaaaataataaactcaatatataatataaataacattttttgaaaatgattatttttcaaaaccaaacaataacaagaagagtgccattatttcatatttttgtcaatctctttaaagtttggcttcatagaagacaactgcattctcatatttgcttttgcattcaatctgttgcatatattggtttggctgaagtatataaagaaaatccaccctcatacagctatgcagtaggaaaggaggactgcacagaccccatgaaaagctctcatgggcccacgttcttttttttttttttttttttgagacagagtctcactctgtcacccaggctggagtatagtggtatgatcttggctcaatgcaacctctgcctcctgggttcaggcaattctcctgcctcagtctcccaagtacctgggattacaggcatgcaccaccgtgcccagctaatttttgtatttttagcagagatggggtttcaccatgttggccaggctggtcctgaactcctgacctcaagtgatccagccgcctcagcctgtgattacatgcatgtgccatcgtgcctggcctccctcccaaggtctttaggttatacttttaacaacgattgctttaaagtttatactcctccagccatctttcctaaggacttgaagaaactaaggtgaactgacatagatctgttagaaacgtgaaaaatctgctttatactgggcacttccctaacctataatctcccctagaaatctctgaaatctactccagatgtatatggggcacaaagtcaaccctatttttcttataatcttttgtaaatggcaacatagtatgagaaaaaaaatcagtctagattgcagcagcctactgcaatagaaatgagaatatctgggcatcagcacaaactaaagttacagaaaggatggcaaacagttcctgtaatgagccaaatagtaaatattttagattttaggggccatgtcgttgatgtaacatgtatgattatccttatagtgtgaaagtagccatatacaatatataaaggaatggtagtggatacattctagcacaattttatttagatctgacacttaggccatggctagctgaattctgttttaaacaaaactgatcaacctcaacaatacagtgactaaaacaaagccattttataaaatcagatctcttttcttatttacaaatggattttactccttgtaaacccttgtagaagcatactttctctcaatgaagaaagaggaggaacaatgaataatttgtaggaactttcaatcaataattaaaagctattcaaatacctagaaacatgtaattaggaaagggcaatatattcttttttttttttttttttagatggagtctcactgtctcaccaggctagagtacaatggctctatctctgctcactgcaacctctgcctcccaggttcaagcaattctcctgcctcggccccccaagtagctgggattacaggtgcacgccaccacgcctggctaatgtttgtatttttagtagagatggcgtttcaccatgttggccaggctagtctccaacttttgacctcaggtgatccacccgccttggcctcccaaagtgctgggattacaggcgtgagccaccacacctggccagaaatggcaatatattctacagaatgacaaaatatcttagaataataactttgatagtcagtaaaatgtaacacttaaagatatagagaaattatcattcttggtatttattccttctagtcaattttttattaaataaatagctatataattatacagtattccttctgagtaatgaaaaagttcttaaaattcaaaaaacatacaccgtaaatgaaactaatagattttaatgcattaattacttgaaatgtaaattttcctcagaaggtacaaacataaaactccaaaaatagttagataatccacatattggcagaagatgttcataaacaacatagctagcaaaggattaagaatgagactacataaagaactcccacaaaacaacaagaaaacacagatcaagattatggtgatgtagcattttaaattcatcaaagtgacaaatttttaaactccagccataccacgtgattaggtgatgtgaagcaatgagaacttaaacactgctggtgatatgtaaactgatacactactttagaatactgtattgtattggaatacgatactttggaaaagaatttgcattatcttgtaaagttcaacattttcaccttataagtcagcaattctacttctaggaatatatgcagaaaattcttgaacaagcacaaaatgtatacgaaaatgctaattaattggtaaataaatagtcatgtcatgcaatacattacaattgagaaaatgaacaaaactatatgggtcaatgtggatgaatctcaaacagtaataagcacaaacagtaattaacaaaaaaatgcattcagtatgccacatttaccttaagtgcaaacataaaaaataaaactctttattgtttagagttatatacacgtagtaaaggtatagaaaagacaaaagacaacaccaaataaaagctagtggtgttgggggtcaggcgaagaagaggagacaaagcaattatagaggagtaacccaatttcataaacagtgatcctttttgtatgcttagagtatttcaaaaaagaatttaagctatatataaataactaaacttactttggcttaatttaaaaaaaaaaaaaaaaaaaaactacattcttccaaacccagtttttagctacctgtaagattagcacagggcagacatcacccagagcttttctgtttactcatccaccttacgttgctaaaacaactgttcatctttgaatatagtgcgccaccttgtgttcaaaagcttttaactcatataaaattctgagacccatgtttgtaaacagggcttcctcgaaaaaaaatattaggttggtgcaaaaataattgcagtttttgccgcaactactttttcagcaccctagtataaattcctttatgctgtggcaatagatttaccattataaagataagtacatgtaaaaacaacattagaaaaaattattttgattctaaagaaattacaaatgctttatttctattgataatctttttgagctttcattttgctgtactttcagaagataacttgccttttttccttgattttaagtatcgaaattttttaaatgactaaaattcaaaaattatagatatttaaaatgctacaatacgctttcataaagaaacttacctttgaatgagtgattgataaagtgtctacccatacacgccagccaccccactcatatttgactgcatggtaaagcaggattctgaatatggcgtataccatttctgttatcttttgctcatctgaattcttaggattaaaatagcagagagaaagcatccattcttgccacacagagcattgtagcaagctcctgaaaattatgagagggtactaaattactgaagaaaaaaaaattatctaaaataaatctaaaggtttaaaacaaaataaccctgcccctccctttccccccgaaaaagaaacacatttagttatacattaagaacaattcgacaatgtggtactaaaaattctaacttaactatgtggtacattatttacatactcttaataaaaaaaatagaaaaatcatttcacagtatttttaaagcaatttttcttagataaaatgggcttatacaaaagtacatttgaatactgcaaataaatgctttctgattcagcttacctcctgttttctctactgttattaaaaagtttaatcatgtcagaaagaaaggctctgcgaacctccatgctctctgggcactggggagaatttcgaagtagggtcgcaattacttttagtatctctgtaagacagtttataaataagtaaaaaccaaactcaacaaaaaactcatgatagaaggtcatccatctattgcaatttctttagtttccctaacacaaatgtctaccaaaaacatcctcttctgttattaaaaaaaatcacctctggaaagaaatgacaatacattcattagaaagcatttataaatatgaaaggaaatttctttcatgattcaaatgtgcaaaaataaagctgaactttaaaaggttaaaataaaacaagttaaattataaatgaattaaatgtcagtgaaactgcttactctctctgagatataccaaatagtaaagttgatcttaaaaacaagcaggccgggcgaggtggctcacgcctgtaattccaacattttgggaagctgaggtgggtggatcacttgaggtcaggagttcgagagcggcctggccaacatggcaaaaccccatctctactaaaaatataaaaattagccaggtgtggtggcgtgtgcctgtaatcccagctactcaggagggtgagacaggtgaatcgcttgaacccaggaggcagaggctgcagtgagccaagatcgtgccactgcaccccagcctaagcgacacagcaagactctgtctcaaaaaaaaataatgaaataaaataaaaaatactataatcaaaatctcagaaaaatataataaattcttagattcctcatcataatttatggtatgcacacacagtctttcatagctgggattataggcacctgccaccacgcctagctaatttttgtatttttagtagagacagcgtttctccgtcttggtcagggtggtcttgaactcctgacctcgtgatccacctgccttggcgtcccaaagtgctgggattacaggcatgagccaccacggccggcctaccatagagaatttttaaaggtgtgaagattttctttcataatcttaaaagtaaaattagacacaaaaaacccaaaggaaattaaaacctattcaacatcccatctccccagaaaatgcaaactaaactactattgtaatggtcttagcataaagctatttaaatctccagaatttagcttaaattaggccaggcacagcggctcatgcctgtaatcccagaactttgggaggctgaggcagttggataatttgaggtcaagagttcaagaccaccctggccaacatggcgaaatcccatctccacaaaaaatacaaaaattagccaggcctggtagcaggcacctgtaatcccagctaccagggaggctgaggcaggagaatcacttgaaccaggaggcagaggttacagtggctgagatcctggcactctactctagtctgggcaacagagcacaagactcggtctctaaataaataaataatctccagaacttagcttcttagcttaaattaaaacaaaaaaaaaaattcttttaaaaatatgcacttagaccaggtgcagtaggctcatgcctgtaataccagcactttgggaggttgaggtgggaagattgcttgagcccaggagttttagaccagcctgggcaacataggcaaaataatgacatcacgtttctctgaaagctgaggaaaattaaacctcaaagccacgtgctttgaaaattagcactggagtaccaaacacacaaatacacctaaccacataaaatgtaattaaattttaaaactctacaaactaataattttaataacatgatcttaaaaagcaagatgaaaaaggtatactttatacaagtgcttaagaattctaaatatcaaaagaaaagactgtttaacaagactatcttcataaacaataaagaagacatattgttctattccaaatttggtatttttatattcacagtaatttaagataaaactaccccaatggttcttgtaattctgcctgacatcactaaatagcacaatcaaaattttgctgaaagtctgaacatatattacatcaagaccttaagcaaacaattcttcaaaacctttatataagaatttccacataacttaaggttgattcgaaggaatactcaatataaaacccaaacaaaactagtataatatcatcacccttaatgaaacattcatctaacaatctgtttcaacaacatcaattttaggttgttcacagtgactttctttttaagtagcaaaaggtagtttttgttaaagtatataaaatacatacgagggttttgtatcttcactgaagaatcaggatctggatgctgtttatgtatcacctgagtaccaatctgttctataagaatctacagaagtaaaacaatggattacattagcaaatcactggattagcatcactattaatgaactttaagtgcatcactattaattaactttaagtacaacactaatcaaaatatagtatatttttagtccaatattgtcatgctaaataatatacttctaaaataactacagcattattactctatgttttcttaattataaaatgagacatcaaatagttaataaaatggagggaacatttaaacagaaataacgatactgtttagaaattcacagattaattatagatttctaaaaatgcagccacatctccttatatcatttcaaagctgtacattacaaacttaaatggtctggtcagcatggtggctcatgcctgtaatcccagcactttgggaggctgaagtgggtagatcgcctgaggtcaggagttcgagaccagcctagccaacacagcaaaacccgtcactactaaaaatacaaaaattagccgggttaggtggtgtgcacctgtaatcccagctactggggaggctgagacaggagaatcacttgaacccgggaggtggaggttgcagtgagccaagactgtaccactgcactccagcctgggtgacagagtgagactctgtctcaaaaaataaaataaaaataaatgatcttatttacctacacaatgttaagaggcatttttataataagaaatttagaggagtaaatcctaagtacattcctacctcaaacagcacattatatgtggtcattgtgattaaatttgtctgaagcatgagcctttcagctagcaatgaaaacaatccatgtccaagcatgacttctgctttcctcctgcaattacacaaaaagaaatcatcaaatgtagagcttttctgtgctctacttaatatgcatgctggatgaaggaaacacaaaatactttttcacattacaaacaattcccaactcaattactctcccaactatcttcaatctagaacttttaaggccacaaaacctttaagcagagaaatgctaactatataagcatagccgaagttaaaaattaaaaaaaaaaaagacaagtgtgcctatgctacagcacagcaaaaacctcctccaaaatcttcagagcagttatttatttaacgaagttgctacaatctaccagcactaacttagtctcccctggggatgatcatctaaagcacaataaatacttaagtagaaaaacaatgtggagaaaaagtagaagaaatgtaatataattttttaaaataaatactatgaaaacatatataccaaaattaaccttccaagcataaattcagaaactaaaggatcacaaactttaattttacccttggggtcagcaaagcttttctgcaaatggccagggggtaaatattttagaatttgtggaccaggtgatttctgtcacaactcaacactgtccttgtatcatgaaagcagccacagatgatacacaaataaattattgtggctgttttccaataaaactttatttacaggtggctaactggattcctaaagacttcagtttaccaacacttgttctacccccaaaattttctttttaaaataaactacttctggtacaaagaacaagaggtagaacatgaatatctgtattcagctaagaaaataagcgtggaagtttcagttttgagttacgcatacagcagaacacactatgtgacaaacatccaggttatgtattactttataatacagataaagcaaaaatggtgtgagtcacctgaaatcaagtctccatagcttcttgaatgcaagctgtccaaactaattctcataattcacattaaatacatgaataatttaaataattttatgtacaaaaaaattaatcctgttcacttaatttttaaaatatgtactagtgggattacatttatacagcaatttatgaataaaaataaaagaaaaactagaggactatagaacaaaattactactgcaaagatttataaaataaataagtagaatacaacagtccatcttagatttcggcatacttactttggggccagatgttttaaaaaataacccattgccttaagagcttgtaccctgattccttcacttttcgatgccagaagtttgtagataacactgaatgaataaaaatttaaaacaaactattttgagtataatttttaaatggaaaggtttaaaatatatacttttcatattattataaatctatttcaaataatatggaaggaaatttaatatagatttctgtatataaaaaatctgcttatctcaggctagagttcctttcaatgaaaactaagaaatgagaagaaattggaatataagaaatgaggtgacttttccatgcacatacttatatgtaacgtgtgtatcaagctagctttcagatacttttttccttctgctacaggcttgtaaatgttctgaaggttaccaacttgttattttaagtcagtagaaagaaagcatttctaatggtagcacatatttaaatttctaaataattgtcgccatgaaaaacaagacagtaggctaataataaatgattatcagaaataattacaaaagtaaaaagatttacaaccaaagaactgctaaaaataaatttctcattcaattctcaaaaattatatagtaatctaatttaatttttaaagatctatgaggcagctggatgcagtggctcacgtctgtaatcccagcagtttgggaggccaaggcaggcagatcacctgaagtcaggagttcgagaccagcctagccaacatggtgagaccccatctctactaaaaatacaaaaattagctgggtgtggtggcatgtgcctctaatccagcttctcgggaggctgaggcaggagaatcgcttgaacctgggaggtggaggttgcagggagccgagatcatgccactgcactccagcctgagcaacacagtgagactctgtctcaaaaaaaaaaacaaacaaacaaagatctaggaaggccttctgattttagtataagtaaagtataatgcaactgaaattaaactgattcattacagcattcccttcctcataaacatttagaacaagaacagtaattagaaactcttataattacttataaaaattaaggatatcagtatcctcctagatcaaaattttggtgtttagtaagttagaaaacattctgaacaaaaaggaaatatcttcaacctctagtgatcaatagaaaagcaggtatataaaaaagaagtttgattccttttaaaacatgaactaaaggcatccaggtccatatcacattgtaactgcataattttaattcaaatcttagtacaaaaacttaacagtcaatcattaggaaaatactaatatgttgtatgtttcttttcttcaaggatttaaattcagccaaataaaaattaaaccttttaaaagaaatattaatataataccagtttaaaatcacaatagttttttgagtttttttccccaaagatggcagatttgagggctttagcatttctcagccacttagaaatagcaagatagtatataaaaatcaactgtgagctttaattcaggaagaaaagcaggactccaccagaatcatgaaaggcaccctagttcccgagagcactttgtttctcccaagacctggagctaactgggaaagaggtatggagatactgtgagggaaagacaccaggaaaagttgcagggaccaacagcaggatgccattttgaattcaagcacacacaattcaaactggaaatctggcagtgtggctgtgcaggcatgccagagattagagtccctgctttggagccagaattgtgaaaactgcctcagcagtaggtgttataattgtactctaccccgtcgcaggcctggggtgggaggaaagctgctacagctgcaatatctcctggacaacaagacttggcaggcagaggcagcttggtgacctggaaccagtctgcatgtgtcattgctgggtgctccagcctgctaccctgacactgtggtgcagcagggccctctctgctccactctcaggcagaaatccagacattcaagccaccccacccttcgtagacacagatcatagcactggaccctctttgctccatgcccaggcagatctccaggcaactgacgcacccactcccacggactagcaacctgagccctattccacgtggtgcagcaagatgcacaggcagatctccaggcattaaatgcacttgcttgcccagattggcagcctgagccaccccactcttcctttgcagagatccaggttcagaggggtcctctatgcttcatgctcagggagatctccaggcattcagagcagctgcttggctactccagcagcctgagtcacctcacccctctgtgcaaagatcttggtgcaagggggaacctctctgctccatggccaggcagatttccaggcattcagactactcagtcacctggaacagcaccctctgcaccattcctatgtagagatcctggtacagggggccctctctgtttcacacccaagcctatctccagggattcaaaataactgcttgcctggttcagtaccctgaggtgtcccaccattccggtgcagaaatcctggtgtaggagaccctctccatttcacagccagtagatctccaggaatctggaaaacccatttttcctggattaggagtttaggccatccccattcccatgcagagaacttggggctgaggtttcccatcactattttttgtgcccttctccagagcatagaagggagctcagaccaccatgcactacacacatcagcttattgcctgaggcaacagagaacttctcccactaaacaagggtcaagtatatacccagccacattggccaaagcccactcttactcataactgccatccaatggcttgtaggttgaactgcacagcccaatataaaacctgctgacggaagtgtataaagctacagaagcaaagccaaaaggccctacccagcattctctatagccacaccccctatgaagacagggaaagagaaagaagacaaaaaaataataataacattacagagaaagaaaaaaatcttaaaagcatgaaaattattacaaaagttacaagtgtcagcatctccaaagaaggaaccaccacaaaacttcagacaccatgaaaaatctgagtgtggtgacaccatcaaaggatcacactggctctccaaccatggtccataaccaaaatggaaactcagaagaattgacaaataaataattcaaagcatggactgcaaggaagctcaatgatatccaagacaatgttgaaaattaaaagaaacttctaaagcaatccaggagatgaatgggattaaacatcttaaaaagaaatcaatcagagatcctggaattgaaaaactcacttaagaaattacaaaacaagactgaaagttttatcagcagactggacaaaccaaaagaaagaatttcaaagcctgaagaccgatctttcaaatttacctgaacaaaaattttcaaaaacaggttgaaaaatgaaaaaaagtcttcaagaaatataagactatgcaaagcagccaaacctataaattactggcattactgagagagatggataaaaagaaaacaacctggaaaatatatgtgaggaaataattcaagttgctagagatatagacatccaaatacaagaaatctagagaacatcacaagataccatacaaaatgaacatcaccacagcatatagtcaccagactgcccaagatcaatattaaagaaaaaatcttaaaggtagccagagaaaaaggtcagatcacatacaaacagaaccccatcagcctaacagcagacttcttggcagaaaccacacaagccaggagacattgagggcttattttcagtatccttaaaagaaaataaatttagccaagaaatttcatatccacccaaactaagcttaataagcaaaggagaaataaatgtttttcaggcaagcaagcatcaagggaatttgttacctacagaccaaccttacaagagatccttaagggagttctaaacacggaaatgtaagaacaacacttactaccacaaaaatacatgtacgtagcttgcaaaccttataaaacaaccacacaaaagaaattacaaagcaaccagctaacaacttcatgataggatcaaaatctcacatatcaatattaactatgagtgtaaatggtctaaatgcccccactcaaaagacacagaatggcatattggataaaaaaaacaaaactcatccatctactgtctttaagagacctatttcagctgggcgcagtggctcacgcctgtaatcccagcactttgggaggccgaggcaggaggatcacgaggtcaggagatcgagaccatcctggctaacacagtgaaaccccgtctttactaaaaacacacaaaaaaaaattagccaaccatggtggcgggcgcctgtattcccagctactcaggaggctaaggcaggagaatggcatgaacctgggaggcagagcttgcagtgagcagagatcgcgccactgcactccagcctgaatgacagagcaagactccgtatcaaaaaaaaaaaaaaaaaagagagacctatttcacatataacaccactcataggctcatagtacagggttggggaaagatctaccacacagagagaacagagaaaaagagcaggtgtcactattcttatatcagataaaacaaacgataaactatcaagagttaaaaaggacaaaaaatggcattgcataatgaaaaatagttcaattcaacaagaaaacttaattaccttaaatatatatgcacccaatagtagagcaatcagatatataaaacaacgactacgagacgtaggaacagacttagacagtcacacaatattagtggtggatttcaacaccccactgacaggcattagacatgccatggaggcagaaaactaacaaataaattctggacataaattcaacacttgactaattggacctaatagacatctatgggatactccacccatcagccacaggatacacattcttctcatctgcacacaaaacatactccaagatcaaccacatgcttcgccataaagaaagtctcaataaattcaaaaaattgaaatcatgccaaccatattctcagaccacagtgaaataaaaatagaaatcaataccaagatgatctctcaaaaccatacaattacatggaagttgaacaacttgctcctgaatgacttttgggtaaacaatgaaatgaaggcagaaatttaaaaattttttgaaataaatgaaaacaaagccacaacataaccaaaactctaggatacagccaaagcagtgttaagacgaaactttaggccaggcacagtggctcatgcctgtaatcccaacactttaggaggtcaaggtgggcagatcacttgagagcaggagttctggaccagcctggccaacatggtgaaaccctgtcttttccaaaaatacaaaaaaaaaaaatagctaggcatgatggtgggcacctgtaatcccagctactcaggaggctgaggcaggagagtcacttgaacctgggaggcagaggttgtagtgagctgagactgagccactgcactccagcctgggtgacagagcaggactgtctcaaaaaaaaaggaaattttatagcacatagcactaatggcctaagtcaaaaagctagaaagatctaaaattaacaatctaacatcacacctagaggaactagaaaaacacaaactattaaccccaaagctaccagaagaaaataaaaaataacaaaaatcagagcagaactaaacaaaactgagaccaaaaaaaatccatacaaagaaccagcaaaacgaaaagctggttatttgaatggataaagaagactgatagaccactagctagattaaaaaaaaaaaatccacatacaagcacaatcagaaatgacaaagttgatgatacaaccaatctcatagaaatacaaaagatcctcagagacaattatgaacacctctatgcacacaaactagaaaatctataggaaatggataaattcatagaaacacaaaatcaggaagaaattaaaaccctgaacagaccaggattgagctccgaaactgtatacctgcttaaatttggcagtgaatttttctggtccaggaattttttttttttttttggttacctactaaccaaaaaaatcctagatgaggtaaattcactgccaaattctagcagatatacaaagaagaggtggtagcaatcctactaaaaatattcaaaaaacttgagtacaaggaactccaccctaacttattttacaaagccggcatcaccctgataccaaaacccagcagagacacaacgaaaaagaaaactacaggccaatatccctgatgaacacagctgcaaaagtccccaacaaaatactagcaaaccaaatccagcaacacatcaaaaagttaattcacgatgatcaagtaggcttcatttctggaatgcgaggttggttcaacatacacaaatcaataaatatgattcaatacaaacagaattaaaaacaaaaccatacatttatcccaatagatgtggaaaaaactttcaataaaatccagcatctcttcatcataaaaatcctcaagaaaccaggcatagaaggaacatacatcaaaataatgagagccatctagggtaaacccacagctaacatcatattaaacagacaaaaacaggaagcattcctttgagaactggagcaagaaaagggtgcctactcttaccactcttattcaacatagcactggaagtccttgccagagcaatcaggcaagaaaagggaacaaaaggcatccaaataggacaaaaaaaattcaaactctctctcttcatgacaatataattctacaactagaaaaccctaaagactcctccaaaaggctcctgtgactgattaaatgacttcagtacagtttcgggatataaaattgatgtataaaaatcagtagcatttccaaacaacaaccttcaagttcatatccaaatcaagaaagcaattccttttacaatatccatgctcaaggattggaagaatcaatattattttaatggccatactgcccaaagcaatccacagattccatactattcctacaaaactacgaatgtgatttttcacagaactagaaaaaaactatactaaaatacatacggaaccaaaacaagagcccaaataggcaaagcaatcctaaacaaaaagaacaaagctggagtcatcacaatacccaacttcaaactatactataaggctacagtgaccaaaacagcatggtactggtataaaaacagacacatgtgtcaatggaacaaaatagagaacccagaaacaaagccacctacctacagccctctgatctttgacaaagtagagaaaaataagcaatggggaaaggactccctattcaataaatagtattggaatagctggttagccatatgcagaagaatgaaactggacccttacctttcaccatacaaaacttggccaagtgtggtggttgacacctgtatcccaacactttgggagtctgaggtgggtggatcacgtgagcccaggaatttgagaccagcctaggcaacgtggtgaaactctgtctctacaaaaaacgcaaaaatcatctgggcatggtggcacatgcctgtaatcccagctacctgggaggccaaggtgggaagatcgcttcagatgcagaggcagaggctgtagtgagctgtgatcgtgccactgcactccaacctgggaaacagagcaataccctgtctccaaaaaaaaaaaaaaaaaccttttagctcaagatggattaaaggtttaaatgtaagccatcgaattagaacaatcctagaagaaaaacgagaaaacaccattctggacatcagccttgggaaagaatttatcactaagtcctcaaaagcaattgcaatacaaacaaaaattgacaagtgggacccaattaaactaagcgcttaggtacaaagaaactgtcaagagagtaaacagacaatctacagaatgggaaaatactgacaaactgtgcatttgacaaaggtctaatatccagaatctataaggaacttaaacaattatacaagctaaaaacaatcccattaaaaaatgggaaacgccacaaacagacacttcttaaaagaagacatacaagcaggcaacaaacatatgaaaaaatgcttaattaacatcgctaatcatcagcaaaatgcaaatcaaaataatgagataccatctcagaccagtcagaatagctattactaaaaagtcaaaaaacaactgattctggcaaagctgcagagaaaaggttggtgggaatgtaagttagttcagcctctgtggaaagcagcttggagatttctcaaaaaactttgaactaccattcaactcagcaattttattaccgggtacatatccaaaataaaataaatcattctaccaacaacacatgcactcgtatgtgtattacagcactaatcacaacagcaaagacatgaaatcaacctaggtttctatcaacggtagattggatagagaaaatgtaatacatatacaccaaagaatactacacagccataaaaataaaccaaaatcatgtcctttgcagaaacatggatgcagctggaggtcattatcctaagtgaattaatgcaggaacaaaatgccaaatatcacatcttctcagttataactaggagctaaataatgggcactcatagacataaaaatggcaataatagacaatgaggactacaagaaggagagaaggaagggggaaaaggttgaaaaacttaactattgagtgctatactcagtacttgggtgacaggatcaatcatacctcaaacctcagcatcatacaatatacccatgtaacaaacctgcacatgtaccccctgaatctaagataaaggtgggaattattaacataaatacataataaataaaaataaaaactgtaacacactaagatattttaacgtatcaaaaaactatccttgctatagcttaactcacaaatatctacggttaaaaatcacaatagggctgggcgcggtggctcacacctgtaatcccagcattttgggaggccgaggtgggcggatcacctgaggtcaggagctcgagaccagccagaccaacatggcaaaaccctgtctctattaaaaatacaaaattagttgggtgtggtggcacatgcctgtaatcccagctactctggaggctgaggcaggagaatcgcttcaacccgagaggcagaagttgcagtgagctgagatggagccattgcactccagcctgggcaacaagagcaaaactctgtctcaaaaaaaaaaaaatcacaataattttttcaaaagataaactctagacattgtctatgtactttcaaataatgttttattaggattaataacacaagaagatcaaaagaacctgaaattattctatgaacctaatagttatcctacaaaaaatttttaaattttgaacacttctaaccaaagcagaatcaaactagtttatctgctaaacatcagcagtaaattttgtaaaagttaaatgggcctattttgctttttgaccatagttttgttcttatttaatgcacaaaaaaatactttacacattaaagggaggaaaaatcctgtagtgcttcaatgaaatttatatatttatctaatcataaaacaataaataaatgtttattctctatttggaaataaagaaaagtgtaagggagataacaaaaataacccatgaagaacaatattcaaatctggaaatattttcatgcaatctatttgactatgcttacatgtttaaagaaatagatatggatatttttgaattgaaatatactatggtatgtacagtatattttcaatgcagaaaatataattcaggcaagagaaacgcccaaaaagataatctgaatagtaacatgatttcaatctgctcacagatattaaaaatatgataacagatcattaactagactcaaatattaaaaatttataacaatttaagcagggcatatgatgagactgacactgagtcagaaaacacagtcacttctaaggaaggataagtcttccaagctgttgacctaagttcaatatcagagctaatgtttaaatgatttcatggtagagaaaaatttatattaaataactgaatgtgaaaatttctgtcatttgatgaaaattaaattgtcattccaatttggaaatgttactgatgactatgacacagtttggcatgcctatattatctgtcaccaataaagaccatcccccctccaattttctccacttgagactgtgcttacacccccatttaactttcagttaatatgaaaccttttcttaattcacctctgtttttttcatggtggccttcaaaaattatggttctaggccgggagtggtggctcacgcatgtaatcccagcactttgggaggccaagatgggcagatcacttgaggtcaggagatcaagaccagcctgggcaacatggtgaaacgtgtctctactaaaaatacaaaaattagccaggcatgggggtgggcgcctgtaataccagctactcaggaggctgaggcaggacaatcacttgaacctgggaggtggaggttgaagtgagccgagattgcaccactgcactccagcctgggcgacagagtgagacgctgtctcaaaaaacaaaaaaattatgttactgtatactaagtaccaaggtaatcataaacaggtactgaaattatgtatcaatgtctagtttgaattttctgtctctccccgaccttccaccatctctctttttaaatcatcgaaaacaaaaatccataatttaaaaaatgtaaatactgaatttttggacccaaagaatactttcaaagaactccaattagattgaagggaactatccatcattcaaaaatcattttaaactacataactaatataaacatttaataaatatttctacccagtttaagtaactgaactgaatttaaatgggactaaatcttcacatttctatatactagtccaaattagaaattttttatttcttcacagtaataaataaaagactgagaaagtagcaaaaattaaaacatactataaaagcaaaatagggggaataatgatgctaacatggaagtcagcattttccctccatgaaaaaagacaggaataaaaccgaaaaaaattttcactgaaaaatatttattgttgagaaattgctagaaattcaggtaagaatatcaggagtcagtggccttattaatgagactactcctgtcattaccaccccagtttagttggtaagaactgtagttttaccatttgggggctggcagtaaaaagtagcactgttgctttcaaacagggcaaacctattcagggtaagaaatgaaaactgcagttctccagctaaaagtggcagacttggttacgaatcaatgggagaaaccagcagctttgctagatcagagatacaggcacaattcagggggaacagcagaccagttagatatttactagggagatattaaaagagaaccatagaaagattgagataagtactccacacagacatagctgattgagaaagtacctatatccaggagacacctgggtcactaactgaaaaagggaaggcaagagagactagataagtagccacaactttgaatgcaatccctaaaaatatacagatcaacacagtgggcctaagggctgaaggaattttatcagaacctgtagctaaatcattgactgaactctaagatatatagaaacatggaaaaccctaagagtgctatggaaagaaaaagggaaaaagtaaaaatactgggcagagaaaagtcagagctgtagaccgtggagaaaacacaatctgcaaactaaatgaggcaaattatttaaaaccaaacaaaaaccaacaaccatagaaaaacaaaaaaagtctagagttgcccagttttcaacaaaaattactatatatgcaaaaaaacaaaaaagagtataacccataatcagtaaaagagcaataatcaaaaataacttgtaaggtccaaatgttagattcagcaaatatttttaaggacttgtaataaattatattcaataaatgaaaaaatagtatgttcaaataattgaatgaaacagattaacaatgagttctcaaaaaagtataaaaagaccaaatggaaattctagagataaaaaagtaccatttaaaaatcaaggaattcactataggcattcaacaggagactcagatggcaaataaagaatctgtgaattcaaagataaatcaatataaattatatagtctaaaaaacagagaaaaaaatgggaacacaaattattcaacctttagacactgtaggacaatacagtgttccaacatagatgtaacaagagttccaaaaaaaaaaaaaaaaggcacagaaaagaaacatctgaagaaatagggataaaatcttccaaaatttaatgacgaaacatttacttacagattcaaactcaataaaccaccgaagtgaaagtaacaaagtgagtcaccactaggccgggcacagtggctcatgcctgtaatcccagcacttaggctgagatgggcgggtaatttgaggccaggcattcgagaccagcctgacccacacagtgaaaccccatctctactaaaaatacaaaaattagctgagcacagtggtacatgcctgtagtcccagctacttgggaggctgaggcacgagaatcacctgaacccaggagacagaggttgtagtgagccaagaccatgccactgtactccatcctgggtgacagagggagactctgtctcaaaaaaaaaagtgaatcacaactaaacaaaccacagtcaaattgctgaaatccaaagacaatgaaaaaaaccttaaaagcatcaagagaaaaatgactgatgacatacagagcaacaacaatgcaattcattgctgtcatctcatcagaaacaatggagtccacaggtcagggagatgacagtcaagtgctaacagaaagaaaactgcaatttaagttcttatatccaggataagtatcctctaaaaatggaagcaaataaaagtattctgagatgaacaaagactgagaaaattcattgctagcaaatatgccttgtaagaaataataaagcccaccaagatgaaagaatatactgtaaaaccactaataaaagataacctttaagaagaaaactaaaatcaacaggggaattttgatccaaccaaatggagtcagcccaataaagcctctctgtcccaaatattaataaaattataggggaaaaaaacacaaaaatcaacttcccaagtactctgaagactaaacaaaagcaggtgcattgtgtaggggagttaaaacttggagaattactcatatggatagaagaatcatttttttcctttctctcttctgaatctgcccctgtttcagggctggatgtcagaagctcgggtggcaaaattctaagaaaaactatgcttccagttagagaaatctagaaattaggtcctagataggagaagtgtggggaagaatcctaaatagcagagagtaagagaaaagggttctctaaatctgtgtaaaaacctgtgataaccccaaactcacccaagagacgcatgggtgtgggacaaacccaaatcagaatagacacctttctaaatttaattaccatccaattctcagcctaattcctgaatgaagcatatgtatgtgaggaaaatacaaggcaaactagtctgtctccctggatcgaaggggaaaaaccaaagaatgaaagaaaacccaaagtagggtaagagaggtttgaaaaatgaagggacactggaaacatcatgcacagagaagaggtggaacttgcagccccacccttaccaggttgtctatttgctaaacaacaacaacaaaacatgtgttagaggattataacagggcccagagttatgctctaatgcatccaggacccacaatattcaagacacattagaagattacgcaacatacaaagagccaagaaaatgtgactgtttctcataggaaaacacaaacaacagatgtcaatgagatgagcaaaatgttggacttatcacacaaagactttaaaggagatactataattatgctttagaaaataaaggttaacaaagtctaaatgaattgaaaaagttctccaaaaagaaataataaatgtttgaggtgatggagatgctaactaccctgatttgaatattatatgttatatgcatgtattaatatatcacaatattgcatataatatgtacaattattgtcaatttaaaatattaaagaaaatagagttctcatccaaaaatgaaagcataaaagtgaaccatattgaaattttagacttgaaatgcatactatctgaaacaaaatatgcaagagatgggttcaatatcaaaatgtaaaacacaaagaaaaagtccataaatttgaagatcaagtttattatacatatcaagtttctatgcacaaactacaatctgaaaaaaaacaagactgaaacaaactaaacaaatgcttaaggagttgcctgactctatcagaagatctaatacttatttctttggagacccaaagtgaaaggagaaagatataagtgaagcaaaaattgaaaaaataagaaccggccgggagcagtggctcacgggccgggtgtggtggctcacgtctgtaatcccagcactttgggaggccgaggcaggcagatggtcaggagatcgagaccatcctggctaatacggtgaaaccctgtctctactaaaaatacaaaaaaattagtcaggcatgctggcgggcgcctgtagtcacagctactcaggaggctgaggcaggagaatggcatgaacccaggaggcggagcttacagtgagccaagatcgggccactgcactccagtctgggcaacagagcacgactccgtctcaaaaaaaaaaaaaaaaaagaaagaaaaaaaaaagaacctacaacttctcaaatttggtagtaatcacaaagaaaaccataatgaacctatgaaaggaggaagagagagatggatgcagtcaagtgtgcctgtagtcccagctactgaggagactgaggcaagagaactgcttaagcccaggagttcctgggcaacatagtaagaccccaattctaaaaaacaaaaacctaaagaaaatgtcttgaaagcaagtgcagaaatctagaacattatatttaacaaagaaagatttcaataaccacagatttctcattggaaaccatggacaccagccaacagaagaaaaacacaggaaagaaaggaaaggaaaaaggtaaggaaaaaggaaaggaaaaaaatgattacaaacacagaattctacatacaacaaaaatatccttggagagtgaaggtcaaataaatatattttcagaagaaataattaaaaattgtttctgtcaaaactgctcaacaagttctttttcagcagaagttcttctaaaggaagttcttcaagaataaacagcaaaagaaactgtaaatacctggataaaagtagaaacttttttctctcttcaattctttaagctatatataactagtgaaagtaaaactttaagctatatataactagtaaaagtaaaacttattaactgtctggaggcgcttatgtatatacagacataataaggacaattgaggcagttaaagggatctgagcagttccaagggttctatactttatttgaagaggtaaaatattaacactaggtagactgtgaaattacatacactggcatctctagagcaaccaccaaaaaagttacacaaagagataaactccaaactcaaaatataaattttgagaatatttttaaaattcaaataaaaacaacatagaaaaagagaaacaaggaatatattacactgggataaatagaaaacaaataaaatggtagatgaaaataattacaatatcaataattacattaaacataaatggtctaaacatactgtaaaaaacctgactttgtcagactggattaaaataaataaaacctacaactattctgtgtgtattagctaggtttttccagagaaacagaaccaagaggatgtgcagatagagagagagacagagattgatttcaagaagtttattcatgcaattatggaggcttggtatgtctcaactcagaagagtagaccagcaagctgaagatgtaggaaagaactgtattctcagtacaaaggcagtcagccagcctaatttccttcatccctggggcaggtcagactttgttttattaaggccttcaactgattagatgaggtccagacatattacagtggataatctgttttactcaaagtccaccaatttaacctatttatgtctagtgttccattattggaacactaagcttgtgggagttatttatatcctactgctcaaggtcattgccaagatttgattttccacaaaaaaaaaaaaaattgcaacctctggcataaatggcttaaatgttaatctcatcaaaaaaacactttcaggccaggtgcagtggctcctgcctataatcccctcactttaggaggccaaggcgggcagatcatgaggtcaggtgatcgagaccatcctggccaacaaaaattagttgggaaccaggccacacagcaggcggtgagcaccaggccagcaagcattactgcctgagctctgcctcctgtcatatcagctgtggcattagattctcataggagtagaaccctattgtaaactgtgcatacgaggtatctaggttacatgttccctatgagaatcaaatgataaatataatgcacttcaatcatcctgaaaccacccccaaccccagtttgtggaaaaactgtcttccacaaaaccagtccctggtgccaaaaaggctggggacctctgttttagaatttatgggccatatcatctctgttacaactctttgactctgttgttatagcaggaaactaaccataggcaatatttaagagaatgagagtggctgtggttatagcaggaaagtaaccacagacaatatttaaaataatgagaatgacagtgccacaacaaaattttatttataaagacaaatcattatagaagagtcagccaaagaaagcaataaaaataaaatagaaaaaataaaaatgaatatgatcgagagcaataatggaagggcagccataaacgggaagaagaccttatctactactactgtactagaagtaagtaaacaagaacgtgctctaaaatacacctttggggaaaaaagatggaagttgaaataattccctcctaataggtctaatgaagtagatgaggctgtcactgctgacaggaagagttgtaaaaatttagaattgtatctgaaggaacaaagaaatgtttaacaatgatagaagtatagatcatgaatttataataatttcaacatacaacactgcatgacatttccccaccagccaaggtttagcttagagtgtgcctacctagactaatctaggatcagaattctcaaaagcaaatctaacaggacaagggcagacgggagtttttgttagaaaccacttccagcaaatagccaggctaagaaggaagtaaacaatggcagatatagtatgacacactaggattaaaaaaaagcaagatcacaggacagaaggtaactatgaggctgaagagcattggaaagggcgatattagaaaaagaggagatagatggttttgattaaagagtaagattggaatttaaaatttatgatgtgaaaacatgccagtgataaaaaggtctaggtttttaaaacaggaatggataaattacaaagaatggcagtaagggtagcaaagttaaggaattaaaaaattacaaaatgtgaatgttaagatgagttagtcacaaggacaatgaagttattcacatgtagtgaaactgagataagactgtgaaccaaaaattcacacactaagactaaaagtataaagtatagactttccttgcccagactttcaatagaataattcttcttactagtttttaaatgtctatgatactatcttgcaattatttttttttttaaaagtggtaaaatcctatacagtaaatcacaaaatacactaaagcacatccacacaaatacaggttatatccacagaaaataaggttataaaattagatactctggcaccaaaaagaaaaaaatctgccaagcctttacataaacccttaaatcttttttctgaaattcagttattagataggaaatgtgtacaaagaaacaaacaagtatttataagcctcgtttgttttgtgttaatatggctatcatacgacctatccattacattcctaagtatggtatatactcaagataaatgaaaacatatgtccatacaaatacttgtacatgaatgttcatagcaagcttgttcaaagtaataattattagacagtggtgagggaaaataaagagtactttgtttgacagcaaaactataaataaataacaaactgtaaatttacctcttacaatgcttaactttatgtgtcaactgggctaggccatggtatcaagatagttggtcaaatatttttctagatgtttctttgaaggtattttttggatgagattaacatttaaataagcagattttttgtatgtggaccttatccagctgaaagcctaacagaaaaaagcctaactgccttggagaaagagaaaattcactcagcagactgcctttggacttgaactgcaacatcaacccttccctgggtctccagtcagcctgcctatcctatggattttggatttgccagcttccacaattgtgtaaaacagttgcttaaaataaatctctctcgtgagtgtgtgcatggacacccacgcacacactattggttctgtttccctggagaactctgaaaataaaccccttaagtataatgaataaagacactttttatcttatagagaatgaacattaaaaaataccaaataaagaatctgttatagaagatcaatgtgtgtttgagcctaggagttcaagaccagcctaggcaacatggtgagactttgtctctacaaaaaacttttaaaataagctgggcatggtggcacacgcctgtagtcccagctactcaggagactgaggaaggaggatcccttgagcccaggaggtcaaggctgcagtgacccgtgatcataccactgcactccagtctgggtgacagagtgagaactgtctcaaaaacaaacaaaaatccctgtgtgaatttattataactagataattaaattagtttctgtagctgatgattaagcaaaactagttgctaaacttttcttgcccactttctcattaaacaaaagattttaaacttccttatacgtaaaatagaggtattctgtttttgttgttgatgactgtaatggaccaaatgtttgcatacacccaaaattcttatgttgaagccctatcattagtatttggagagggagcctctaaggaagtaattaaggttaaatgcggtcctaagagtgggtccctaatccaataggagtaacgtcattgtaagaagagacacgagagagctcactcatgctctctttctctctctgctacatgacaacacagcaaggaagaggatgtaggcaacccaagaggagagtcttcaccaaacaccaacccgactggcatcttgatcttagacttcccacctccagaactgtgagaaaccaatttttgttgtgtaagccatccaatctacggtatttgattatggcagcctaagcacacaaatacaatgttgagtcagaagtgggaggtggaggaagtgacattttaaaggaaggatagagagcttgtcttggatttcaattgaacactatttaatactatctaggacctaaagataattctgctaaagaagtcaacaatacagtagctctataatagcactcaccatacaaaatattggaatcatttatctgtcttcacaaatcaaatagtaacaaatagtaacacagcctctataattaaagattcattgaaaaaaaatgcatgattataaatgggtcttaaatcttaactcatttcatgctataaactcatttcatatgtaagtttaaataatccttttcatatttaagaagctttcaaatatttccaaactaatcccttatatgaaatagattaaaaactcttaccgtaacccattcctttggtcaaaagcaggaatcatagagttagggtgttctgacattaatgcaacaagcagctgtaggacatccattagattgtcatcctataatcattttagaaattttttttaaaaaatgaggaaaaaacaacttagttgaataatgaatacttctgaaatagaaatttcaacattagaaatataagtagacatatgtgtgatatatacttatttttaacaaattatgttctttaaatgtaaacattcacctctgtaactccaaatatacataaaatagcaaaccaatttctttttttgtgcgggggggcagagtctcgctctctcactcaggctggagcacagtggtgtgatctcagctcactgcaacctctgcctcccaggttgaagcaattcttgtgcatagcctccctagtagctgggactacaggagtgcaccaccacatctggctaatttttgtatttttggtagagacaaggtttcaccatgttggccaggctggtctcgaactcttggccttaagtgatctgcctacctcagcctcccaaagtgctgggattacaagttgagccaccgcacctgacctcaaaacaatttctttgtttttttgttttttgttttttgttttttgagacagagtcttgctgtgtcgcccaggctggagttcagtggcacaatctcggctcactgcaagctctgcatcccgggttcatgccattctcctgcctcagcttcccaagtagctgggactacaggtggccaccaccacgcccggctaattttttgtatttttattagagacggggtttcaccatattagccaggatggtctcgatctcctgacctcgtgatccacccgccttggccttccaaagtgctgggattacaggcgtgagtgagccaccgcgcccggcctcgaaacaatttcttcatcaaagaaataaaataccttttatgttatattgaatcaagattttgtaaaacataacctttagaaacagtatatccaacatgacttttttttaaggaaggcttatatatcaagaaattgtggggaagggttattctctattacagaaaaatatattagagcttctaaaatgctactaaatgttgcaaatctggtggtagtggtagggctaagatattatgtatcatttcttaaacttatctgatctggaatgttttattcactgtgcctctccagaaactagttctaaaagaacactttgtgggaaatgataaccggatcattttcatatacggtattatctattgtccctataaagataaagataaccaataaatgtttactcggtcaacataccactaatatgtggtagtatttgataacatttacagaataccagcacaagaaacgagttctagacccccaaaaaaacttcatgaaaatccttcactacctttgttgcatataccaatatgtatgcatatcattagagccaacttggacaatactgacccaaaaaggaaaaggcaaacagctaacagagtttagttaacttggttgccctgactctagttttccttcactgctttggaatttttgctgtggaagctacttgtataccgaattttcattaagttaaacagatgatctggagctaggacactgaatcattgaaagtgttatttagaggacctgaaactttcctaacaataaggaatcactgtgacttccagtttatctcatataaagtactttattcagtcccttagggttaataaaaacaaaatcacatatatagatcactatgaaattcacctgaaaacttcaaatattatatttggtcagaaaaatctaaaaattaatagaattgcctattcaagaggaaaaaatatcataatcattaatgattttaagtcaaatattactcaatcacaaaatttaagccattcttttatacctgaattaacaaagagatccaatcattatccctcatttaaaaattaaagaaggcactactccattctaaaatatatttattaattcacaaggtattaattataatataggagtataaattatcatttaaaatgctgtgatgtattatattccatcaattcctaagttttactaattataggtaaaaatctaactaaaaatagatgatttagttagattgcaactgacatatattgcattttcctggtgctaaaaaataaaaacagatatttcaacctatttaattttctttttatttttttttaattacacttcaagttttagggtacatgtgcacaatgtgcaggtttgttacatatgtatacatgtgccatgttggtgtgctgcacccattaactcgtcatttaacattaggtatatctccaaatgctatccctccccgctacccccaccccacaacaggccccggtgtgtgatgttccccttcctgtgtccatgtgttctcattgttcaattcccacctatgagtgagaacatgtggtgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcactgttggacatttgggttggttccaagtgtttgctattgtgaatagtgccgcaataaacatacgtgtgcatgtgtctttatggtagcatgatttataatcctttgggtatatacccagtaatgggatggctgggtcaaatggtatttctagttctagatccctgaggaatcgccacaccgacttccacaatggttgaactactttacagtcccaccaacagtgtaaaagtgttcctatttctccacatcctctccagcacctatttaattttcaacctccttttcaaacacataattttaaataccattataaatgagctgtttaatatctgaacatgtaaagtcagtaggaagattgtgttatgaatttttaaaacctaatcatttttagtcattttcgtaatctattttttcatttgttacactggtttctggaaatacactgaaagtatgctttggtatactttattattaattcaatgaaatctaatgttagtactttttaaagcctttcatgatgattctcaagattcatcttgtggtaataaaggatatttaaataaagattgctagggcttagttcctaagtagacacatttactccccattacagttacataattactgaagatttctttaaatttttacttttaaaaaagtctaatgtagcttcaaaaattaaaatttcaaaatataaaattcatatattacctcatgcatagtcagtaggtaattaagaatggcctgtaattcatcttcctttactccagaatccttcaaaaacataatacaggtatcttacgtttacatgtaaaaaaatgtttaaagagaaattatacacatagatttgtcaagttggtcagctactataaatataaaaatataatgtaatagacaatctaaatttaaaacaaaaatttggggaagcactaaagacatcagtactccagaacatgtagaggtcaattaacatcagcttcctgttttcaacaccttatataatatgacagcctacttactaaagctacagaatcctgaagtcagcaaaaataataagtaatgataacttaaaaagtaatatccacacctactactcctctaaatacagaagacatcttttcgactgaaattaaatgtggagaatacaatgaacagtttctgaaattatcaagttaaaatgtcaagtacctaaaaattaaatagtaatctcactcgggaaaagaaaaacacactgcacttctaaatatgagctcgttatgaaaattttcaacctactctatcagtatattaatcactaaaaaagctgcaatctaaaaaaaaaaaaacaccacaagaagaaaagaaattggaaaacaaaaaacagtatgcatcaggaacgagcaacaaaacaaagacaattcaaaggacactttttttaatacatggaaataaggtatctgaatctgaaaggtatactaaaagttaggttcacttgccataatcttatgtgacaactaataaagcattataaaatcatataggaaaatactgaaaaaatattggtaacaattacatttatatattgctatcttataaaaccaaaatgccttttttagaatattaaattttactttacctgtaatagaatgaaaagggacaaaatgtgaccacttctaaaggctcatacacctacctggtacatttatacagaaatactatttctcaaaatctgaatgtcagttacaaggagcctgctaaaaatgaaacctccttcaggagtttagtgccaaatactaacagaaacatagtaaatatttgctgaatgagtgaacacacttgagctactatacaaatttatataacataaaatacaactaccaatccctaattctgcaataatttacatccatataggctccaaaaaagaaccaaaacaaacatggaaatatctttcaaagtattttccaatgtgtaaccacagtaaccaagcaaagaataaaaaaaccaagattgtatttcatgtgaaattataaccttcaatacacggtatgctatggaataagcaacgtgaactcaccttcatcactaattgcttaatgaacatcaacaagaatgctcgtagagaaagcatttctttttgattaggtcgcggtccatcttttaaaaaaatatacacatacacatttagtatttaaaggacctcaaagctgtcaaagtataaaattctcattcccaacagcttttccatgtgtttgtaagaaatataaaggtaggtctcctacagaatgaccttttatgcctctagaaagacaagtgtttaatcttacatgcactgtatacacaatatttcaaacatacaaacaggttatgttgaaactactatgaagaagtttgtactttgaataggtcaaagaatgtccaaaacataaaaatgaggtaacaaataaaatttgtattcaataataatatacgtattttaagactctgagagtattagtaaggtaacagaagtttacaaagaaaaaaacaaaggaaaatctaaactttcaacattattattatatgtgaattcagtatgacaaaatttttctactgttatcattatataagctaatacagaaatctcaaaaagaatgcctcactacacgatatcattcatgaagaagggaaatattatgttaactgcctctgacatctccttctctgcttagaaaagtccttggtcacacatggctcacattaaatcaattttcatgtctcaaacatataattcccaagtagaaagcttttgaaaccaaacactcattgttctaagatcctaagttagggacctgttttctcatatattttataatttttccaccactaatcactatttatagatagttcttagaccaccaaagcataggaccaccatgactttgaacagatcaatgaaaataggaagaaaattgtttaaaatttgttccatgtgattcctagacaaaaaaaaataataagactagagttagaagaggatcacaaaatttgtccagctctctcatttgaagaatgagactttcccaaggtcactaatcagttataaaaggcaggcgagaatacaaaactagcacctaggacagtacatgatacacctacagcaccatgaaatagtcatgagaaaattctgacccggttctggatctgccacaaccttgccagcttaaaaagttcatagcttgctaaattataggtaccagattctctgaggctaaaccaagcttattttgaaagtgatataaaaagtagtatgcaaattgaaaatctttgtaaatcactaaacaaccaaagcctcttactgcaatcagaatgtatgttattgactccccagcatctatttcttaatttcaagcaacagctcttaatttttaccaagtgactgaagtcatcttcactttcagacaatgtctttcaacttaggggatgcctccatttctaagcaatcagggcaactacaaccacaaaaatgggcacatgatacaatcaaagccaatgagcaacagagagactaaaagagactttcactggaaatacattatataggcagatgctcttacactgaatttaagttgttacggatgtgaaaggggaccggctgcttgctactacaaaggaagcgaatatgtgaaaacagccaacacagaagaattggcaagtgcagtgagacaaattcagtcctatggtcatactcagaatacctttatcaagttgtatctggaactgccagtttatatgagctgattacctccctttttgatgtaagccagttccaaggagactgttatagttacaaccaaaagagccactatatgtcaaaagttttattttgaccccttatatgaactgctagacatgatgaatgaatattaccctttcagcaagttagtcctcattatgtaagaaaataattgctaacattttgtaatttcattatctctttaagagaagcagataactcctacttctgcaagaaaccaccatattcccaaaacaccattttcaaggaatctcattgtgacaatccatctcagcatcaattactaaaaactaattaagaatttcttggcattttcagtgtcttacaacaaccatcctagtcatattagctccccaaacaactcacaccagcacaagtagtattcttccacacaagtagcaagttattaaactctagaaaccacaatttaggacaaactattaacattatcaatgagattaaaataaaattttgccataatggaatatagaaaaactgcccaaatatatgatagtactggttaaaacaaaaagaaaaattaaatcctgatttgcatttgtgtaaagtaatatacagacagaaattatatacctaatccttttggggtgataccacttcgatcctgaggattcactgcccagtagtagtacttcagcgtgtgcatgatgagaagcactgttccaactctccgaatggtgttatatatgttgactgtaccaatgaattccgtggacagataagtatagagcatcagttgaacctacagaataaaaatgaagaacttagagaaccccaccagcattttatctgtttccagtaacacttccaggctgttttattttcaccacgcttcttccaaaaagtaagatgctgagcctgataataatatccatattagacaacacatactcactgacacacaagcacatgcacacacactccttataaaaccaaaccaggtaatttcttcttttatagcagcattatcaaatatggaaactttttgctgcattattccatgaaaataactttgtgattcctatttagcaatcagcaattattcctaagcatgtgtaacttctttataatagacttattacttatgctatctatgcatagttgtttgaaaaagctagaatttctttcaaatacaacatttgcagaaaatcaggagctaaaatgactcaaaagaaaaagtactagtaactcaaaaggaaaaaataaatagaacaaaaccaaaagaaagaaaaccacagaaaaagatatagagtttaccttgaagaatattagaaaaacagaattctattacagtagctcattacaagaaacattccaatctagcattttaatcataacattataatctctcaacatgtatatcatgtcccccaattaggaaaggattctactaatctcattgaaagtaaatagtctaaaaaaatacataagaagttatatatgtttatattaacttcgaaatatctcctcttcatatgtaagagaaagaaataatacaagtgctaccccaccactgcacatttcatcttaacaaaaaattggcccaccccagtgattcacgcctgtaatttcagcatgttaggaggctgaggcgggcagatcacttgaggtcaggagtttaaaaccagcctggccaacatcgtgaaacttcgtctctaccaaaaaatacaaaaattagccgggcgtgatggtacacacctgtagtcccaggtactcaggagactgaggcaagagaatcgcttgaacccaggaggtagagagtgcagtaagccgagagagcaccactgcactccagcctgggcaacagagaccctgcctcaaaaaaaacaaattttttttcagtgaaattatgggtctgaaactcatcaactataatccattacttaaagcagcaaaaataacgactgcttttgctctactctcatgttgaaatcaattcattttattgctagagggtatattttataagctgaacaactgtaagtataggatatatattcttcccttgaccatagaccaaactactgatcatttataactgaacctttatgttaccttcctggacaatgagggcattttccttttcaaacctgcaaggtacctcagtgtcacctagggatttctttagagagcaaaaagtaggtacctatcttccaggtgccctgcaaataaacaatcaaggctaaatgaattagagtgtcagtgaataaatctaacatgctaaaaagtggcaggttctgaaccacttaaaagcagggcttggaagatcattataattcacaaaaccatatatgtatctatacacatacaatacattgtgatctactgacctgccgcaaaatgttattttgatgtagctactgctgttcaaattgataggcccaatccacttgtcattgagacaatacgacatgcctcaaattcttaaccatgttatttcagtctcttagcaaatatttacatctaactatatgcataacactgtatcatggaaatacagtggcacatatgctgtccctaagtagctgaaatacagttgaaaagattaaaaaaacacttatatttaagcaaaacaaatcaaagacaataaatatgcctaccaaaacatgaaaaaagtcatgaagcaatatgtaattgagtgacatagagctatgaaatattattaattcagaggacagataaattattataggataaactgaaatagtaaagaaaagcttcactaataaagtaggcattaagataggctttgaagatgagtagtagaatagacagacagaatacaagaggaaatttcaagctagaaaaatgatggttgaaataaaggtttccctagagttagaacaacagttctcaatcttgactgcacattaaaataactgaaaaacttttctttttttttaatactgatgcctgagtcccatcccagtgaggcaggagaatagggtctggaggcagcgaacctaaggacttcctagaactaaatcaaatggaaatgctacagctatgacaggaaatatcctctccatttacatagggcatacaccgagtaaatgactttgtaactttactgtatcctcttcatttacatagggcatacaccaagcaaccaatggaaacctctaaaggttatttaaaccccagaaaattctgtaacagggctcttgagcccctacgctcaggcctgctcccacagtgtggagtgtactttcattttcaataaacttctgcttttgttccttcattcttcccttgctttgtgcattttgtccaatcctttgttcaagacaccaagaacctggacactctccacggataacaccagattgatgaaatcagaatctgcagtggaagtggtgggattctatttttgcttgtttttaaaaacctaccccaactgattctatcagcagtcaagactgagaaccaccactgtagggaaaccttttggtacctccctatccactgaggatatttccatttttaagctagaaaatctagaaataagaattgacatgaaatccttagataaaggactaactacttcgttctgagaacaatgggaaaccattaaaactgctggggctaagaaattataagagtcatatgttaggaaaatattggcgttgggcatggtagctcaagactgtaatcccaacactttctggggctgagagaggaggattgcttgaggccggaagttcgagaccagcctaaacaacaaagcaagaccctagtctctacaaaaaaatttaaagagttagctgggaatggtggcgcacacctgcagtatcagctactcaggaggctgaggcaggaggactgattgagcccaggagtttaaggtcgcactgagccatggccatgaaaagaacatgttggaattctggcagaatagttataagttagacaaagaaatggaaaactggagaaagtcagtctattgagaatgatactgtggtaaaagaaaaatgaacagaggctgggcctgatggctcacacctgtgatcccagcactcttggggggctgaggcaggtagatcacttgagcccaggagttcgagaccagcctgggcaacatggcaaaacatcatctctacaaaaaaatacaaaaattagctgtgtgtggtggtacacagctacagtcccaactactcaggaggctgagatgggaggatcacctgagctggggaggcagaagttacagtgagctgagatcccaccttagtgacacagtgagaccctgcgtcaaaaaaataagtaaacagaatttagtagcaacgtatagagatgaatgaaagacctcaagattactcatatgctaattatgaataaaccttccctcattcactcattatgtactccaatagccacacaaattgtgtgttaacatctgtctttcccactaaatctaaattctatgagggcaagtatcaagtctatcttgttcatcaccatatccacagtgcccaccataaagtagtcactcaacaaatatttgttgagtaaatgaaggaccatggtagacaagaaaattcatctctcctgctaggtcattaaaaagatgttctctgaacagatctaagataaatggaaattataaatcgctggtagctcccttttccaaaagcaaagcttttcacatccacacatccagaccttcaacttttaaccagaggtggattgaccacgaagctgataaagcttcaactttatgaccactgatctataaatgtttcttccaagaccctaaacctaattttgtatgcattatattgtattcttcttcttaaaaaatttcccacatgataaacatttgaccttcaagtcaaacaaaatttggatctgcccttttttatgactgtctttacaataaaataaaagcagataaaaccccttgtggatacataaagcagatggctaaaacaggagaaaatgctaatattatcaactcaactgcaaattctaaaaaggaaattgagaaaagttattaaaaagtagaagataagaaatagagtataataatactaggaaactaagaaaatcataagatgaattttttttaattcccctccaactaagtatctaataagaggctttctgaccacatcaaaagagacacaaagccttacaaatatgctgattagtaagacaaaaaagtatctagtaaaagattttaaaagtaacttgaaacaatcctcaaaaagaagtaagactgagggtcatggaagaaaatgaggtcaaatttgacctggagataaaaagctacaacctccaactgcctgtttcgattatttccaaatggcaatcagagtcagcagctgtttttctctttaacatttgaaaagaccagctgaaaataaaatattaagactctagaaaagcaaaaaagtctgcagacttttttctgacaactagaataagtaggtgctattccaacttaaacaatgataaacactgcaagtgggccaaaaggcagaaggggagagaggaaaactgggcttgaaataacacgacttctaacaaaaattgtagataagacggatacaattatgcaatttaataaaatgatctgtttcaagttatgcttaatactgccactactgaatttttaggacaatgtattacaacactaggatttattaaagattttgttcatataccttaccacaaattcatttacattcacatagaactaattggtttgttgttacaaaactgaaaaaaaaaatttgtacaaatgttttcataatttgaattaacgtgaaattaaaatgattacgagactagtatatcatgccttcaaagaaaaagtgacatttcagtggtacctataagaatgaaactcagtagttcatcatgttggaaggcaaaagtgtgaagtaaaaaagagagagagcaggagcagggtgagttcttaagaaataaaaaaaaaagaaaaaatatatatggatatttacaatggaacaaagctacagttactaggaaacattaataattacattaaaactgtctaactttgatttatatttagtaaatgaagtctctcccaaataaaactttatttcatttaatttcagaaaacaaagactatacctgtatcttttaaaataatgatattgtttacaaagaatatattctttgtatgtatgtatatattatttgtatatattcatacacacacacacacaatttgcaatttttcctgaagagtaaaaaaggatgcttagtcaaaaaaagcaatccactgaagtcttgcataatagtacataaaaaaaagaaaatcctcttaattatcactctcctcacgcacaaaaacagcaaagatagtaaaacaatatcaatatatagatatatattaccttggctggggtatgaatccatatggcaggattaagaagaacgtgatcacacaattgcttgagcaggggcatcccattctgcagattactcagatattttgaaaatgcaaggcaaagttcaagtactgctctgctaacatgagatttggaagactgcaaaaaaagtagttcaaatgttaccacaaattcaagtcaaagtaagtgaattacaggctgtccctaccaggaaaaaaactggcccacaaattatgctcaaagttaaagatgccatgaagctcactatcacatttgtttgatagaggaatggaggcaaggtaaaacaacaaaatgttattttagtttaggtaattttctgtaaccaaggagacattcttgcagacagaattccttagccacttagagaacaaatgtatggcctgtaaattaagaatcaaaaacataaaatatttcatactttaccttttcaaggctatatcctattaccaagaagcccttacaggcaagcatctgttcctgcatagcaattgagttcttcaacaattccatgataaaggccagcaaggttgaactagaattttttaaaaaggcgatgattaaaaaaacatattctattttttttaaattaggttagatagatgtaacccttccattcaccttaataaaaagttctccatttcaaagaaattgaagctccactaaaactgcttccaacattacatcagaactagatttttaatgtaggattaggagttactcagatatttatttcatatactttatctcaaacacattgataggtgaattacttagaaacaatgacaaatgttcatgatatagagaaaaatgagcaacttccaaaaacaaccaataacaaatacttattaaaaatacactaaggccttaaagaacagatataacttagataagcaagtatattcaactttgaagcgttaggggccaaaaggtgagaaaagacagtggagcaaacagagtaaggtgtaaatcctcaaaatgtgttagggctccagacttgcatagtctgaatggagcagagggcacatgaagagaaagatgagacagttaacttggaggcaaacttgagctccttgaacactaatttaagaagtttgttcattatcccaacaacaaaattgtaattctccagtcagtctcgaacacttttaaaactgaataggggctacagccatgctctactacctacaatttttaaagatccccggaaaggaaaggaaaaagatcagttgttactgccttctcagagagaagtcccacaaaacaaaaaaaaagagagagagagagaaagcatgaccagcagccaatctcctcctccacatcagtgctttcactgccagcaatttcaatacggggggaggggggagggagagggagaggggagggagggaagagagaagggggggagaggggagggagggaggagagaagtgggggagagggggaagggagggagggggcagagaggggaggaaggggaagggggagggaaggaagggagggagggaggaaaactgtaagtaaaccctgttagaacacagcacaaaacaattccataaagtattaatatgtcagggtaatttaattttatattttttaaaatataagttgacaaatactagatttgataactttttatttttaaaaaaattgttgcctgaaaataatgaggacaattaccattattatacacactggtggcagacatcaagttatgtataaaagcaaaaatcaaagggagaatttcaaaatgagagaatgtaaaagtatttaaatttctcaagtaacaaatgaaacaataatttcaatacaaatgaaacaataatttcactatacattgtttcactagaatatatagccatgagaaattgagactcctttcctacattttatgacttaccctataacttatatccctttcttttttagactcaggactacaacacaagagacaaaaatgtgctaaatgtacaatctaatttttttcaaaaagactaattcacttcgataacactattaaaattttgacttccaattacataaatgcaatcagtaataaataattaaaatatgaaaagttaagttccataataaatcattaccaaataattttaaatatttcagaaattaaaaatttcttattgcattctgagtaatgggtagtaaaaaaaatttttaatttagacaaaaaaatgtatttatttttgagtaacccattattgccatttataatgttattctaaaaccaatttattgtgtttcttacagcttccatatttcctactgataaacaagaacttaagttaatactgacataattaatatggacttgtaatacagtttatagttcacaagtttaaattattttgacacaacaaaacctgaaaggcaaaatattgtatagctcaacagtgatgaaattaaccctcacagccaattaaagaaacaaataaaggcactcaccatatagtcaaatcaatctcatcagacaaatattgcctgtaatccaactgtgcaaaaagtggaaatagtacttgtactcctccaattgaatgcattgcactttggatggaatgtgttaaaactgcctttacatccttgtaagatcaaaaacacagtaaagagttcaatgattttttttccaaaacaattaaaaataaggcacaacaataaatgcagaaacactataaacgtgacattccatgtgtttaacagaagctaccaaatacatctcaataacacatcaaaaattaccattataaatgttcttaaaagatcacagttagtacctggagcatgagtgcatgtggtgaatgaacaaaaattgaagggttgtccttaggagatgattcaagacaaagctgggcatctgtagcccgtggattgtacgtgaatgcaatggcactagagagtttcccatcgtacaataaaagtttgtgatgctcagcaaggaaaaggtcgctttctgctttgaatttaaatgtaccctaagaattaattaaaaacagttaaatagtatgccacaaagagaatctaagtacaaatcaacacaggtgtaaaactttaaggagacagaccattgataatcttttaacagtattatataagaggacccctcgtttacttctaaaattggctgaatttaaagatataatggaaatcaagtcaacttgacattaaaaccttaccttaaaaatgtagaagtgaccaatagatcatattttatcttttttcgtatattctttttttaaaattgtgatcaaaagcatataatatacaacttaccatcttaagtatttttaagtgtataattgagaaacattaactgtattcatattgttcaacagcaaatctctagaacttttatatcttgcaaaactgaaactctgtagccatttaacaactccccatttcctgctccccaccagcccgactatcacaattctactttctgtttctatgagttggactcttagatacctcgtataagtggaatcatacagtatttgtctttttgtgacccaagcatttcatttagcacaatgtcttcacagttcctccatgttttagctgatgacaggatttccttgttttttaaggttgaatatggtcccgtgtgtttatgtgtgttgtctgtcacattttctttatccattcatctgctactggacatgtgggttacttctatctctgggttatcgagaatattactatgaacatggatgggcaaatatctccttgtgaccctattttttgtgtgcaaatacgtctctgtgatcctcttttcaattattttgtatatatcccataagtgagattactggatcacatggaagttctatttttaattttttgaggaacctcatattgttgtccatagcagctgcaccatttttcattcccctcaacagtgcacaaaggtaccaatttctccacattctcaccaacacttgttattttgttttcttttttaagtagtcatcctaaatgatgaggcaatagctcgctgtagtttaaattagcatttttctaatgtctagtgatattgagcatcttttcatatgttcattggctatttttatatcttctttaaagaaatgtctactcaactcttttatgcatttttaattgttttgttattgttgttgttgttgagttacaggattcatatattctggatattaactccttatcagatatatgattgctaaatattttctctcactctgtaggttacctttccactctgctggatatttcctctgatgcgcagaactttataactttgacaacatcttatttgtctgttttggctttggttgcctgtactttcggtatcacagtcaagaaatcactgccaaattcaatgtcgtaaagcttttcccttgtgtattcttttaggagttttatagttttacatcttacttttaggtctttaatccattttcagctcatttttatatacaatgtacaatatgaattaagtataaaacttttctttcttatttttcgcatctggatatccagttttcccaacatcatgtgttgaacacattgtcctttccccagtatgtggccttgcctcacttgtcaaagatcatttgaccgtatatgcaaaagtttatttccggacactctattgtgttcccttggcctatgtgtctaagcaagtctaacgttgttttcattatgtatcatagccttgtaataaattttgaaaccctgaagtgtaaagcctgcaactttgttcccctttttaaatactgttttggcttctgagaatcccttgagattccacattaattttagaattgtgcttctatttatgcaaaaaatgccattgggattttgataagaactgtactgaatctgtagattgctttaggtagtatggatttttagcatattaaatcttccaagggatgtctttacatttgtttcggtctcttaaattttgtcagcaacattttgtacttttcaatgtacaactcttttgcctccttggtggagtcagggtacagctcttttgccaccttggttgagtttatttctaagtattttatccttgttgatgctattgtaaaagaaattgtttgcgtaattttcaaactgttcattactacttcattattactaatagaaacacaattgatttgtgtgtattgattttgtgccttggaactctgcagaattcatttactagtcctaacagttttcagtgaaatctttaaggatttttagatataaggtcatgccatacgccaacagatgattttacctcttcccttccaatttagatgccttttctttttcttgccaaattgctctaactggatttccaaatactatgttgaatagaaatggaaagaataagcatccttgctttgttcctgattttagaggaaaaactgtcagtttttcactgttcagtattgtgtcagtcatgggcttttcatatacaatattttattatgttgaggtagtttccttctattcatagattgttgagtgttttaggttttttttaaatcaagaaagagtgttgaattttgtcaaatccttttctgtatcagttgatatatgatcatatggattttgtaattcactgttagtgtggtacattgcattgactgatttccatgttgaaccatctttgcattccagaaataaatcgtaatttgacattgtgtataattcttttaatgtgctgttaaattcaatttcttagtattttattgaagatttttccatcaatattcatcagggatattagtctatagttttctttcttgtactatcttgatctggctttggtatcagggtaacactggcctcataaaatcagtttgaaaatgttccctactcttaaaatttttgtaaatttgaggagaattggcattaattcttctttagatgactgagagcattctccagtgaagccatctagtccctggctttctttgttgaaaagttttttattattgattcaatctccttactagctataggtcttttcggattttttaaatttatttttgattcagtctcagtaggatgtatatttctagaaaattgtccatttcttctaaattatccgatttgttggcatatacttttcatagcattctcttataattctttctatttctgtggcaagttataatgcctcctccttaatttctgattttacttatttatgtgctcttcttttttccttagcctatgtaagaatttgtcaattttgctgatgtttaattaaaaaaaaaactgttagtttcactgatttttttctcactgcttttctattttctattccaggggtccctaaccaggtatatgacctgttaggaacaacagcaagaagtgagcggtgggcaagcaagcaaagcttcatctgtatttacagccactccctaccactcacattactgcctgagctccacctcctgtcagatcagatttttatagaagggtgaaccctattgtgaactgcacatgcaagggatctagattgtgtgctccttatgagaatataatacctgataatctgtcactgtctcccatcacccccggatggaaccgtctagttgcagaaaacaagctctgctttgtttcccactgattctacattatggtgagtcgtataattatttcattatatattacaatgtaataataacagaaataaagtgcacaataaatgtaatgcacttgaatcatcccgaaaccatccctgctgcgcccccaccacccgtggtccatggaaaaactgtcttccatgaaactggtccctgggaccaaaaaggttggggactgctgctctatttcatttatttctgctcggatttttatcatttccttctatctgctaacgttaactttatttgttgttctttttccagttccatgttgtataaattaggttgctgatctgagatctttcttttggtgataatgatcagtcattatcaccataatcttctctcttagactgaggtcactgaatctcgtaagttttggtaggttgtgcttacattttgatttctctcaagatattttctaattttccttgtgatttatctttgacccaaaggctgttttaagtgtgttgtttaatttctacattaaacattttctacattaaaaacttggtggactttccagtttttctttggcaactggtttctagtttcattttattgtggtcaaaaaagatacttggtataatttcaatcttaactttgttgacacttgttttgtggcataacacatgtctatcctggagaatgttctgtgtgtgcttaagaaaaatgcaggtcaggtgcagtggctcacgcctgtaatcccagcactttgggaagccgaggcgggcggatcacctgaggtcaggagtttgagaccagcctgaccaaaatggcaaaaccccatctctattaaaattacaaaattagctgggtgcagtgccacatgcctgtaatcccaggtacttgggaggctgaggcaggagaattgcttgaacccaggaggtggaggttgcaatgagccaagatcatgccattgcactccagcctgggcaacaagagcaaaactccacctcaaaaaaaagaagaagaagaagaacaatgcacattctactgttgtttcatcgagtgttatgtatactactgctaaatacattgggctgcattgctgttcaagtcttctgtttacttattgatcttctgtctggttgttctattcattattgaaagctgaatactgaagtgtcctactataatggtgttgctatctacttcttttaattctatcaaagtttgcttcatatatttgagagctctgatgttaagtacatatatttgttctatctttctggtgaactgaccctatcatcataaaatgtccttctttgtctcttttgacagtttttgacttaaagtctattttgtctaatttaagtaagctactcctactcttctctggttaccatttgcacacatctctttatttgtgggtacattttaggtgtatatatttatggggcccataaaatgttttaatacagtcatgcaacgtgaaataagcacatcatggagaacagatatccatcccttcaagcatttaccaatttagttgaaaaccatccaattacactatttcaaaatgtacagttattattgactatagtcaccctgctgtggtatcaaatagtaggtctcatttttcttttttttttttgtatccattaaccaaactctccatgtataacccaccttcaaatcaagctgaactaacattggttaagcacaaaacagtaagcaaactaccttgtatcccaggcccaactgataaatagcaaatatctgagctgcatttagagcttcactgaaaaggtaaactgcagtcatctgaccacagaatactctattagcatctgctgtttctgatgagcccaggaaacatttgtcaaaggtctgtaaaagaaaaaaaaaaaggaattaggaaaaaacaaaaaaaaactccagaaataataaaaacctatattatcataaatgttttgtccattctaaactgtatctaaatagactaacataatttataccataaaaccattagaaagaatgttgaaaaatgtgtatgtaatgacattaggggatatagaaaagtttgaaacacatgtgttctcaagccaaacaacctagatcaaatccctgcatcctatgccactgagtatggcaagttacttaacctctttgtacttcacctatctgtaaaatgaagattataataatgcttatcttgcaaggttgctggagctttttgaaaataaagctatttattacaatgcctggaatacaaaaagcactcagtaaaagttaatgtaagaaaaaacaggttacaaaacaatacttacatatgagcccttttttgtactaaaaaagagctaacattgagcactcattctgtataaggcgcgctgctaatagatttatggatattatctcatttaatcagatgacaactttctgaggtatgaatattttatgtccattttcaggaggaaaaatgctaaggcctaatagattaggtaaggtcatgcagtcaataaatgacagagctgagattcaaacctaagtctgtctgattcaagaccctgatctcttgaggttagcattacaaaatatgtatatatgtgtagcaaaggatatgaaaagaggagttaatggtgtgtgggtagtgtactttatgttcattttcctggtatttttcaagtttttataaaaagaacataattacaggaaaaacattttaaatttcattctaacctatagatttatttttgaaacctgtaaacgttaacaacatactagttaactatagcagttagaattatatgcaagatttataagcatgcatcatttaactcattcagaaaaatgatcagaaccctatagtggagctcttgttcattttgataaatgaaccaatgacccactccccagatatagccactgttagctataaatccttatttctacctatatggaatgattttataacaaggactaatatttcagtgacatattaagttctattaacatgctagccaaattatgtttataaaaatctaccattgtaatactttgaattttatattcaagttgtaaaactttttcttgtttaaaaagctcatgcttttaaaatcacttttttcattgcaacattttgaaactacttacatcgctagtgttgacaaaccatgttatctctccataggaagccagctcaccattcacataacatcgaagttcactattcttccatcggttatagatgtgtactatggtaaccatataccactgcagaagcaaaaaacagttaaaaatacaaagataacaattatcccaataacgcaaccatactgatgagtaaaagttaaatgataagttgtaattcaacctaaaaataaaacaagactacctttgttaaattcaatatttactttctggaacaatatctattcatgggcctttcaactgataagaacttaatcactagatcatttttccagctttttattatggaaattttcaaacataccccaaaaatctgaaaatcaagtacaaacaccccctttttccaccaactagattccataattgtcaattttttgccatatttgcttaatctatctgactacctatctacttatacattttgttgatgaaccatttattaacctctaaattttaaggtacaaaagcaaacacatattaaatttgcaatactaaaataaatgccgtagatatttcctacttgtatctcccttaatctccataaataactaaatttgcaatctttttcatatccaaatcagagaggtcaattattcagtgatttacgcttcatctttttaaacagtaaaaacgaagttgtgctttagcatgttattatatgaataacattaaaacaaagcattttgatgactagcatagcttgttaacataactatgactcaagaagatcatgtaccttttgtggcttgaaatcaaatttcacacagtgttgaaagccttttccttttgactttattgatgttacaatcaaacagcctccaacaaaatgagcagaatagccaagacctttgctggttctgaaactataaagaatagttttcattttacctctaaatattcttctcagtttcaaagtaaggttttaacactaatcagttacagaaatacataccaatacaaatatggtttatccttatctacattgatgttatttacaggatccattctaagccatgtatgaaatgtaaaaccattctggtatggccatttggctataggaggtaatgcaatagcctaaaggaaagaaactttgagttattaactcacgtgaaaacctgtcttattaaaatcatgaaaataagactttgcaatgctacatatatttgtactacatcacattactttatgtcacaattaaaatatctgaggccgggcgcggtggctcacgcctgtaatcccagcactttgggaggccgaggcaggtgcatcacaaggtcaggagattgagaccatcctggctaacacggtgaaaccccgtctctactaaaaatacaaaaaattagccgggtacggtggtgggtgcctgtagtcccagctactcgggaggctgagacaggagaacggcgtgaacccaggaggcagagtttgcagtgagccgagaccacaccactgcactacagcctgggcgaaagagcaagactccatctcaaaaaaaaaaatatatatatatctgaaagaagactctttatctggaagaagactctttatcaggaagaagacttttagtaactttttaattttccctaatacatagtaatgttaattaaatgaaaaaaaaattcagtgtaacctggacacatgaatcttgtattcttcatttcttaaaatgaacgtatccacagagattctaattaaaagagataggaagtgataacaaattggaaatttgatgaaattttaaggtattagaatagagaaagatggacaggaatggaaagagagaagagaaaaactgggtatatgctgcttttataaaactacaaatataaaactgaagaggattagttcataatatttttaaattatattcagaagtcaatatacaaatggctttaccgcttggtttagatttttatttaaaagatcatactacataataaaaggatcttgtatagccaaaacaatcttttaaaaagaacaggccagatacggtggctcacacctgtaatcccagcactttgggaggccaaggcaggcagatcatctgcggtcaggagttcgagaccagcctggccaacatggtgaaaccctgcctctactaaaaaaatacaaaaattagccatgcgtggtggtgggtgcctgtaatcccagctactcaggagggtgaggcaggagaattgcttgaacccaggaggcagaggttgcagtgagccgagatcatgccattgcactccagccagggtgacaagaacaaaaatctgtctcaaaaaaaaaaatgaagaagaacaaagttagaagactcatactaccatttcaaaacctaccattaatataaagcaacagtgatgaagactgtggtattagcataaggccctggtgtcctttggttaggcaaatccttcttattatgtcaccaaaaggacaagtgacaaaagaaaaaaatatatacattggactttattaaaattaaaacctgtgctttaaggaacaccatcaaaaaagtgaaaagacaagccacaagaatggaagtaaacatctgcaaactgaatacctgataaaggacttgtaaccaaaatatataaagtactcttataactcaataataaaaggacaagtaaaattttaaaatgggcaaaagatctaaatatacatatctccaaagaagatatacaaatagccaataaaaatataaaaagatgctcaatatcattagtcataaaggaaatgcaaatcaaaactacaatgagatatcacttcataccaactaggatagctactaatacaatcacaaagacagatactggccgggcacggtggctcacgcctataatcccagcactttgggaggctgaggcaggtggatcacttcaggtcaggagttgaagaccagcctggccaacatggtgaaaccctgtctctactaaaaaatacaaaagttagctgggcatggtggtacacatctgtaatcccagctactcaggaagctgagacacaagaatcgcttgaaccgggaggcagaggttgcagggagccaagatcacaccactgcattccagcctgggtgacagagcaagacttcatctcaaaaacaaacaaacaaaaatagacattaaccatcttagcaaggatgtagagaaatttgacccttatacattgctgtgggatcgtaaaatgttacagctactttggaaaacagtctggaagttcatcaaaatgttaaacaaagaccatatgacctaatctagagattgggacaaattaaaacatatgtccacacataaaattgtacactaatgtccataacagcattattcatactagcccaagaagtgaaaatcccaaatattcactagttgacaaatgattaaataaagtatggtatatccatacaatataataccagccataaaaaggaatgaagtactgatacatgctgtaccatggatggaccttgaaaacattatgataagtgaaaaaagccagtcacaaaagaccagatgttgtatgattccactaatatgaatggtccagaatagggctggggaatatggggagtggctgctaatcagtatggggtttcttttgggtgtgatgagaatgtcccaaaattgactgtggtgatggttgacaactctgtgaacacatttacctactatactatatactttaaatgagttaattgtgtggtatgtggattatatctcaataaagctgttttgtaaaaaattcaaactgcacaagtgtctgttttattgtaacttacatatgcatttatgtatacatattatacatatattcttttatatgtattagataagacataaaacatgaaagacatcatagagccaaacttcagtaataacactattgagacttcaagagtgaacgttgcattaaacgttgcattaatgcaaaaatgaacgttgcattaagaaaaaaggaaaagaataattacaactcacagactgacaaaaaaaaattttaggagaaaaacatatattcagtgcgtacacatgttctctctcaccaaaaacgatagcaaagatgtaaaagctttgcaaaaatactttattcatgactactttaaattcccagtaaaagctatgtttaaggaaaggaagtcactaaacatatttaaaacatctattctcttcaagtttcaaaagctgttcagctcacctgccctactttcaagataaatgcatgcactgcaatctcagaactgtaaataataaaattataacatgaggcatgaaaaaggttaatctcataagaacactttttttaatgttagaggcaatgataggctatgataagaaagtaaaattattctgaaaagctacaaatctaaaatcgactgtaaggaaaaactgtaaaggaaaaaattgggcaataaaacttttcaaagaaagttgtatattgtgtatataacatttaaatatcacaaatgtcatattaaaacatattcttatctttctgcagatactgccaggctacacagggcctaatataagattttatgagaactaacataaaaaaaagaatgaaagataagctcaggaaaagaatagactgaaatatcttttttaaaagtttgtcttgggccgggcgtggtgactcatgcctgtaatcccagcacttcgggaggctgaggtgggtggatcacctgaggtcaggaattcgagacaagcctggccaacatggcaaaaccccgtctctactaaaaatacaaaaattagtcaggcgtggtcgtgggcacttgtaatcgcagctactcaggaggctgaggcagaagaatcgcttgaaaccaggaggcagaggttgcagtgagccgagatcgcaccactgcactccagcctgggcaacaagagcaaaactccatctcaaaataaaaaaaaagtttgttttgcttgtaacagactgaccaatgtaataatgaggagattttagaaacttccataaataacatatatacattatagaatgtgcttctataacattacgaaacattacagatatcactattatacataattgtcttatgtataaactgattaacggcttacaggaacactgagaccaacataatttggaaactcacaagtcaaggaaaacttgcgtagtaagtttcagagcctctatttcttcactatcattctatacacaaggtacaaaaaaaaagacaggtagagtaatgaaaggcaagagaaagatgttcacaaagatagacatgaaggtgttacacacaaatagctacttaagacaacatggctatgtttaaaagaatgaggttcttattccattgctgacccaagctgtgactgggcattttctcaactaatttaagcctctatttcttcacctctaaagcaattacaaaaaagtaacatgcacgactatcataaggattaaagtatgttgagcagaagtttctacctagcacagaacctgtcaggggtgttcacagggctgtactttcagggagcaaaggaaagaagaactgggagtgatttcctcattaatatttacttactgcagcactctttcctggaaagttaaaaaaggcatcaggaccatacttctgaggcatatgctttaacacagacagcaacttcccagcatgtggaggctatgaagataattaacaattcattaaccacattatttaccataagataaaaaaaacacatctttaatatagtcttgctgtaatatatacaggaataatgctataaggttaaaagcatagaaaataatttctaagttattttcaaatatcttaaagaaataatgtactctacaccagtttttgtaatgctgtagggcctattaggtattcaataaatatgagccagtatcattagacacctgaaactcttctccaagctgcagcaaaaatgatcttttttttttcttttttgagatggagtctcactctgccacccaggctggagtccatgtgcagtggcgccatctcggctcaccataaactctgcctcccagattcaagtgattcaccagctgagtagctgggattacaggtgtgtgccaccacacccagctaatttttttttctttcgagatggagtctcgctctgtcactcaggctagagtgcaatggcatgatctcggctcaccgcaacctccgcctcccaggttcaagcgattctcctgcctcaccctcccaagtagctgggattacaggtgcacgccaccacacccggctaacttttgtacttttagtagagacggggtttctccatgttggtcaggctggtctcgaaccaacctcaggtgatccacctgcctgggcctcccaaagtggtgggattacaggcgtaagccactgtgcccggcctatattttttgtatttttagtagagacagggtttcaccacgttggccagactggtctcaaactcctgacttcaagtgatccacctgcctcagcctcacaaagtgctgggattacaggcatgagccaccacacctggccaaaaacgatcttttaaaaatataaactacatcaatcccccacccacccttctttaaaattaaaaatacttaataatttaacaaatacttaaataatgcttactatattccactgttaaaggtacttcaaaaagatacttgcacatgcatgtttatagcagcacaattcacaattgcaaaatcatggaacctacccaaatgcccatcaatcaacgagtggataaagaaactgtggtatatatatatatatatatatatgatggaatactactcagccattaaaagaaataaattatcagcatttgcagtgacctggataagactggaaactattattctaagtgaagtaactcaggaatggaaaaccaaacagtgtatgttctcactgatatgtgggagctaagctatgaggacacaaaggaaaaagaaagatacaatggactttggggacttggggtaagagtgggaggcgggtgagagataaaagtctacaaatatggtgtggtgtatactgctcaggtgacgggtgcaccaaaatctcacaaatcaccactaaagaacttactcatgtaaccaaatactacctgtaccccaataacttatggaaaaataaaattaaaaaataaaaataaacatttcaaaaaatggtacttcaaaaacactaaaatattttaacctcataaccaccctatgggatggtattattatgattatccgcagtttacagaagaagaatctgaggcaggggaacatttccaaagtcacatgggtaataactgtcaaggtcaggatgagaactcaatcttgactccagagtccatgcttttaaacaactatacagatgctcctcaacttacgatagggttacatcctgataaacccacagtaagttgaaaagaatgtaaatcgaaagtatgtttttgatccaaaatattgtcaacttaagatgggtttagccggaggtagccccatcctaagtgaaggagtatactgaatgcatatcactttcacaccatcgtaaagtcaaaaaaaaaaaaaaacaactatactttcaccattaaaatagggaccaaaacctttaacatggactataagatactttatctacttctttagcctcattttgcttcttactctccccttctccctgcactccatccttttttcagtcttcttcccacaacagggcctcagcaaaagctattccttatgcttaaaatgttctcaaaaggacccctgtactcccctcttatccaagtcaatcttacccagcctttagagctcatcttaacagtcacttcctcagggtagccttccttgaaactgagagtggattaaacttccctatcatatttcattctacaatatacctttaccgcatagcatataaatatatgtatacgcatagcatatacatataaaagctgcaacgctgagtttatttgattaatgtttccttggtccacaagtctctaatacatgaaacaaccaacaataaaaatgaaaaatctcatttgcagttacaaggaaaaacaaaagataatcagacatactatctcattttaatcagtttataaccaaataagaaaagtgtggggcattcctccttgttaaaaatgtaaaagttcaaaacagggtcaaactacaaatgaaatcattggtttgccttcatcttatttttatagatgatataaattataattactacctgtgtaaaagagtttggcaacctttcacctaaatattaagtggaagcttcattcttaagtgaacaagaaattttcaattaaccatactgctcaattgtaaaagcataataacaagtaactacaatcacagtgattttttaaaataaattccaaagtaaaataaagtaaccaaaaataactctgcagttaaaaataaaaatacagtattatagcatgtccatctagaaacatcattcctccaaatttcctttcctataaatcagtcaacaaaagaatacattaagataagcactttacttgacagacattgctgggggagtgtatactgtactggtaaagcctttcagaaaaaaatttagtagaccaggcacagtggttcacatctgtaatctcaacactttaggaggccaaggtggagggatcgcttgagcctaggggtttgagaccagcctgggcaacatggagaaactccatctctagaaaacaatacaaaaattagccaagaatggtggcaagtgcctgtggtcccagctgcttggaaagctgaggtgggaggattgcttgacccaggaggcagaggttgcaggcagccgagatagcaccactgtactccaacctgggtaacagagcaagactctgtctgaaaaagaaaaagaaagaggaaaagaaaaagatgtagtagtcatatttcaagagtccgtaaagacgttcatgtccaccaatgcaatatttccacatgtaaaaatctatgctaaagtaatcaccacaagggcagacagagatttagatatagggattttttcactgcactgctataacagcaaacgatagaaataatatgcctaatattaaataactaaataaacgtaatgagtatctgagcaaggccttgctctcattttataaatagttcattattttttccctttatcatctaaaactattctcattctcctccccctccccataggcaactatattaacatgtttaatcttttttatgtagattattccttcaaaaataatgtttggggctgagtgtggtggctcatgcctgtaatcctagcactctgggaggactgcttgagctcaggagtttgacaccagcttggacaacatggcaaaacccagcctctaaaagaaatgcaaaaattagcctggcatggtggcacatgtccgtggtcccagctacttgggaggctgaggtggatctcttgataccaggaagctgagaatgcagtgagccatgatcacaccattgcactccagcctggatgagagtgagaccctgtctttaaaaaaaaaaaaaagaaaagaaaaaaaggtttttatgtgcttacacttatcattgctttctttcctatatattttacatctattcctattactccatgtactgattctgttatagaacaatctaccttctatacattttaccaatccactctcttaatgatgaacatccatgttaacattcactgccatcaaaaataatgcttcagtgaacatcctcatgtattttatggatctatgtgagaatttcttggaatacgcactcagaagtgaattattaaatcactggatacaggtaaaattaacatgactaagtagcactagactcctcttgaggttggctccactggtgttcattctaatgaaaagcgcaccaagtataaaataaccctatatcccaaactatacttgccattttccaactttaaaattcttgagaaactacagatggaaggtgacaatatcaatactgttttaatgtgaatgtctctaattattaatgattttgtgttcatttggttgtggggtttctacctctgtaaataaatattagttcatattatttgctattttcttacctataattttctatgcttatgaatataataaaaatacattacatattcagaataaataatgtgaatataaataaaaaccaaaatcaaatatatactttctcttctggacacgacatattaataggacctggacttaccaacctaccataaacaactagaaaagtgggcaaaatgtatcaaacaaaaacagttttcagtatgcaggaagaggtagctcaagactgtgttccctgagaaaacaaaatgacttaaacctggagtcaatttccatatcattgcacagggaaaccaaacagaacccgaaagtctcagtgagttggaaagaaagtggagtccacagaagatagaagtttcagagaagaatactagggaggaaagaactgaacagacaagaagctccagaaatctgcattgactctttgacttaataccagactgatcatgcttatgataaaactcaacatggtggggctaagatagtaagagctttaagttaaagaattcccaaaactaatacagagctaggaattgttgagaccctactagacacttcggagagaccacagtcttgctacctcctgtcctatgtctgagacttgagagttattcaatagagaccctctaagagacacgcctgaatagtaaaactaaactagccgtagcgtaacagccactctaaaccttactggaaaaaaaacttttaaactagttttgaaggataaagttgatccacaaataacttatctgcctacaaaaccagtctaacaatcttaaaaggaatatgacaaaatccaacactcagcaacataaaatttgctatgtctgatatattgtctaaattcagtagccataagcagcagaaaaatgtgacctacataaaggagcaaaatcaatgagtaaaaaactgacctagaaaatgacattctagaatgaaaaaccaagagcattaaagcaactattcatatgctaaatattgtcaaggatttaaaggaattaaatgagggaaaaaatggaaaatatttaaaagaaccaaatagaatttacagaaagagaccaggcatggtggcttatgcctgtaatcccagcactttgggaggccaagacgggtggatcacaaggtcaggagttcgagaccatcctgaccaacactgtgaaaccctgtctctactaaaaatagaaaagttagccaggcgtggtggtgtgcgcctgtaatcccagcaactcaggaggctgaggtaggagaattgcttgaacccaggaggtggaggttgcagtgagcagagatcgcaccactggacgttagcctggcgacagagcaagactccgtctcaaaagaaagaaaaaaaaaaaaaaggccaggcgcggtggctcacacctgtaatctcagcactctgggaggccaaggcgggcagatcacaaggttaggagatcgagaccatcctggctaacatggcaaaaccccgtctctactaaaaatacaaaaattagccgcacttggtggcatacgcctgtagtcccagctacttgggaggctgaggcaggaggatggcatgaacccgggaggcagagcttgcagtgagccgagatcatggcactgcactccaggctgggcaacagagcgagactctgccttaaaaaaaaaaaaaaaaaaatttacagaaagaaaaatatactatctgaaatttcagtggatggaattaacacactgctgaagaaaagatcagttaacttgagactacagcaataaaaactatctaaaataaagcacaaaaagattaaaaaaagagttaacagatcccagtaacctgtgagaaaatatcaagaggtctaatatatctgtaattggagtcccagaaaagacaggaagcggggacaagaagacagtatttgaagaaacaatgactaaaatgtttccaaattttgtgacaattatcttatacccccacagaagcaaaaactctaagaagataaacacaaggtaagctagaaccagaaatataatcaaattcaatgaaaattagtaaaaaaaactaaaattagacagtaaactggagtttgagagaaatatgctaaagaatctaaattttaacataatgaaaaagagtaattgtagggcacagttttagatacatttaatgaaagctagattaaggatcagctggctgagctgttgctgtgggcaatgatctctaaagggcactaaaataagattggaaatgcaacaaaaatggagaaaatatttactactcctcttcaatgggacagataactatatggtggaagaaacagtttgataaggcacctggggttcaaaataagttcacccccatcactacccattgcaaatgactcctaagttgcatctcaagagggtagatccaattaactgcagaggttttgttcacggagtgagttactcaagtttaagccactcagataaaactagatcaaaaagaagaaaaggtaggtactactacctaatacttttctttctctacatttatctttttttctaataaatattgaatgtacatttaaagaacaacattttgaagaagaattaaattaccagtttgcctgaaacaccattatcttagtgcatactcttagtgtccaagtatggcacgagtagccacagggatctcaatgctattttaattaatctattcaatttgacaattatcccatgtataataatatcagttactttacaagctacgaatgtgtttgggaggagcatactttaaaataccaaagagtacttaagtttttttacccatcgtcctttatctccttgaagtttactgaagaaaagctttagctcgcgaactgtcaaattatagctagccagcactcccaacatgtcaaccaaaagatctggaaacaaaagaaaacgataaaataactcagctagttatatttctcgaatatttaaaataaactgtgcttatttaagggcttggacactaaagttctaggtgcatgctacatgctcaaatatttcttaaatattgctaaatggaataagaaaaatatgtatttgaaaatcaaactttatttctttgcatatattgtactatagaaaaaatcatacctgctatcatattgtcaactttttcaattttcccaagcactttttcaacaaggcctacttcagtgcagacttgaagattccgtatgcttttcttcagaatggctgtaaacatgctccagacttctgcttggcacgtaatgtcacatttttccagtaggtccaccatgcagttaatactctcaccttcttggataatgaaattcatttccagatcaaactgtcctcctaccaacttacaaggaaaaaaaaaaaacacattaaaagcattagtatcctcaatatcactatagcatgttcctaaacattagattaacaataactactcacattcttcctccacatcaaaaggttcattaaaaaacatgcagctcaaaaaactgaagtttctgaagtaatctccaaatttagacagcaaagtaagagaatataaaaattaaaatatttttcaacaaaaacaaatataggatgtcttaggtaaattgctatctactaacctgttaccaataaagatctaaatcaactctacaattgcttctcatccagtctttcatttatgaagtatcaaatctgtgaactacactgaataatctaaaggtcctttgttacccaaacaacttatgagctcacggtaaaactgaaaagctgaaaaaggctcagagtggtcacacattggagtttatattagtcaaatttttggtttattaagcctattcattttacctctcctctgtagataatcagtataacttacatataattagtcacatatccaaagtcagtaaccaagaaaatgtatttcactgatattactatcagaacgctatagctatacaggccttgtcatctcacccagagcctccccatacagagggaaggttcgtaaattttaaataaatcgtaattgtgtaaaggaattaaaatacttttagaattacctttgtagagctatctcatttaactagattttttaaataaatttttttaaatttaaatttttttaatttaaaaatacatatatttaaggtatacaataatgctatcaactagattttttaaagatctctgtcagaaatagctacacacatgattcacctacgcttctttctgaatacttcttgatttttcattatgcatttccaaactgcatacccaaaaggtatgcaataattagaagaaagtgaactttaaaaaacaaatccggcagggcgtggtggctcatgcctgtaatcccagcactttgggagaccgaggcaggcggaccacctgaggtcaggagttcaagaccagcctggccaacacggtgaaaccccatctctactaaaaatacaaaaattagctgggcgtggtggcatgcgcctgtaatcccagctactcaggaggttgaggtaggagaatcacttgaacctgagtggcagagattgcagtgagctgagattgtgccactgcactgtagcctgggcaactgagcgagactccgtctcaaaaaaaaaaaacaaaaaaatacaaaaacttagccaggcatggtggcatgtgcctgtagtcccagttacttgggaggctgaggcaggagaatcacttaaacctgggaggcagaggttgcaatgagtcaagatcatgccattgagctccagcctaggcaacagaccaagactccatctcaaaaaaaaataaaaataaaaataaatccaatggctcttataaagaataacagacatgaccaagtggagtttagtccaggaaagcaaggaaggttcaaaactaggaaataaattaaaattccattcagcaggatcaacaacatgtatcccaggttctgacaaaaatatacacaggcatgagactgaaaaaaatggaaatgaacaatgtgaggatctgtacctgcatgcagagagacaagaactcctggcaagcacagtgataaagacatttcatctttctcagaaagctctggtagagatctcagcatacaatgctttgtatcatcactaccaagcagtgttaggagatgacagctgggattttgctaaaacagtctctccttgtgatggagtcaattctcctagttacatggccgtagctaaaaagtatacgtgcttggttccctagtcctcctggataaacgctataagctatctattatactatgaaatattccattctacttgaactggttgaattagattatattgtctgtaaatatgttgtttgtaaattttaaaaatacacaattcaaataagaactttaatatagctgttttggttttgtttgtattatttcctaatattgtctgtaactttttattttgaaataatttcgaacattcaaaaaaagtacagaattcctttatactcttcatccagcttccccaatgtatatatattacataatcatagtacagttatttaaaccaggaaattaacatttacaataccattaaccaatctacagatatcactcataaaaagatttaaaaaaaggcatgtatatgaataaggtgcttattattaataatgcttggctgacggtggtggttattgttattataagttttataattttataattacatatctatatttatatattattatatgataaaagtgacatgcaaatagaacaaagatcatttcatcaaaaggttagtggctgggcatggtggttcacacctataatcccaaaactttgggaggctaagacaggaggatcacttgaggcctggagtttgagaccagtctggcaacacagccagactctgtctccatattcaaaaaaaaaaaaaaaaaattacccaggtatggtggtgggtacatgcagccctagtactcaggaggctgaggtgggaagattgcttgagcccaggagttcaagactaaagtgagatcacaccactgcactccagcctgggtgacagtgcaagatcctgtctaaaaaaaaaataagtttagggatagctatattcaaatatctgggggaaaaaaaatcatcaatcaatccctcataccataaaaaaatttccaaatgagtctaagatttaaatgtaaaactgaagtcataaaatgagtctaaaataaaacttataaaagcactaaatgggttaggcgtggtggctcatgcctgtaatcccagcacttctgggagaccaaggcgggagagtcatgtgagtgcaggacttcaaggctacagtgagctatgatcatgccactgagccctagcctgggtgacagagcaggacatgtctctaaaaataaaaattaattaaataaaagcactgaatgaaatgatacaaaaaacattttatcacttcaagtggtaaaagcttttctaactaagagtttttaagatttctggacttcatattgacatatttaactacataataatcagaaactctatatgcaaaaaaaaatcaaaaagtaaattaaacacttagaaaaatcatttgcaacccatatcattacataagcacaaatagcttcctgaaaaaaaatttttaaaagaaaatatatctgcttgtgggaactagggtgttaaaaaaaaaaaaaagaaaatttaggcaaaggcaatgaacaaaaaggtaaataaaagtggcactaaaacatgaaacccaactttgcttacaaaatgaatattaaaaatacactaatataccatttttacatatttgattgacaaattccaaatctctaacaacatataaaaataatacatagtatgtgcaagaacatgaggaaacaggtactgtcatacattactgttgttgaggaaacaggtacaatatgacttattaagagcaatttggggctgggtacgttggcgcacacctgtaatcccgggactttgggaggccgaggcaggtggatcccttgagcgcaggagtttaagatgagccaaggcaacatagcaaaatcccatctctactaaaaatacaaaaattagccaggcgtggtggcagacacctttagccccatctacttgggaggctgagacacaagaatcacttgaacccacgaggcagaggttgcagttagccaagatcgcatcactgcactctagactgggtgacagagtgagaccttgtctcaaaacaaaaaaaagaaaaacaaaaaaatagcaatttggtaatatctatcaaaattttttatttttgaaacagcaatcaaactactagaaatgtatattatagacacatttatgtatctaacataatgatgttagatacaagaacttcattgtattgactctttttaaattacaagataaaggttaatgacagcctggcatgatggatcactcctgtaatcccagcactctgggaggccaaggtgggtggatcacttgaggtcaggagttcaagaccagcctggtcaacatggtgaaaccccgtctctactaaaaatacaaaaattagccaggcatggtgacacgtgcctgtaatcccaactacttgggaggctgaggcacaagaattgcttgatcccaggaagcggaggttgcagtgagtcacctgggcaacagagcaagactctgtctcaaaaaaaaaaaaaaaaagttaatgaagttgtatacaactatacaatgaaatatgatgtacatatagaaaagaatgaggccactccacatgatatgaaaagatctctaagatactgtgagaaaatcaaggtggagaaaagtgtgaacagtaggctacaatttgagtgtaaatcatttacacatagacctatgcatgtgctaaatatgtctaagaatgaactaaatatcgattgtctctggaaaagatctattgcatagaaggcaaaaaaaagattttagtacatacacttttgaacaatttgaattttgtgccatgaacacatattacttatttcaaaaaaaacaatttaaaaagaagcaaatgcagccaggtagggtggcttatgcctgtaatcccagcactttgggaaaccgagagagcagatcagttgcactcagagagttcaagaccagcctggggtcttgaaccaacatggcgagaccccatctctaccaaaaataaaacaaaaaattagctgggtgtggtggcatgtggctgtagtcccagctgcttggaggctgaggtgggagaatggcttgagtccgaaaggcagaggttgcagcagcccaagattgtgccactgcactccagcctgggcgacagggcaagaccctgtctcaaaaaaaaaaaagcaaatgcacaaaacaccactgatgtgaactgtagagcttatgaaatcatcataaatacaaatggtattaatacaaacgtttgggatttctcaagtaacctatttctaacaaattactcactgagtcaaaaataattcagcacaatataacaatgacattgcagaggcattattcaaatatttaacaactggcacagtgcaggcaccatgcaatcagaacacatacaaaacctatcaagatgggctcaagctgtaaaaatctcatacttacatattgaggcacattggctagctattggccttcatagaacatacttaagtaaaaaataacagatacaacacatctgcagaaaacaatcacaaaatacaaacctctactatataataaatttataaactcattcaacacacttttactgaatgcctacagtatgccaggccctgaggaaatagtggaacagtgatcaataagacagaaatagcctacccgtatttgcaggaacactgtgtcttatatcctacagaaatcttttttaattgcttatttagaaaatggctgggtgcggtggctcacatctgtaatcccagcactttgggaggcaaaggtgggtggatcacctgaggtcagtagttccgagaccagtgtggccaacatggtgaaaccccagctccgttaaaaatacaaaaattaggccgggcacagtggctcacgcctgtaatcccagcactttgggaggccgaggcgggcaaattacctgaggtcaggagtttgagatcagcctgggcaacacggcgaaaccccgtctctactaaaaatacaaaattagccgggcatggtgacacatgcctgtaatcccagctactcgggaagctgaggcaggagaatcgcttgaacctgggaggtggaggatgcggtgagccgagatcgcgccattgcactctagcctgggcaacaagagtaaatctccatctcagaaaaaaaaaaaaaaaattagccaggtgtggtggtgcatgtctgtggttccagctactcaggaggttgaggcaggagaatcgcttgaacccaggaggtggaagctgcagtgagccgagattgccccattgcactccagcctggtcaacaaagcaaaactccgtctcacgaaaaaaaaaaaaaagaagaaaagaaaatactagacttctggtttccaaactggaaatctctttctccatgaaaatatataatataggaatgacaccaagtagtaacttcagctcaaaatgtcattttgtataaatataaaatatataacattcataagttttcctaaatacctataatatctaacagaaaatacaagagttttaaaacaacatttctgataccaactataagtataaagtatctaggagtgtattaaaacatacacaagacttgaaagtaaagaaatttttttccacttttgataaatgaacagacctgtttctggatgggaatattaaatcagttcaagttgttaacttttcacaaattaatctataaattcagcacattaccattaaaattccaatatgatttttttctgaaacttatagtgattctaatttctatctgggaattaaatatatgaaaaaagtgaagggaaattctatacaaaaagaatactagaatcattaaacaaatggtataacataattattaaaactgtatggtactagacagaaaataatctaattaaaataaaaggttggtacaaataacttcaatataggattagagtgtcatcacaagcattaaatggagctatgaaattttcattttaaaaaattaagactgaatccttatcttacaaaatatgccaaaataaattctagataacttaaaatatcaaaagttaaattagaagccacaaatataagaaattctcaaagagtacaaaactcattaagctgtagaaataaaaagtggtacagaaataaagtattttcaatttggtgaaaaaaatgtttaggaagacatgaacagtcaattcacaaaaaaaaaatccaaatgacacttgcaaaaaaaaaatactaaatgaatttaactttgtttgaaattattaatgctcaaagtaggtgagaacaagattaaacagatactttcatacactcctgttgaaatatttccagaaagcaatatggtaatactaactaaacatataattgtgttaagtcaagacaatcttttattaaatgtgaggaataacaatcagcagcagatgccaatgattaagaaaaattaagaggaaaaattcaaaactgagaaaattaattccatgaacttcaacctgtaaatttggtaaagataatttttaatcaattttagcagtagaaaggtctggtccaggtccaagaacaccagtattctcaggaagataatttaaaagaatccacacagaagaatgtaaaattaaggagtgacagaatcttcagacacaagaaaaccttcttgtggaaaagaattgcagtgattcagaaaagtagcagaaaaaaacaaaaatctctaaggccatacaaaactagtaattccataattatataatgattataacttcaaaataactttttagtgaaaggaaagctcaaagagaaaatattttatgaaaatcatctagatacaacaataaaaaagacaaactcttcaacagtattttctagaagacagaaactaaaccttgtccactgaatacaataaagtacttcttacaacacccacatacaattgtacatcatttcatataagggaaaccaaccaataaatctgaaacaatttactgccaagaagataatgtctggagagagttttaatagtgtgaaattttcttctaacaattacatatcctccatgcgatctaaattggtcaaaaacctcgttacaactaacataagagaccttaccttcatcttaatattacttacatcaatcattcctataagtaaccaccctttcaagaagctatagatttttgaaagtaatttccaaaaaaagccccaaatatttcaccagcttttaaactgagattataatggtgagagcaatatccagacaggtgttttaaatattcctccattgctttaaatactataaaatatgcctttcaaggagaaattgatggcagaaatttgtacatacaaatgtgtggcatatttgatatactatatgtatgcatatctattatacctaaaaaacatgcacagggtctacagtatgtcatgttaaccctttctaatagttatttgaagctgatcaaccttcaaaacacaaatttgtttccaatgacagggatcataatccaggtacaggcattggctagttattatctgagctgtagtaatggctctgcactacaaaatgtaatcttcccaaatgtcacagtaagttatgaatatctgagcagcctaatgcactttactagccatgaaatgtgaaaatgtaatcttattaccttttttatggttgtatttttttgaataatgtagcatggaaactgatgtatagtctttttctacattttagcatgatttggtctcctttgctatatagaacatttttcaaaactctccatttcaacatattttagtcttggcctgaacttcataaacaatttttatagcagccttcagggtggcataacatgctttctataggttatactttaatgcataaggttatagaaattttaaagcaacttattcgaagaattcaaataaacctttataagttttgtatgaggactttaattgagcatgattatttttcttctcaatagtgatactaataaaatactttaagctgacattagtcactaatctaaattacctgtatattcggaaaatctaaagaccaaacatggagatcaaaaataattatcttctcttcaaaagattaatacaactggaatactgtgtgactcacagaaaattcaaatacttcaaagtaaagctctgttctccctggacaactcactggaaacttgctaaatttttcctcaaaggtggggcaggagtatggtatagtttaaaaaaaaaaaaaaaaaggacagggtgtaatcacagcttctgaccctaactagatactttcttgtgacctatctattatgacaggtgtagttaacacctgtctaaaaatgtcaaaattgcttttttctctgaacctatttatttataaaattaactaagagtaagcttcttttatttatctgcatccttcagaaacatattcaggttttaaaagtgtcaacctcaagatatccaatttttctccaggaatcctttcctaagtgaatgttaccttgtatatgtttacagccactggaaacttactaataaggagaagttgagggaaaattacaaagctgtgacacagactgcactgactcccaggttatatttccttcttccataataataaagagtttctagtttggcacacagagcccaggaaaaagatctcactctccagcttttcttgaatgaaaagcattcctgatcagccatgtgaccaagttctgaccaacaggcagtaaatacgtgcaacctctaggtattattctttaaagaaagaaacctgacccctttttccagctacgctccttcctactgcttaagatgcagaatagtggcaagagctacagtagccatcctggaattgaaggtgtcttatgttgaagataaaagagcaaatcgatctatggatcctggcaatcatagaactgccacactagcccgctacccagactttcacctgaaggacaaatacatttctgttttgcagaaaccactgttaatttgggcctctctgttctatcagttaaaagcctatattctgactaatatagatgctattcactgcattttctcagaaattaaaaaatatatattatctataactatctcaaatgatgtatccttattccccattcttataccatagcaggtgttagttcaccaaaagtgtcttttttgacctacttttgatagttggttatgtgccctggtaagttgagaaaccacagaacagcctattccctgactatattcttactggatagcttcatatatgctctacactactgtgccactatgacactttgccagatgccccattacaggttgaattgtgttctccaagaggacatatgttcaattcttaacctccagtgcttcaaaatgtgatcttatttggaaataggattgctacagatgtaattagttaagatgaggtcattagggtgggtcttaatccaatatgactgttacccttataaagagggaaaatttgtgctcgacacatgtacacagagaaaatatcatgtgaaaatgaagatagagattacagtgatacttctatatgccaaagaatgtcaaagattgccagcaaatcaccagaagtcaggaaagaaacatgaaacagattctcacaattctcagaaccaaccatgccaacacacttatcttagacttctagcccacagaactgagggaataaatttccattgtttcagcaacctaatttctagtactttattacacagccctaacaaactaatacatcccaacatctcccaaggtttatttttgatgttacccactaaattccccagtaagcattgtcaagaactcttagaaaagccaaaccacgacccagagactctgttcagcttatcttcacccagaccttcctacaacaccgtactctccttagagaaagaggtttgcggaatggatacacacagacatacagagtgaaataatagacactggagactccaaataatggaaaggaggtgagggtgaaatatcacctattgggtacaatgtgcactattcaggtgatgggtacactaacaggccagacttcaccataactcaatatatcaaggtaacacactgaacttatacccctaaatccataaaaataaaaacttcaatgtcaaaaaataggtttgtgattggtactcagtttttccaaaaagaacaatatattgctgaggaatatatacgtagataataaacttaaaaaaaaaaacaaacaaaggaatgactcacatcaaagttagcaaaagagctgggcatagtggcttatgcctgtaatctcagtactttgggaggctgaggcaggaggactgcttgagcccaggagttcaagaccaggctgggcaacatagcaagacctggtctcttaaaaaaaaaaaaaaatagcctggcaggtggcacatgccaatagtccaagctactcaggaagctgaggcaagaggactgcctgagcccaggagttcaaagctgcagtgagctatgatcatgccacagcaccccagtctgggtgacagggcaagatgctttctcaaaaaaacaaaacaaaacaaagttagaataaagataattgttttagcaaagaaaaagagattccaagtaaaaatattgttctattgttaacctggtattggatatatgcaggtacattttaatggtttttaagtacttttatatactttacacatatctttttaagtactttttaatacttttaagtacttttatatattttacacatacatttttaaaatacaacttattttgtatttgctatctccttgcctctctctgctatcttttggaaatttccccagtgtttcagttaccacattctttattcaattctttctaatctacttttcaatctgtctgttgagttaatttctatgtctttttatttaaaagttctatttgttgttatttttcaaatctgcttagtaatcttctctctttcctacataatcttttaagtgccttttttgttttccttctttttgttttctttctttcatgactttttgacatgaaagggcctctatttcataatttattataattttctaaattttatagtttgaaagtcttgaagatctaatcttgctttcagtgtatctactgactcctcatgctgtgctgcttttttaacgggtttttaaattttagattgtaaatttattttcaatggggctttatctgagagactctcgtgcagcctgtgcctctctaggttgaattaggtattctgctacctgccctagggatgtcttcagcatggaatgacttaaaaatatatatatatattttgagatggagtctcactctgctgcccaggctggagttcagcagcatcggcttactgcaacctccacctcctgggttcaagcgattctcctgcctcagcctcccgagtagctgggattacaggcgcccaccaacacgcccagctaatttttgtatttttagtagagacagggtttcaccattttggccaggctggtctcaaactcctgaccttgtgatccacccaccttggcctcccaaaatgctgggattacaggcgtgagccaccgcacctggccttaaaaaatattttttattgtgaaatgtttcactgcacccagctgccaagctattcttagacaaaatttaacattacagatatcgtggtaatacaatccagactttttttggaaatatcatattttctttcggaacaaacatttcttatatagtgtctggctacaatggctcatgtctgtaatcccagcactttgggaggcagaggcaggtggatcacctgaggtcagaagttcaagaccagcctggccaacatgggggaaccccgtctctaataaaaatacaaaaattagccaggtgtggtggcaggcacctgtaatcccagctacttcagaaactgaggcaggagaatcacttgagcctgggaggcggaggttgcagtgagcagaaatcaagccattgcactccagcctgggcaagactctgtctcaaaaaaaaaaaaaaaattcttagtaatatttgtctctactgggattctaaatctctgtaggtaaagacagtaaagtgtttttcttgcaggtaaagaaaattatgagttcgatactatataaaagaaaaagagtaagtttaatatgatttacagttaagtgtaaatgtagaatgtcactagaaacaaatataaattttcaacatatcccacccaaagaacttcacacaaatatgagtccaaaatatttcctaattatcaggtactagaaatcaaatctgctgttttaggacccaatttgaattctaaaatgttttcaccgaatacaacaatatgggttgggtagacaaaatttcagctcactctggttttcccctgtcccttctctaagatcataattgtaaaaaactatgtccatgtcccaggaatcacagaacatttagtctcgtataagaaatttctcatttcagaaaattaggttaaatttggtattctctacaattgcctttcctctttcttgcttcttttaaagaactataccttaacgttttcttaaggcccagctcaagaaatatctctctgagaaccattttgacctctccagccgacagtaaactagaatgatacacatcatattaccaatacaatatagtcatttaatatgctgaactgaaaatattccctttgaagtttttgttctccttctacttactatattctgggtctttcactatttcttagaatgcacagaagccctagcagtttcagcaatattatcaacaaactcacaatcatataagatttccatttctactatcataactaatccttacaagaaccctgtaagtcatacagattagtcaattatcacatctagctgataaaggaacaaaaaaaaaatgtgtccattcatagccaagactacaaatcagactatctgactcatagtctcatgtttccttacaccttcactaataatctattatttaagttagatttttttttctttaaatagtgagctaagtatttgaaaaatttgtgaactttactatctatacaaaaattagtcaaagtatatgttactgaaaataaattagaagtatcatctttatatttatttaaatccccaaacatactacaaaatagtcgaaatctcctctcattgtttattgtacccttcataagagttagaaattttcacagaataatggtatgtctacaaaagtgttaagaaaaaaggttccatgatcaaataagtctaagaaataatgaattaaacaatggtaaagagatgtttatatgatagaattaccagagctttaatatgcaactgtgcagtagacatcttgaaaggaagatatacaaccaatgcatggacttcccaaaagttatttcacaatggaacctcttttcctttttatttgatttagagatagggtctcactatgttggccaggctggacttgaacttctgtgctcaagcaatcctcctgcctcagcctcccaggtttctgtttgaacaagagattttttcataaatagcattcttcaacagctttttcaaaaaacatttgatgatgtaacatatttatgttcttgaagcttattattgtaagcttcacccagacccctaaatccataaaaataaaagtgcttgaagtcttagataggcagctggatgaataaatatcacagaattaactatgttttaagcaaacatttagtaggcacttcagaagtttttcaggtaagtagtttaactcaacctgtttgttttttcacagatttccttttatgacttattgaagttagtaagtaaacaaaaaagacatcttcaattaagattactttaggaaaaaagaaaatatgagcaaataaaatcacactaacccctcatccctttctgaaccagtcagtccaaaagtcaagcaacatagatatcctcccacatttggctggtctgtgtgcccacagaagtaatgtgtgacttacgaagttaggtcattagagcttcatggctccctttacatcattcattctaaggaaaatcagtcaccacaaatgaggatattcaagcagctcagtgagaggctcacttagagaggaacagtcctccagccagcagccagcaccaacttgccagtcatgtaagtaaccctgaaagcaagtcctctagtcccagttaagtctttagatgactacagctccagccaacattttgaatgcaacctcgtgacagaccctgagtcaaaactatctagccaacctactcccaaattcctgacccagaaaaactgagctgataaatgtttatcactgttttacactgtaaggtttgggggtaatttgtaacacagcaatacataactagtacagttacaaatcagtaattggggaaaactttattatgctatttattcctgtatcataaattttttaattcaaatattctaataataaaaatgcacagaataagtgattgctgtcagctacataggcactttacataagcactttacatggattatcatatttaattacctcttgtaaacatgaaacataagtaacttctgaacatgggtttcaacactacataatacttgtatttaattatttgtgacagttactgcagactggcttacccaacaccaattcctcaaagtctatcagacaaaactgaaaagaaagtataaatgagaaaaaaaaaatagttcatatggcaagaagacagttttggcaatgagaaaaatgaaacaaaaagatatagccaggctttaaaatcatactctatacctatgtattaagaagagaaaaagcagtgaaaaaaattcgagtggctaacagtttgtactctggcatgactctatacatctgaatactggtgatatggtttgtctgtgtctccacccaaatctcatcttgaattgcagctcccataatccctacatgtcgtgggaaggacccagtggtgggtaactgaatcatggggtggggggttctcatgatagtgaataagtctcacaagatctgatggttttataaagggcagttaccctgcacatgctctcttgcctgccgcatataagacgtgcctttgttcctccttcgccttccactacgactgtggggcctccccagcaatgtggaactgtgagtccattaaaactcactttctttataaattacccagtctcggttatttcttcacagcagtatgaaaatggactaatacaactggaaagttctttttttccatctcaaatatccaagtcagtctgaaatgtggaaggtatttagagttcaaggaaaaaaaggcagaatcaaataattcgagtacctatataaatatcttctataaaattacgtatagaaaataagatataaagatatctattgcagcactatttgtgaaactgaaacattagatatagcctaaatatccagcaatagagagatacttataaccagctgatggccatgtaatggaatattgtacagcctttaaaaagaatataaatcaatatgtgctggcatgccacgatgttcaagacacaatactaaatttttttaaaggtgcaggacagtatttacagtatgaccacatttccttaaaagatacaattatatttaaatcagagataagtgaaactgcagtttcagcctaggtagttgccaaaacatattgcttggtttcagctaagtgcccacttatgcactgcttctgacattcctaaagtgtaggtgataaataattgtattatcaagtatattaacatcatatataatcagtatgacaatgtcagtaatatagataaggcaagtcattcggatatagtatctgaatattcactttcaaatgcagacaaatttttgaggaaaaatctccttatgtgctttatatggtaaaagtgaggaattaaggcatatttctttttttttttttagatggagtctcgctttgttgcccaggctggagtacagtggcacaatctcagctcactgcaacctccgcctcccaggttcaagcgattctcctgcctcggcctcccaagtagctgggactacaggtgtacgccaccaagcatggctaatttttgtatttttagtagagacggggtttcaccgtgttagccaggatggtctcaaactcctgaccttgtgatccacccacctcagcctccctaagtgctgggattataggcgtgagccaccatgcccagccggcatatttcttattataagaataaaatgctacaatatttatttattatgaaataaacagtattatgaaagctactaattttatcttacaaaagtaactgtgccttcctcaataattggtagaaataaacagaaaatcagaaaggattaaaagaactcaataacactatcaacaaagaagaactaattgacatttatataagactccacccaattatagaacaataaatattgtttacaagggcctatggactagagattatattctgggacataatacaaactcaacaaatttaaagatattgaaagtatatggagtgggttctctgaccacaatgaaatcaaactaggaatcaataacagaaagataaagatcacagaaaaatgtgcgaacacttggaaactattacactcctaaatagtttatgtgtcaaaagaggaagtctcaaataaattttttaaatacgatgaactgaatcaaaataaaaatataatatatcaaaatttgtgggccatacctgagagggaaatttgtagcactaaaaccagaagtctcaaatcaataatctaagtttccattttaaagaacctagtagaaaagcaaaataagcccaaaacaagcagaaagaaggaaataataaagacaaaagcagaagtcagtgaagtagaaagtaggaaaacaataatcaatgaagagctagttctttgaaaagatcaataaaattgacaaaccttggcaggacttaaaaagcagcaagaaataagacacaaattactagtatcagggagaaaacactatcactacaggccttagaggcagcaaaaaaaaaaaaaatagggaatactgcaaacaactctaaacatataatgtgacaacttagaggaaatggaccaattcctcaaaactggaagctaccactacttgcccaatatgaaataatttgaataatcctataattattaaggaaattaagttcataattttaaaattcaaaaaagaaatctcaaagttcacatggtttctctggagaattcttctaaatattttttaaaaaattaatgccaattttaaatttctcaatccattttacgaagctactattttactaaaaccagacaaagacagtaccaaaaaaaaaaaaagcctatacaccaatatccctcatgaatataaacaccaaaattcttaacaaaaaattagcaagtagaattcggcaataaataagaattttacaccatggccaagtagattttattccaggaatgcaacactgttttaatatttaaaaatcaattaatgtaatccaccatattaataggataaggtaggacaatcacacgatcatatcaactgatgcagaaaaagtatttgacaaaaattcaataacactattgaggataaaaactcagaaaaatggaaacaaaaaaaaacttcaacttgataagcaacatttacataaaacctacgactaacattatactcaatgataaaagaccgagtattttctctcctaaagatcaggaacatggctaagacatgcactctcactacttttattcaaattagtgctgaaagttccagccatggcaattcagcaagaagaaataaaaggtatgcaggtgagaaaggaagaaattaagctgtccctatttgcaccaaagacatttccaaaaacagaaacctcctagaaataatgagttcagcaaggtaacgggttaccagataaacatttaaaaatcaattatacttccatatactaccaaggaacatgtgggcaatgacatttaaaatataccatctataattgctcaaaaatatgaagttcttagatgtaaatctaacaaaatatatacaggacttgaatgctgaaaacaataatatgatgatgaaagaaatcaaagaagatctaaataaatggagaggcacactgcattcatagtacagctgtcaattcctccaaaactgatatatagatctaacatagttcccatcaaaatcccagcaagacttttgcagatatagaaaagattattgtatgatttatatggaaaagcaaaggaactagaataccaaaaacaatcttgaaagagaaagataaagtagaaagaatccatctacccaatttcaaaacttattatgtagctacagcaatcaacactgtgaggaactggtggaggggcagacacataaatcaatgagacagaataaagaacccagaactagacccacacaaatattctgaacagttttaacaaaagtacaaaaagcaattcaagggagaaagaagagtctttaaaacaaatggtactggaacaattacaaatgaacttttctttacctaagtattacaccttacacaaaaactaactcaatattgatcacggatttaaatgtaaaatataaaacttttttaaaaacataggagaaaatcttcagaatttagggttaagcaagaagtttttagacttgacacaaaagcaagatccatacagggaaaactgataaattaggctttattaaaattaaaaattctgctcaccaaaaaaccttttcaggaggatgaaatggcaagctacaaactaggagaaaatatctgcaaaccaaatatctgacaaaagaataatatctaaaaaatatagtctctcaaaagtcaagagtaaaaaaaatccaattagaaaatgtgcagaagaacgtttcaccaaagaagacataaagaagacacataaacacacacacacaaaaagtctaacatcattaggcattaaagaaatgcaaattaagaccacagtggatatcactatacatcaatcaaaacaactaaaaaaataatgacaacaccaaatgctggtgaggatgtggagaaactggataattcgtatgttgttggtgggaatgtaaaatgacacagccactatgaaaaagtttggtaatttctatttaaaaaaaaaaaactaaatatgcacctactattcaatctagcaagtgcactcctgccatttttcccaaataaataaaaacttatgttcacacaaaaacctgtatataaatatttacagtagttttgttggtaatagccaaaaagtggaaatcactcggatgtccttcaacagctaaatggttaaacaaactgtagtacatccataccataaaatactattcaacaataaaaaggaacaaactattgacacacacagcaatctagaagaatctccagagaaccaattggtttttttctcaagttcgtacagtcttctggagattcttcaactgacaaaaatatagaaattgagaacagattggtggttgccaggggttaagatggggtagaggaaagtgggtatagctgtaagagggtaacaggaggaaactttctgcacctcgattataccaatatcaatattgttctagttttgcaagattttcccattgggggaaaccggataaagagtacaaaggatttctctgcattatgtcttcaactgcatgtgaatcagcaattatctcaaaatagaagacctagttttaaaaaataagtaattctatgtgaggtataaattgtcacaggattaattttccaccaattatttcccattgaaaagaaaactatattaacctaaatgaatcttcaattggtagaaaaatgagagccaaattaagcggcaaggaaactcgtaagttcaaattctgaagccacctacagacatacataatcccagcttctttacttatccctccctccctactccagccaaaaaaaaatcagtatatttaattacttgccctacacctgaaaaaatgtttgccatatactatacaaaaaagatgaagcatatattgatatcacacagagtttaactatatatcctactgactcacatctaatacttgcattatagaataaatatgcaaatttgaaccttcaaacaggaaatgaaattttctaaatccattacataacttcagattcatgtgtgcactgaaggctaataaatcatctaaaccttcatacagagaacctttttaaatttgcatttatctacagtaaattctgtcatgttctttaatagcttgctggttcaatctagcaaactagtgatttatagcagtgacatatttcaaaaatcagaaatctctcactatgtgacaaccagtcaaagtccactgaacttacattacttgaactcaaacatcataggatatgaaagagatagcaaaatgtcatgaatttcatattcaaatcaatttgagtttatgtttataagtgtttaaaactatagcatcacatacattacttaatacttcagtaccccaaatattttatgtcatgattccctcaatgtgtccaaactacctgtattttaaaatacatttttaaatttgatagttcataatttgaagactctacaaatcttactttgaagaacaccaaaatttagggtacatgaaagaaagatctatatattaggttttctccaccaaaaaaaaaaaatgtacttttagatctttataataatttcataccaatatccttatgtagggagatttatcagatgtgaaaatggagattatattaacaatagggaaataaactggaaattaccaaaatgttcactgtaatagacaatgttgtttttgtctgtattgtatttactcttccttccatcctcttccatttatggaattctgacaagaaagtctcagtacctcacacccaggtcacagagaggtcacttaagtcaggcctggctaaatatatacttcccccttctactggccacagtgattaatacaagactgagaatgtgagctaagtcaggccaatcaaaatcattaccaagactgttttttaatttataaggtgaaaaagaagggctcttggtctttgggtcaaaagtaggagaaatatgtaaactgaaggcttccagcagatatgttccctgccatgtggacagaggaggcctagctgcaccataaatggaagaagaatattctggtgacatcaattccctgtttccagggtttccctggttcttgcagcttcattcaatgatgtagcctggtcctatgaaccaatcattcccttttatacttaagctactttgatgtaagattctatctcttacaatgagaaaatcccggattaattccaaaaaaagaaggaactagctgaattatggcacatacgtatagttgtatataacacagcaattttttaaatcattttcattcatagttctccactgacagtctacgttagactcaacatcatctttttacaaaaaaaaaaaaaattctttgtgacacccctatactaacctgaaataaaagtgacacattccattttatcaattattttaaaaagatcagagatcagaatgtgtcttataatcaatggcatctaaaattacaattgcagggttttttcctaatgctgcataaaaataatgacaaatcttacaacttggcatcttagacttgaggaaacacaatagataataagacctacctataaacaacaacaaaaatctacaaagtactctaaccataataaaagaaaaataattaaaatacttttcagtattttttccatatataaatccttgtaaataaccaaataataaagtagttaggtcctggtaactatatacagaatctacattaatgtatgttacagaaacaaggcacagtgattcaggtgtgtattagatattcaaatactattatattccaattagacgtgatttttaattcttcataaagttccaaataaaacaaagtatgatttttttcttctttaaagcttacttatgtttctaaaaaaactcagcatatgttaaaagtattcaaaaagtttatgctgatatggaaaatgaaattaaagtctaataagttcaggagaacagaggatatcacaccttgctgtttgcaaatgtatcttccattgcaaggtccttagcagccttagtccagaacactaagtgtccactaccaactccaaatcattctaagaaccaaaaatactcaccaaatttcctaaacacctccaaggagcagtactggtctcactgagaactactcatgattggacaaggaaagatgtttaagatacatgattaaaggaaaaaaagcagatatgtacaaaataacctgttgtatatgtgtgtgtgtgtgtgtgtgtatgtctatagagagagagataggtagagacaaatgaagacagatgctgatacatataaaaatgtgtaggatgtatatgggtgtgtgtgctgcaagaagggcagacaataaactattaacaatggctacctcaaagaagtgggttgaggagagggaaattagacagtcagtctttcattttcacttcatacttttttaaatgagcatatactgctttaaacaataaaaaaaaggactttaaaaaatccaagtagtaaaggccatgtccaacatcattcccaagagcctgtctctttgcctgtgtctgtcaatgtctgcctgagcctcatcctgaccgtctataaggccgtctgtttctctctctctttctctctgtgcgtggggtgggcggggtggagagggtttctgtacctatctctctctggttcttggtatctgcatatctcttctttgagtgtgtctctcttgaaattatgtgtatctgtgctttactctctgagtatctgtctctctgtgtatgcatgaatgtcttcctcccggagcacagacggaagcatgggccttgacctcctcccagtcttaatgcattcatctttatatctctgtgtatgtgtccatcttccactttctcacttacaattattttgcttcctttcctcttctgtttccctgacccctcatctccctccatcaagcccttcgcccatcttgtcttcctctactacctccccaactgtttccatataagcaaagttcacactgctagagtgttaatgtgttcatagccctgataaactctcttcaactggatcacaaatgatcatttctatctgaagagcgtatctgaagagttctgttagttacaaaataacatgctaactaaattaaaattagggtaactaatccttattttaataatagaacaactcagcagaagatcaacatgaaaaacagaagaggtgaacaacactataaaccaactaacctcacgaacatctataggatatttattctccaggatagaccatgttactcatccataaaacaaatctcaataaatttaaaagaatagctccctctccctctctccctccccctccccctcccccccctctttgcacggtctccctctgatgccgagccaaggctggactgtactgccgccatctcggctcactgcaacctccctgcctgattctcctgcctcagcctgggagtgcctgggattgcaggtgcgcaccgccacacctgactggttttcgtattttttggtggagacagggtttcgccgtgttggctgggctggtctccagctcctaccgcgagtgatctgccagcccgggcctcccgaggtgccgggattgcagacagagtctcactcactgagtgctcaatgttgcccaggctggagtgcagtggtgtgatctcggctcactacaacctccacctcccagccgcctgccttggcctcccaaagtgccaagattgcagcctctgcccggccgccaccccgtctaggaagtgagaagcgtctctgcccggccgcccatcatctgggatgtgaggagcccctctgcctggctgcccagtctgggaagtgaggagcgcctcttcccggccgtcatcccgtctaggaagtgaggagcatctctgcccggccacccatcttctgggatgtggggagcgcctctgccccgccaccccgtctgggaggtaaggagcgtctctgaccggccaccccgtctgagaagtgaggagcctctccgcccggcagccaccccgtctgggaagtgagaagcccctccacccagcagccgccccgtctgggaagtgaggagcatctctgcccggcagccgccccgtcggggaggtggggggcagcccccgcccggccagccgccccgtccagaaggtggggggcccctctgcccggccaccccgtctgggaagtgaggagcccctctgcccggccgccaccccgtctgggaggtgtacccaacagctcattgagaacgggccatgatgacgatggcggttttgtcaaatagaaaagggggaaatgtggggaaaagaaagagggatcagattgttactgtgtctgtatagaaagaagtagacataggagactccattttgttctgtactaggaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatactcgttaagagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatcctcctctctgagaaacacccaagaatgatcaataaatactaaaaaattttttaaaaattaaaaaaaaaagaacctagactcagaaatcaaaaaaaaaaaaaaaaaaaaagaataaaaggaacaccaagtatatcatttgaccataagggaataaaactagaaatcataacagaaagaaattttggaaactcaacaaatatatggaaattaaacaacacactcctaaatagcctatataaaagaataagtgaagaaaaaaaattaggctaggcacagtggctcacacctgtaatcccagcacttcaggaggccaaggcaggtgcatcacttgagcccagagttcgagaatggcctgagaaacatggtgaaaccctgtctctacaaaaaacagaaaaatgagccaggtgtggtggcacatgcctgtagtcccagtgtctcaggacacctgtgaggatcacctgagcctgagaggtagaatctgcagtgagccaccatcacaccactgcactccagcctgactgaaagagtgacacactatctcataaaagaaaaaggaaaggaaaaaaagaaaatagaaaatacactgagatgaatgaaaatgaagatacaacatgacaaaatgtatggaatgtataaagcagtgttcagagggaatttatagctgtaaatgcctactttaaaatagaagaaagatactaaatcaacaatataacctttgaacatgcataaaaagaaggagccaagccatgtccggtggcacccacctgtggtctagctactcaggaggctgacgcaggaagattgcttgagcccaggagttcgaggtcagcctgggcaacacaaggcaaacccccatctcaataataataataatgacgtaggccgggcgccgtggctcacacctgtaatcccagcactttgaaaggccaaggcatgcagatctcctgaggtcaggagttcaagaccagcctggccaacatggtgaaaccccatctctactaaaaatacaaaaattacccaggtggggtggtgggcgcctgtaatcccagctacttgggaggctgagacaggagaatcacttgaacccgggaggcagaggttgtggtgagccgagattgtgccactgcactccagcctgggcaacagagagagactccatctcaaaaataataataataatgtagccttccatcttaaaccctacaaaagaagcgcatagtaaacctaaagcaagcaaaaggaataaaataataaagattacagaagaaatgaatgaaacaaatgagaataaaatgaaattaacaatataaaattagtggtatttttaaaaataaaatcaatacaacctggcttctttggtccttcaacaacaacaacaaaaaaatgaaattgacagatttttagttagactaaccaagaagaaaagagaagactcaaattactaaaatcagaaatgagagtgcattactaccaaccttacataaatgagattataaagacacactatgaacaattgtatgccaataattagacaacttagataaaaggagcaaattcctcagagggatacaaactacagaaactgactcaaaaagaaatacaaaatacaaacagacctacaacaagaattaaattagtaataaaaaaatcaactcacaaaaaacaaaacaaaaaaaaaacttaggcccaggtggcttcactggtgaattctacctaacatttaaagacaaattaatacaattcttcacaaactcttccaaaacactgaggaggagagaacacatcccagctaaatctatgaggccggtactaaccttatgccaagatcagacaaaaccatcacaaaaaagaaaactacagaccaatatatcttatgaatatgaacacaaaaatcctcaacaaaatactagcaaaccaaatccaggaacatataaaaacagttatacactatgactaaatgagatttattccaggaatgcaagctcagtttaacattcaaaaattaataaatgtgatacaccataaaatgaaaaaccacatgatcatctcaatagacaaaaaaagcatctgacaaaatctaatacctttcattattaaaacacttaacagactaagaatagaaagaaacttcttcaacctgacaaagggcatctatgaaaatcccacagctaacatcatacttaatggaagtatcactatgaaccaattaggtattttatcttaaaatacatatacacacacatatacacatacacactcacacataaatatgtaatgtgtgtgagtgtgtgcgtgtgtgtgtatgtgtagttttatcaactggaaaggggtacaaacaatgaccaacacaataacaatgaacatgcttactgcccagattgtggtcttgaaataccatttctcactaaaaatcagggcttcttgaaggagtagcttgtattagtctgttctcacactgctaataaagacatacctgagactgggtaatttataaaggaaagaggtttaactgactcacagttccactccccagtggaactggggaggcctcacaatcatggctgaaggtgaaggtggagcaaagacatgtctttgcaggcaagtgagcatgtgcaggggaactcccctttataaaaccaccagatctcatgagacttattcactatcaagagaacagcacggaaagacctgcccccatgattcaattacctcccactgggtccctcccacaacatgtgggaattgtgggagctagaattcaagatgagattttggtggggacacagccaaaccatatcattctgcccacggcccctcccaaatctcatatcctcacatttcaaaaccaatcatgccttcccaacagtccccccagtcttaacccattttagcattaactccaaagtccacagtccaaagtctcatccaagacaaggcaagtcccttctgcctatgaatctgtaaaatcaaaagaagctagttactgcctggatacaatgggggtacaggcattgggtaaatacactcattccaaataggagaaattggccaaaacaaaggggctacaggtcccgtgcaagtccaaagccagtgggacagtcaaatcttaaagctccaaaatgatctcctttgacttcatgtctcacatccaggtcacactgatgcaagaggtgggttcccacggtcttgggcagctccgcccctgtggctttgcagggtacagacccactccttgctgctttcacggctggcgttgagcatctgcagcttttcgaggtgcacagtgcaagctgtcagtggatctaccattctggggtctggaagattgtggccctcttctcacagctccactaggcagtgccccagtggaaactctgtggaggcgcttgtaccccacatttcccttccacagtgtcttagcagaggttctctgtgagggctccacccctgcagcacacctctgcctggacatccaggtattttcatacatcctctgcaatctaggtggaggttcccaaacctcagttcttgacttctgtgcacccaaaggcccgacaccacacataggccatcaaggcttagggctttcaccctctgaagcaatggtgtgagctgtatattgcccccttttagccacagctgggatgcagggcacaatgtccccagactgcacaaagctgcaagtcccggaggccagcccacaaaaccactttttcctcccaggactccaggcctgtgatgggaggggcttctgtgaagacctctgacatgccctggagacatttccctattgtcttggcaattaacatttggctcctctttacttatgcaaatttctgcagctggcttgaatttctcctcagaaaatgggtttttcttttctattgcatcattaggctacaaattttccaaacttttacactttgcttcctcttgaatgctttagcacttagaaatttcttccaccagataccctaaataacctctctcaagttcaaaattccacagacctctagggcaagggtaaactgccgcaagtctctttgcatggcaagaatgatctttactccagttcccaacaagttcctcatctccatctgagatcacctcagcctggactttatcgtccatttcaccatcagcatcttggtcaaagccattcaacaagtctctaggaagtttcaaactttcccacatttccctatcttcttctaagccctccaaactgttccaacctcttcctgttacccacttccaaagtaacttccacattttcaggtatctttacagcagcaccccaccctaccattaccaatttactgtccgagtctgttctcacactgctaataaagacatacctgagactgggtaatttacaaaggcaagaggattaacggactcacagttctacatgcctggagaggcctcatagtcaaggctgaaggcaaaggaggagcaaagacacatcttacatggcagcagccaagagtgtgtgcaggggaactcccctttataaaaccatcagatctcgtgagacttatccactatcaagagaagagcaggggaaaaacccacccccatgattcaattacctcccactgggtccctcccacatgagacctacaattcaagaaagattttggtggggacacagccaagccattatgatagctggttcaaggtctggaactagaaatgaaaatatgagcctgaaatatcttgccataaaaatagcagaaacatgatcaaagtctagtagggttgtaccaaaaggactcaggaatcaacctgaagaagtgcctactggccaaaaataaaagtttgaggttcaataaagtaataataattgccatcaaatatgtttaaatcctttaattcataatatttcaaaaagacaataacaacgaattggtctcctgtagaggataagaagagaaatggctgttacttacaaaattaatgaataaaaggaatgaaactgttccaattacatatttatataatatttatataatatgtaacatagtgtaaatctaatatacttattatattatctataattatatataaagaacatataaaaagtatataaatatataaaagaatgtaaatacacaaagaatatatttataaatctatataaagtatacataaatatataaagtgtgtgtgtgcatgtacgtatacatacttttttttttttttaagaaacagggtcttcccatgttgcccaagctggccttgaactactgtgttcaaggaatcctcctgccccagcctcccaactagctggggctaccggtgtgtaccaccatgcctggcttatctatgtattaactgtgccactggataactaaatacaactggataattaaatacatcttttcatagaactattccatttaatacatgaaaaaatatatataatatcatcattattcagactccagtgatttaatggatctagatgttgagaatcaacagctgataacattataaaaagagacaacctgacataagagcctccggatgacagaacacagcaccacctagagtctagccaaaggtatggaagccaaatcttctggaatcaacttccaatttgcaggaaatacggaggacacaagaacatgttaaactacaccatgaatatgcacttaacaaaatccagaccatgggaaatgctaaatgtcaaaaggtccaggttttttaaaaggtccaggtttttttaacagatagaatgacctgagacttaaaaaacgtgttttttaaaactaagaaaaactaaattatagataagggatgtattattagattacataattacaaataaataaaagaaagtgattactgtaaaagtcaagatagaggttccatttgagggagagaggcagttgtaattagagggattctaagatgactggcaaaattctatttcttgacctacatggtggtttaaaggtaattatttgccctttagttttatatttgttttggtttggtttttcaatagttacagttttacaataaaaatttttatgagaaagttctgtcaatggttaatttcatattttaaaacatctatattcaggcaatgcaattccatcataaaattagtagtttcagtttttgtaaacttgtaactcacagcctgtattaaatacatataacacatttctttcagtgactcctaagaagcttctgatgcataactaacctccatatgtaagtcacctcaaaacagtaacagtgctctcaagctgcctcagggaacatggcgccacctctctgctgagttatgtatagccactttggccgcccactgcatcctgatggtgatgggggagacaggctttgattgccagtcacacccctctatcctcaccccatattggctgtggctgtagatgagattcagctgtgggtggcctcagctcaccaaccactgccttggttttgagggtcaaacccaggctcaaacaggtgggggaggaggataaacagccatattcacaaatgcattcttgaatcactgaatctatgtgaaataattaaacaaaagagaatgtccttaaaaagaactcatatttgcaggcctaatcttcacccaagagatcttaaaatgctatcaccttatgcataagagctaaagagaaatactgcaaggcatcatgatatcctgagaaaacttaaagctaagacagaagaaacagagattagccagaaaaaaacaaagtctagaaaaatcaacattgatatatttcaaaagatttaacagctgcagaaaatgagtttcaaaaacaaaaaatactatttttaaaaataccagtcttattatttttattagaaaggttaggaggatagaagagaagcaagtagacaagctgactctaaatttctctaggaaaagtaagcaaacaggaatagccaggaagctgtgaaaaagaagtgcaacaatgggaagctagctccatcagagattaaaacataatatgaaataaaataacttttttaaaaagcggtagcagtagatgaatgtctgctagatgaagaagagaacagaaagtccacacatagtgccaaagacaacaggaaattatcacaccataataatagcaatttttagagcacttacttgtgccaggcactaagaatcttatgtatattaaatgtctgactactccatgagataggtacaattattgtatttttatttgaggaaactgaggcatagacatatgaagtaacttgcccaagatctcagaggcaagaagtggtgctgctagaatttcaacctaggtaatctagctacaaagtccacactcttaacctgtacgcactatggtttttctgtttttcattcaggtgacatctcaaatcatggaggaataataaacaattcaataaacagcattaaattggaattcaatttttttctacatatgttcaaatggacatttgtagaaaaaataaattggcccatatttcaaatcaggaaaaatttcaggccagacacagtggctcacacctgtaatcccaacactttgggaggctgagataggaggattgcttcagtccaggtgtgcaaaactggtctgggtaacatggggaaaccccatttctacaaaaaaatgcaaaattagctgggcatggtggtgctcacctatgatctcagctactcaggcagctgaggtggaaggatcacttgagcccgggaagtcccagctacagtaagctgtgatcacaccactgcaatccagcctgggtgacagagtgagatggataaataccagagtgataaataccatcaaaataatacaggaaagcatagaactttaaggaagttctgagtaagaaaagcctttctatgtatgattcaaaacccactaactataaaagaatagcacaataaattcaagctacataaaaataaaaagcttttggctgggcacagtggctcgtgcctgtaatcccagcactttgggaggctgaggtggacagatcacttgaggtcaggagttcgacaccagcctgaccaacatggtagaaccctgtctctactaaaaatataaaaattagccgggcgtggtggcatgtgcctataatcccagctacttgggaggctgaggcagaagaattgcttgaacccaggaagcagaggttgcagtgagccgatatcacaccactgcactccagcctgggtgacagagccagactctgtctgaaaaaaataataaataaaatttaaaagaaataaaaataaataaaataaaataaaaagctttttattaaaaaaaaaaacaccactagtcaagtcaaatcaatccctttaaaataagaagcttctagaaaataacaaaaacatcaactcaatataaaaaggggcaaagtaacatgttatttaacaatgaatttaatccctctccctctcactctgcctctccccctccccctcccctttgcacggtcctcgtctcccctttgcacggtctccctctgatgccgagccgaggctggactgtactgctgccatcttggctcactgcagcctccctgcctgattctcctgcctcagcctgccgagtgcctgggattgcaggcatgcgccaccacacctgactggttttcgtattttttggtggagacggggtttcgccctgttggccgggctggtctccagctcctgactgcgagtggtctgccggcctcggcctcctgaggtgccgggattgcagacagagtctcgttcactcagtgctcaatggtgcccaggctggagtgcagtggcgtgatctcgaatcgctacaacctccacctcccagccgcctgccttggcctcccaaagtgccgagattgcagcctctgcccggctgccaccccatataggaagtgaggagcgtctctgcctggccgcccatcgtctgggatgcgaggagcccctctgcctggccgcccagtccgggaagtgaggagtgcctcttcccggccgccaccccgtctaggaagtgaggagcatctctgcctggccgcccatcgtctgggatgtgaggagcccctccgcccggccccccagtctgggaagtgaggagcgcctcttcccggcagtcatcccgtctaggaagtgaggagcgtctctgcctggccgcccatcatctgggatgtggggagcgcctgtgccccgccgccccgtctgggatgtgaagagtgcctctgccctgccgcgaccccgtctgggaactgaggagtgtctctgccctgccgccaccccttctgggaggtgaggagcgtctctgaccggccgccccatctgagaagtgatgagcccctccgcccggcagcctccccgtccgggaagtgaggagcgtctccgcccggcagccgccccgtccaggaggtggggggcagcccccgcccggccagctgccccgtctgggaggtggggggcccctctgcccagccaccccatctgggaagtgagaagcccctctgcccggccgccaccctgtctgggagatgggggggcccctctgcccagcagccccgtctgggaagtgaggagcccctctgcccggccgccaccccgtctgggaggtgtacccaacagctcattgagaacgggccatgatgacgatggcggttttgtcgaatagaaaagggggaaatgtggggaaaagaaggagaggtcggattgttattgtgtctgtgtggaaagaagtagacataggagactccatttcattctgtactaggaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatactcgttaagagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctctgagaaacacccaagaatgatcaataaatactaaaataaaaaaattaaaaaaaatgaatttaaaaatgagcaaaggatacaaatggataattcaaagaaaatatggtcaaccttagtcataagggaaatgtaaatttaaattctgattaatcatcactttttcacctattagactggcaaaaaccacagctgctaatactgttggagatgctacagaggcactttcatagagttctggagggagaataaattaatataatccctgggaaggcagtttggcaatataaaccaaaattataaaggaataaaacctttgacccagcaattatatctctaagaatctatcctatagatacaattacattaagtatgaaatagtatatgtaaagattatttattgaagtattattagtaataacaaaatactggaaacaacccagtaaacaggggtcaagacaaccatggttcatctatgcaatagaatacttatatagctcttttaaaaatacagaagctctgtataaaatgctttagaaagacaaataagaaaaattatcagcaaagaaaaagcaagatgtagaacaaggggtacagcatgccaccttctgtacaatgaacaagtgaaacatacaagtatttacattagtttataaaagcctaagaaaatttagaaggatacatgagctgctaataatacttttcaggttttctctctatcgtctatatatcaatcattcatccatctacctatctatttatttgagacagggtctcactctgttgtccaggtggcagactgcagtggcgtgaacacagctcactgtagccacaacctcctgggctcaagggatcctcccgcctcagcctcctaagtagctgggactataggcacatacgaccatgcccggctaatttttttttttttttttaatacagatggggtttcaccaagttgtccaggttggtctcaaactcctgggcttaaacagtccttccacctcggccttgcaaagtgttgatgttacaggtgtgagccactgggcctgacctaggttttcttaagcagtgactaaattaactgaaggagagagatgagcaagggataatgtatgctggaaacaaggagaaaagaggtcatagagagagatttcattaaatacattcctatttttgacctgtgttaaaatgtttcaaagtcatatatttgacagaccagaaacaataccatcccacaggtactggatgagataccccaaataatatgttaatatcaataaagatagtgttttgtacatgatccatcttcattttcgtttttgactatggtattatgtgaaattttgcccctggagaaagggaagtacatattggagactgcagtggaagatggtagaaaagaagtgaatcagcaacttatgaggcaaatgcattaaaagcaaaatacccaagtggtatatttgtagctcattctcttaagtgctacatcttactgcttgttttgtattgctagttcattcttttttttttttttgagacggagtctcgttctgtcacccaggctggagtgcagtggcatgatcttgacatactgcaagctctgcctcccaggttcaaagccattctcctgcctcagcctcccaggtagctgggactacaggtgcccgccaccacacccagctaattttttttttttttttttttttggtaatttttggtagagacggggtttcaccatgttagccaggatgatcttgatctcccaacctcgtgatccgcccgcttcggcctcccagagtgctgggattacaggcgtgagccaccgcgcccggccgctagttcattcttaattattcaaattaactaaaaggcaaatcaggatgctttctagataattttttgtattataaaaccaagaaggtaaacagtgctagtttaagcatttggctgagttaacagatttttcccaaacaagagcacactgcagcctgtatttctcaaaacatctattactattgcatgtcatccatcagcataaacaaatggaagttcaaaaaatagggctgaaacaagacagctttggtaagaattaatatttaaatgtcttcctcagtgtcgtgtcatcaggaatcccaggctgaggcccagagacaacctcatggccttgaaatctaaacaacatagaaacataagccttcactatctcttattagttatttgagatctactatttactccataaacttaaaatatcaagtaaacactggtttttaataaaagtctaatttaatttgttttaaatagtagttaaaaaaccattaacacattaaggacataaaaaaaattcctccttgaaaaataactccaatttaattcagaactctaatgatagcacattattaccaccacctcaagcttctcaagaccattttaactatgtaataacccctgaacaaaaatcatcatggcttctcatcacctacagaataaaattttaatcacttgggcaacaacgcaaaatgtcaaaaagtctcacttcccatgttgtccctatacaatccagtccagactatttattatatccagaaggagttttaatattctactcccttgcctttgctctccctccctaaaattcaaagtttagctctagccccacttctacaaaacgacatttccagataaaacttgtccattgcaaaatatgctcagttcatagatactgctttgaatttttagtctcccatccaagtacagacatacatcattttatggcacttcatgttattgttctttgcagatacagcattttttacaaattgaaggtttgtggcagccctgcatccagcaggtccattggcaccatttttccaacagcatgtgcttgctttgtgtttctgtgtcacattttggtaaatctcacaatatctccaactttttcattattattatatttgttatgatgatctggaatcagtgatctttgatgttactactgtaactgttctggggtatcataaaccatgtccatataagatagtgaacttaataaatgtggtatgtgttctatagctctaccaagagactattcccccatctctcttcctctttttgggccaccctattatctgagacataacattgaaattaggccaattaataaacctacaatggcctctaagtgttcaagtgaaaggaagatttgcacatcttttttttttttttttttttgagacagagtctcactctgtcgcccaggctggagagcagtggcgcgatttcggtttactgcaacctccacctcccaggttcaagcgattctcctgcctcagccgcccgagtagctgggattccaggcatctgccaccatgtctggctaatttttgtattttagtagggatggggtttcaccatgttggccaggctagtctcgaactcctgacctcaagtgatcacccacctcggccttccaaagtgctgggatcacaggcatgagccactgtgcccggccgcacatctctcattttaagtaaaaaactagaaatgattaagcacagaaaggcctacgtcaaaggttgaaataggccaaaagctaggcctcttgtgccaaaatccaagtgtgaatgcaaagggaaagttcttgaaggaaattaaacgtaagcaaaacagcttcatggctgatatggagaaagttttagtggtctggatagatcaaatcagtcacaacgttcccttaggccaaagcctaatccagtgcaaggccctaactctcttcaattttatgaagtctgggagaggtgagtaagctgtagaagaaaaagtggaagccagcagaggcttaaggaaagaaacagtctccataacacaaaatgcaagataaagcttcaggtactaatggagaaggtacagcaaattatccagaagatctacctgagataactgataaaggtggctacacaatagatttttaatgtagacaaaacagccttctattgcaagaagatgccatctaggactttcctagatacagatatgaaatcaatgcctggtttcaaagcttcatagaacaggcagactctactgttaggggctaatgcagctggtgactaagttgaaggcaatgctcacaaaccattctgaaaatcgtaagatccttcagaattatgttaaatgtactctgcctatgctctataaatggaacaacaaagcctggatgactgcatatctgttcacagcacagtgtactgaatattttaagccaactgttgagactcactgctcggaaaaaaagatttcctttcaaaatattattgaccatttacaatgcacctggtcacctaagagctctgatgcagatatacaaggagattcacgttgttttcgtgcctgttaacataacatccattttgcagcccatagttcaaaatgtaatttcaactttcaaatcttattatctaggaaatacattttgtaaggctatcactgccatagatagtgattcctctgatagagctgagcaaagtaaacagaaaaccttctgaaaatgattcaccattgtagatgccatgaggaacatttttgattcatgggaggaggagtttggaagaaatggattccagaccccatggatgactttgagaggttcaagacttccatggaggaagtcacagcacatgtggtggaaatagcaagagaactagattgagaagtggagcacccaggctggagtgcagtggtgcaatcacaactcactatagccttgacctcccagactcaggtaatcctcccacctcagccacccaggtagctaggactacagatgaacgccacaacacccagctaatttctttttatttttggtagagacaaggtctcaccatgttgcccaggctagtctcgaactcctgggctcaagttatccacccacctcagcctcccaaagtgctgagattacaggcgtgagccaccacacctggccaaagcggtttcttgagatggaaatctacaactggtgaagatgccatgagtattgttgagataacaaaggatttagaatcttacataaatttagttgataacgcagtagcagaatttgagaggactgactccaattctgaaagaagttctactgttcatagaacactactgaacagcattgcatgctacagagaaatttttcaagacaagaaaacaaagatcagtcaatggggcaaaacttcattgtggtctgattttaacaacttttcacagccactgagcaaccaccaccctgatcgaggcaaaaccctccaccaccaaaaagattaggacactctgaatgctcagatgatcgttagcatttttaagcaataaagcatttttttaatgaaggtgtgtgcattgtttttttagacataatggtattacacacttaacagactaaagtaggctgggtgtgatggctcacatctgtaatcccagcacttagggaggctgaggcagacagatcacttgagcccaggagtttaagaccagcctgggcaacttagggagaccccatctctacaaaaaagtaaaaacttagctgggcatggtggcctacacctgtagtcccagctacttgggaggttgaggtgggaggatcgcttaagcccaagaggttgaggctgcagtaagccttgatcacactactgcacttcagcctgggcagcaaagcaagaccctgtctcaaaaaaataataataatatatacttgtgtgtgtgtgtgtgtgtgtgtgtgtgtgtgtacacacacacacacacacacacacacacacaaaagtatactgtaaatgtaactcatatgcattggaaaaccaaaaaatgtgtgactcatattcactactttattgcagtgctctcaaacaaaatctgcaatatctccaaggtatgcctgtactaatcaggcctaactccgcttagcttcaaagatcagacaacactgggtgtgctcagggtggtataactgtgtctagagtattagttatctttatatgagtcttgtttccatcagactgtaagcttctgagaaggaaaactgcatttggtgagcacctactatgtgctgggcattattttcaaatattccaagagccctatgaaactggtactgttattctcattttaaagatacagaaactaggtcagaaagattacacagcttgaccaagatcataagcccaagaactgacagacctgagtcaaaccaaaagtctacctgattccatgcaagatactgcctctcaaaaagaaaagaaaaattcaaaacaaaactattagaaagctatacagtatatagaatatgtcgaagtgtgctcactcatttcatttttgttgcaacccttagaggcaatgtattagttatggttgctactacttttctctggcaagcataatttcacatttccctttctctggttcctttgaggaactttttccttacttcaaagtagtcctggcagggacatgaatcatggtgcccaatttcatacagagtggcacacaacaaagataaggcaatcagacacatactgtcacatataatgattgttttagctataaggtcatcatgtaagccagcccagtcaaaatccttcaggggtctaggcattttcattatgttattttgaataattctgcttctaaccttcatcccagccaccttctctttcctcaactcaacacaacagaaatttgataaaagttcaataattgcaaaaggaatatttggcataagggtgaaaatacacagatatacttggttcctcatgtcttaataaaatctatagtgaaataaagtcaaagaacaatgctttcagtacagagtacttagataacaaaatatcattctctttctaatcataagatatatttaatactaaattttatgtaacaaatagctataaacaaatgaaacattaagagctctgatttttatttactatttcacaagggttccaagcttggcccaaagaggaagggaaaaagaattcacatgctataaaaaacaggtatgcaatctgaagcttgtgttaaagaaagaaggtaaaaatggagatgcctttaatgtatcatcatttgaaaacttacagcaaattaatgtagtatattagccaacacacagattagggagaaaaaatgcataaatgtatgccagtataatgtacctccattccataactactgagaaaataattagaaatttacagcacaatatatttatagattctcttataagtaccttaccaaaaaaatcaatgctacaaaaatgaaactaatgagcaccatctcatgggcatttgaagtaatatatgtaaaaccagcctttgcaagagctttaaaaagccaagttacttagtaaaggattaatcataaaactttcttttaaaatttcaaattttgtacatatatcctaaaaagttaacaagggttttaaacaaacagatatactatttaagccagtatttaaatagcttcaacaaatataaggggaggagatgtaaaatgattctcacaaaacaaactctgtagaagagttaaatagaagcaaaatccaaaactgttaaaaaataaaataaaataaaatagtacttaacaagaaaaaacaggattttagatagatttggcaaatctgaaagtaacataaatcaactctttctcatagtgactaacagattttccattttaaaaaccctgacttgatcattatacattctacgcatgtaacaaaataccatatgtaccccataaatatgtaaaatattacatatcaatttttaaaagtcagaagaaatgcttaaaaaacgtatttcacatttcctctaatggtgtacatttaaaaggaaatgcatttcccattcaaagaaaaacatgtactactttaagactaaagcaatctttgtcagcttcctggctcttcatttaagtttattttctaaaggcaatcaagtggaatatattaactagactatctgatactaaacaaagcagttatttcctgcctgaaatttcatccagtagcaacatacactcactgaagcacttcagtgtcacattctctcttggttcagattacatgaactcactttctgtaaattaatagtcagatcaagtatcttcttacagtgttagaagaaatggcaaactttgagaacaaaaattgtcctttaaaaaaaaactatcaataattagtcttggccgggactggtgatgggcacctataatcctagcactttgggaagccaaggaaggaggatcacttgaggccaggagttcaagaccagcctgggcaacagaatgagaccctgtctctatttttaaaattaaatattttgtctgtctgtttgtttgtttgtttgtttgtttgtttgtttttggagacaaagttttgctcttgttgcccaggctggagtgcaatggcatgatctcagctcactgcaacctccgcctcctgggttcaagcaattctcctgcctccgcctcccgagtagctgggattacaggcatgcgccaccacgcccagctaattttgtatttttagtagagacggggtttctccatattggtcaggctggtctcaaactcccgacctcaggtgatctgcccgcctcagcctcccaaagtgctggtattacaggcgtgagctaccatgcttggcctaaaattaaaattttttaaatgatattaatcagtctagttatcaagtccaatcttgttctacattaatatttcaaaagaggcataatgtatagaatcaaatgtgtacaatatagagtaaaatcttctaataattctgttctaataactgtgtgattacatataagataaaaggatgtctaaataaaaacttgtgtggatttttgccagttaggctattgattctgtttaaagaaaccaactcatgaccagacatggtggcttgtgcctgtaaccccagcacttcacgaggctgaagcgagaagatcacttcagcccaggaattcaagaccagcctgggcaaaatagcgagaccctgtctccacaaaaagtaaaaagcaaaagaaacttgagcatcagcagtgcagtaaagtttaaaagagcacaacacaagaatgcatcactgcaaatgaatctatcaacacacattaatcaagcagctattacataaaagatcaaatataagacgcactcgctgattcacaaaaatattcatgttcagcaggcaaaataacaatgagtacggtatgcaaagtactgccactggctataaaagggtaatggacaccagatttaatctctcaccataaagtggaaaactaaacaaaatacataaaacaattctttggactgtgatcactgaaagcacaaaaacaaacaaggtctcaactcagtgacaccttgagacaatgaaaccattgagttgagacaaccatcattctaatgagttgaagagacacagatcagagttcagagagaatgagatggctggaattcaaggagaagagtaccagagaagaaggttacctgagaaattgctctagaaatcttagtagtggtccctttgagtatttggatgaatactaaactgcatgggcattgggtgagaatcagaacaccatcaagagaagaacaactaccgagattgttgtaagctgaaaaattctacaggtcacacagggctgagagaagtctgaattctattcaaagtggaaagatctcaaacatccaaggctttggactaagctttagttgtacaactaaacaaggactagaataaaggctacactatatctaccattgcaatatttaaaaacaagctttgagtctgccttgaaagaactgtatagcagataaatagaagcgctggctacagtgctgacagaaaccttgtctttcaagccagacaaactggaaaaaggcaggagagggtaggaaagtcatggagagaagaaaagttctctatgaaccaatacaagactcatccctgtgcaaagcatatgacagacccaaaccagaaaagtaaaagctttgagaatcgaactcaaatctcagactagcccctgagtggcatatacacaggacaaacccaaaaaaaaagcaaggcaaagcttttgaaaactgaactgatattgaaaccactacatatagaaagcaggccaaaacttgtggtctgaccctaataaaggttgattgcctgctaaacaaacaaaataaatcagccttctccaagaaatataacacagctcagagtctaccaacataactttcacaaaatcaggaatacaatccagaaattacttggcatacaaaaaatcaaaaaactatgaatttcaagagaaacaacaataaacagataaaaacaaatctctactaatcagatgttggaattaccatggaaagagtttaaagcagctattaatattataactatgcttcaggaggtaaagataaaggtaaagtagccaggcacagtggctcacgcctgtaatcccaacattttgagaagccaaggcgggtgggatcacttgaggccaagagttagagaccagcctggccaacgtggtgaaaccccatcttaaaaatacaaaaattagctgggtgtggtggtgcatgcctgtaattccagctactcaggaggctgaggcaggagaatcccttgaacccgggagacggaggttgcagtgagcccagatcgcaccactgcacttcagcctaagtgacagagtgagactgtgagactctatctcaaaaaaaaaaaaaagaaagaaagaaaacaaaaaagaaaaggtaaagaaaaatgaaatgaatggaaagacagaatagaagtattcaatggagaaaactgagaagtaaaaaatctattaagaaattatttaagaagtaaaaacctattaagcctagatgggcacattagcagaatggagatgacagaaaaaataatcaatgaatataaaaataaatcaatataaattatttaacctgaaaaacaaagaaagaggtaagattgaaaaaaatgaataatctaatggaaatatgggacagtatccaaaagtctaacatacatgtcactggagttccaaaaaggagagtagaggccgggcgcagtggctcacgcctgtaatcccaacactttgggaggccaaggtgggcagatcacttgatgtaaggagtttgagaccagcctggccaacatagtgaaaccccatctctattaaaaattaaaaaaataaaataaaaacttagctgggcgtggcagcacacacctgtaatcccagctactcagaaggctgaggcaggagaatcgtctgaacctgggaggcagaggttgcagtgagccaagattgtgccactgcactccagcttgggtgacagagtgaaactccgtcttgaaaaaaaaaaaaaaaaaaagaacaaaaaggagagtagaaagagactgaggcagaaaaatatttgactgactagacaaatttgttgaaatatataaattacttctaatatagcctcaccataaactcacacgtcatacaagctaacagaagagctgtcccccaaacaaatacatttcactaatgatgcagagctcaaatagcacaaaagaagtaattcatcctctggataaatgatttccaaacagttgattacatactcctactggcaaaaaattaagtagtcagatcacagatatattaacgtataaattatatatgggttactgaatactaatctgttatttaatctaatatgttatatatgttactaatctttattaagttattttttaaaagaaattagaggacagagaaagatggccaaatacaagccttcaccgatcatcgccgcgacagaaacaacaaatttaacaaccatgtccacaaaaaagcaccttcataaaaaccaaaaataaggtgagcaatcacttcgtatcacagaaaggggcactgaagaaggtaagcaagacagtcttgaattgctattccccccaaaagcagctgtgtgtcatggagcacctacgcgcctgggagtgggagagtgcagcgactgtgggatcctgcattgaacagtgctgccctgtcacagcggaaagcagaacaagactaaaattagccaacgtccacctacagagagagtattaagaccagccctagccagaagagaactgcacatcccagtggctggaaacagtattgacaagcctcaccaccgtggcttaaagtgcttggggcctctaaataaacttgaagggcagtctaggccacaaggactgaaattcctaggcaagtcctagcactgtgctctgagtccactggctctgaacatgaggggcatgtgacctggtaagaccccagctggggcagctaaggaagtacttgcgccactcctctccaacccctggcagcgcagcttgcaacaacaaaagtgactccttccatcagcttgaggagaggagagtgaaaagttaaaaggactttgtcttgcatcttggatactagctcagccacaatcgaataggaaaccaggcagtcatgaggaccccattccaggtcccagctcagtcatgaggaccccattccaggtcgtagctcgggcaacatatatacacacacgctgggccagaagggaacccgctgccttgaagggaatgacccaatcctggcaggattgattacttgctgactaaagagcccttggaccctgcagaaccagaagcaacatccaagtagtaagccatgggccttgggtgagactctgaaacgtgccggcttcaggaatcacctcggacacagtggtgtaaagcaccaaaagggctcctgagatccccgattctaggctttggctcttggacagcatttctggacatgccctgggccagaagagagcctgctgcccaaaagggtgagtcccaggcctggaagcattcaccacaagctaactgaagagtccttgggccttaagcgaacattggcagtaacctggcagtattccccatgggtctgtggtggtggtggctagtgggagatgctcctctacctatgtaaacaggagggaagagtgggaaagactttgagcaacatcttagccacagaatagagcaccagtcagatttctaagagtttttattccactccttggctcctggatggcctctctagacctgccaagggcctcaggaaacacgctaccctgaagggaaggacataagccttactggcttcgccaactgctgatggtagagccctagggccttgagtgaatatagagagtagccaggtagtggttatagcaggccttgggtgagacccagtgctgtgctggcttcagatctgacccagcacagtcccaatggtggtggccacataggtgcttgtgtctccctacacccagctccaggtggttcagcacagagagagagagagcaacataccatttgtttgggacaaagtaatggaagaaaacaagagtctccacctggtaaccaacagaattcttccagatcttatccaagaccaccaaggcagtacctctatgagtctacaagaaccaaagcattatgggcttgggatgccccctaatccagatacagcttagatcacaatagccagtcccttcaaatacctggaaagccttcccaagacagatgggcacaaataagcccagactgtgaagactataataacagtccagacactgacaaacatccacaagcatcaacacttcctaggaaaacatgacctcaccaaaaaactacataaagaaccagagaccaatcctggagaaacagagatatgtggccttttaggcacagaattcaaaatagctattttgaggaaactcaaagaaattgaagataacacaaagaaggaattcagaattctatcggataaatttaacaaaaaagatgaaatattaaaaaagaatcaagcagaaatttgagaattgaaaaatgaaactgatatattaaagaatgcatcagagtctcttaacagaattgatcaaacagaagaaagaattagtaagcttgaagacagcctatttgaaaatacacacttagaggagacaaaaacaaagaaaagaatacaaaagaatgaagcatgcctacaagatctagaaaacagcctcaaaaggacaaatctgagagttattgtccttaaagaggaagtggagaaagaaataggggtagaaagtctattcaaagggataataacagagaactttgcaaacctagagaaagatatcaatactcaagtacaagaaggatacagaacaccaagcagatttaacccaaagactacctcaaggcatttaataatcaaactcccaaagatcaataataaggaaaggatcctaaaaggggcaggagaaaagaaacaaataacgtacaatggagctccaatacatccggcagctgacttttcagtggaaaccttaaagccacatgagagtggcatgaatatatttaaggtgcagacggaaaaaaactcttaccctagaatattatatccagtgaaaatatccttcaaacatgaagaagaaattaagacttccaagacaaacaaaagctgaggtgtttcatcaccatacctgtcctacaagaaatgctaaaggaagttagttcctcaatcaaaaagaaacagatgttagtaagcaacaagaaaagaaatcatctgaaagtacaaaattaattggcaacagtaagcatacagaaaaacacaataacaccataacttgggcatataaattactcttaagtagaatgactaaaagatgaacacagacactacaataaaatataaacagaaacaacaaaaagttaaaaagcagggagataaaggtaaagtgtagagcttttattagttttctttttgcttctttgtttaagcaatcagtgttaaactgtcaccagtttaaaataataagttataagatagtatttgcaagcttcatggtaacctcaaatcagaaaacatacaacctaccaatattgaaccaggaagaaatccaaagtctaaacagaccaataacaagtaatgagattgaagccataataaagtgtctcacagtaaagaaaagtccaggacctgatggctttactgctggattctaacaaacatttgaagaactaataccaatcctactcaaattattccgaaaaataggggagggaatacttccaaactcattcaacatggccagtattaccctgataccaaaagagacaaagacatatcaaaaaaaggaaaactgtacaccactatctctgatgaatattcacatgaaaatcctcaacaaaatactataatagcaagctgaatttaacaacacatgaaaaagatcatttatcatgaccaagtgagatttatcccagggatgcaaagatggttcaacatatgcaaatcaatcaatatgatacatcatattaacagaatggagaacaaaaacaacaagatcatttcaactgatgctgaaaaagcatttgacaaaattcaatgtctcaccgtgacaaaaaaaaccctcaaaaaactagggagagaagaggcatacctcaacataataaaagccatatatgacaaccacagatagtatcatactgatgggggaaaaactgaaagtctttcctctagatctggaacacaacaaagatgcccactatcaccactgttattaaacatagtactggaagccatagctagagcaatcagacaagagaaagaaataaagagtggtggcacttgcctgtggtcccagctgcccaggggagagggggctgaggcaggagaatcgcttgaacctgggaggcggaggttgcagtgagacgagatcacgccactgcacttgggtgacagagtgaaattcggagagaaaaggaaggggaaggggaaggggaatccaaattggaaaggaagaagttaaatttcccttgtttgcatatgatatgatcttatatttggaaaaacctagagagtccaccaaaaaactattagaagtgattaattcagtaaagttgtagaatacaaaatcaacatttgaatatcagtagcatttctatatgccaacagcaaacaatctgaacatgaaatgaaaaaaagtaatcctatttaaaatagctacaaataaatacctaggaattaaccaaagaattaaaagatctctacaatgaaaacaataaaatactggtgaaaaaaagtgaagaggacaccaaaaaatggaaagatattccatgttcacggattgcaagaatcaatactgttaaaatgtccatagtacccaaagcaatctacagattcaatgcaatccctatcaaaatactaatgacattcttcagagaaattaaaaaaaaaaaaaacattagctcggcgcagtggctcacgcctgtaatcccagcactttgggaggccgcggtgggcagatcacaaggtccgaagttcgagaccagcctggccaacatagtgaaaccttgtctctactaaaaatacaaaaaattagccaggtgtgctggcatgcacctgtagtcccagctactctggaggctgaggtgggagaatcgcctgaacctgggaagtggaggttgtggtgagctgagatcacaccattgcactccagcctcggcgacggagtgagactgtctcaaaaaaaaaaaaaaaaaaaattataaaatttatatggaaccacaaaagacccagaatagccaaagctatcctgagcaaaagaacaaaactggaagaatcacactatctgacttcaatttataccacacagctatagtaaccaaaacagcatggtactagcacaaaaacagacacacagaccagaagaacagaacagacaactcagaaacaaatccatacaactacagtgaactcaattccaacaaaggtgccaagaacacacattgggggccggacacggtggctcacacctgtaatcccagcactttgggaggccgaggcaggtggatcacgaggtcaggagatcaagaccatcctggctaacacggcgaaaccctgtgtctactaaaaatacaaaaaattagccgggcgtggtggtggcgggtgcctgtagtcccagctacttgggaggctgaggcaggagaacggtgtgaacccgggaggcggaggttgcagggagctgagatcatgccactgcactccagccagggagacagagcaagactccatctcaaaaaaaaaaaaaaaaaagtaacctgtttcatagtttaataaataatgttttctgtttcttagttgtacaaaaaatgatgcatcttacaatagcatcttatggagtcaatgaaaaataataaatgtacaggccaaaacacatcaagttttcttcatccaactaactagaaaaatagaagacccaccatacacactagattaaggctacttagagatgagagacagtagtatgatcgatctggtcttcaagtaattgggacttcagttattaattgttccttaagtctcattctataataaatgtgcttaattataattttaaaagtacttacgtacattgtgaggaaatcaatatatagctattaaaatatgtaatgttttaaatgggctttaaagcttcaaaaactaaaatgccccttgaaaactaggtttagagggaactaaaaactactaaattatttaataggtgatcatccaaaataaaatgtgtaacaaaaggaaacaatgtaaggttacagtaaatatgggatttaaatacagtaagaagacaattcaactgtcagtaaactccctgtaatgctaggaaaatgaatgctaggattatcagagattttttaattttgtttcatttgtatttgccaaaaaaaaaaaaaacacccatagaataaaaaataccagtttctcttgtaatttgcattttttaccaccacatttccccttctggaaggaattaaaggaagattactaagatgggtcaagtaacaacagaggacaacaagtaaacaaagaagccacagaatgtagggcaatgcttatcagtttaaccaagtgaatcaggagactatgaatgtaatggaacaaatttagccataaattcactgagctgggacaaccatctgaaaacctacactgtgatctatggatttacacaaaaggtgcagaactggaaagtgggagaagaaaactgtataccaaattatttcctaggaattatccagtctgatgatttttccactttaaaactttctgatcacctgagcccaggaggtcaaggttgcagtaagcagtgactgtgccactgtactccagcctgggcaacagagcaagaccctgtctcaaagaaaaaaacaaaaagaaaaagaaaaaacaacattataaaactcaaatatttctaccacaaaattaaataagagattagaaaagtgaagtttttagccaggtgcagtggctcatacctgtagtcccagcatttgggaggctgaggcaagcggaacacttgaagccagaagttcaagactggcctgggcaacatggcaaaaaccatctctacaaaaaatcaaaaattagccaggtatgatggaacatgcctgtagtcccagttactgaggaagttgaggcagaaggaatgcttgaccccaggaggttgaggctgcagtgagctgtgttcatgccactgcaagccagcctgggtgatgaagcaagcactcttttttttttttttttttttttgagatggagtctcgctctgtcacctaggctgtagtgcagtggcacgatctcagctcactgcaacctctgcctctgggttcaagtgattctcctgcctcagcctcccgagtagctgggattacaggtgcccgccaccatacctggctaactttttgtattttttagtagataaagggtttcaccatgttggccaggctggtctcgaactcctgtcctcaggtgatccgcctgcctcagcctcccaaactgctgggattacaggtgtgagccaccacgccaggctggcgagtactccgtcttaaaaaaaaaaaaaaactacaatggctgataaggtaagaattagagaccagttaccatctgaactctcaagatacttacatgtaaaagaagagttgtatggtcatactcacctttctaccagaaatacttctgggatgtttttattcatgtatgcattcatttattcatttatttaacaaatatttattcagttcctatgatgccaggctgtttccaacctctgaaggcacttgattcaagccacaagcccaatttcctctactgcccacccccaactccaacagctcaagggcagttagttcaaatctttctgaataagaagataagggtagtaaaccacaaagaaccacactacggcctgccaataaaactagctaatttcattcaacctgttaaaatccaatcagaaagaaaaataaaccaaacataagaaaatttttgcgatctacagaactttagggctgggcgcagtggcccacgcctgtaatcccagcactttgggaggccaaggcgggcggatcacctgaggtcaggagttcgagaccagcctcaacatggagaaaccccatctctactaaaaatacaaaattagccgggcatggtggtgcatgcctgtaattccagctactctggaggctgagacaggagaattgcttgaacccggaaggcggaggttgtggtgagtggagattgcgccattgcactccagcctgggcaacaagagcgaaagtccgtctcaaaaaaaaaaagaactttaggatttgatagcatatctaatattccaaaataaatacatataatttcttaattgacatgccatctgtcaataaaagatttaaaaggtaatctgctacaagtcttcattcttatcactaacctttcttcatgtgctaacatgtacatttccttctttactgtgccttgactttccaaataaatttgtgtgtgtgtctgtaacagaatgagagacagacaaacagagacgcatttgggttttattataacgtattcacaccttaaggaaggagaaaggctgaggtagcaaaggaaaggaaaaaagtaaatggaattataaaagtgatggcttaaaaaaaacatacatatcacaaaactgttcttcctagcagcaattctctaacactcaaatttgtctatctagctatctaactcttaagaaagtaattaagcatttttaaataagtcttaaaaagcacggtggctcatgcccgtaatcccagtactttgggaggccaaggcgggtggatcacctaaggtagggagttcaagaccagcctggccaacatggcgaaaccccgtctctactaaaaatacaaaaaattaaccaggcatggtgacaggcgcctgtaatcccagctactcgagaagctgaggcaggagaatcacttgaacctgggggtggaggttgcagtgagccaagatcgcatcactgcactccagcctgggtgacagagctagactccatctcaaaaaaaaaaaaaaagcttatattttaaattaaaaaataaaacaaaagctcatgttcccttctaaaataagacctatgagaaaagttccaccatggaactagtaaaatcaaaataactattttatgttagttcagtctatgtaaattgtactgtaaagtttttgtatttagcattttagccaagataaaaatttaataaatacaggttgaaatctagaattgcacttttttttaatatatagtttttttttttttaattgagatggagtctcgctctattgcccaggctggagtgcagtggcaccatctcggctcactgcaagttccgcctcccgggttcacgccgttctcctgcctcagcctcccgagtagccaggactacaggcacccaccaccacacccagctaattttttatatttttattagagacgggatttcatcgtgttagccaggatagtcttgatctcctgacctcgtgatccgcccgcctcggcctcccaaagtgctgggattacaggcgtgagccaccgcgcccagttgaattgcacgtttttaatggtcatatttttatatcatgttgttaggaggaaaaaataaaatacctaagaatgatagttaaaaatccaaatgattctttactatcctactactctaattttaaatcaacattaaatttttcccagtatatttaatacatattataactaaaacattttaaatgtataaaagtgctttttttttggtagagatgggggtctcactttgttgaccaggctggtcttgaactccttaaaagtacattttttacagtcacacaggcaaattcacctaaataatttacaatgtagaattgaacatagtctgttaagggtgctttcaggtcatcagaatctgaaaattatacattaaaatagcagtccccaacctttatggcactagggaccagtttcacaaaagacaatttttccacagaacgggggtcagaggtgggtggatggtttcaagatgaaactgttccacctcagcgggagatgaacggcaggcaagcgagcattaccacctgagcttcacctcctgtcagatcagtggtagcattagattctcataggagcacaaaggagggatctgggttgcttgctccttatgagaatatgtacatagacctgaggtacatagacctgaggtactacagacttggtcaacttttggcctccttcttaaccatcagaggatgctaaaacatggtctgaaacagaatgtagacaaatctgacaaaatctgtcaatctggtaagatggttaaaataaagggaaggaagtagactgctatcccaactgtttccaaaccaatcactgaaatctccaatacacaaatcaaagccatcatgctaatttttgtcattccataaagggtagcaaacgtaccataaaaacaaaacagagatctactcatgttgtggtgactgaaaacaaagattttacaggcctttttacttgacacaggatgccaaggaagcttctaactgcagaagaacagaatacagatcccaaggaaaagcaacagcccaaggggcaaggaagtgagggggaaggcagtaaagaaaatgatactcgtgcgataggtgaaaggagagaaagggaatctgtggaaacttccaccttctgctaaagaacagaaaaaaatcataggatattccattcgaccaacaatataccctctggggccagggagtagagaagctagctgaaaacagcctcattagagtcaaaatttgacatgtctcaggcaaaatcattcttaaagttttgttccatatcaagttttcatgtcttcagatttacataagaagggttttcctcatctataaccaattaattggcatttccagctagaaataagaacttaaattacacagtggtcccaatgattaaaagctcccaggattgtaaacagactttgatttgcaattaagaatattttactcctactccagtaatgacaagagcaaaacaaaaatacatcaagtctttctcaaagccaatacagtaagtactgaagaaattgtgctaatgccttaaaggttactgaaaataaggtacttacagaagtatgcatataaatctctactagaaaggataaaagtgccagtcagcaagttcattcaggccagatgtggtggctcacctgtaatcccagcactttgggggactgaggcgggcagaccacttagtccagtcaggagctcgaaaacagctgggccaacatggcaaaaccccgtctctactaaaaacacaaaaattagccaggcatggtggcaggcacctgtaatcccagctactctgcaggctgagacaggagaatcgcttgaacctgggagacagaggtggcagtgagctgagatcgcaccactgcactccagcctgggcgacagagtgagtctctgtatccaaaaaaaaaaacaggccaggcgcggtggctcacacctgtaatcccagcactgtgagaggccgaggcaggcagatcacctgaggtcaggagctcgagaccagcctggccaacatggggaaaccctgtctctactaaaaatacaaaaaattgccgggtgtcctggtgagcggctgtaataccagctacccaggaggctgaggcaggagaatcgcttgaacccaggaggcagaggttgcagttagcagagatcacacaacttcactacagcctgggtgacagagcaagactccgtctcaaaaaaaaaaaaaaaaaagtgcattcgccttattgaaaactcttcttataatatcaaacccaaatcagcatccatcatcatagattattagacttctatctcaaatacacaagaaaaaaataataaagtcaaaccctatgtataaacccatggtgacctcaggcaattttaaatccaaaattattcaaaattatttgaagggataaagaatcaaattgccagcaccctcaaaatagaacagtacaggacacactggatcccattattgagcatggtactactacattcaacacaccatggatattatttcatcaatttcatataaactttggcagcagactttaagttcctagaaaattgttccccaaagttttgtaaccttaattaaagtataataattccaagaaacaaatcacagagaggcaaagaaaacaaacatatagaggccatgatgtcattagttaaaatgacatatgaaaaaatgcaagaatgttgataatgattaaagctggctgatgagttcataggttttcttttcgcttttgtgtatgtctaaaattttctatgagaaacagaatatcaaattttttttttttgagacacagtctcgctctgtcaccaggctggagtgcagtggtgcaatctcggctcactgcaacctctgtctcccgggttcaagctattctcttgcctcagtctcccgagtagctggaactacagctgcgtaccaccatgcccagctaatttttgtattttcagtagagacagggttttcccatgttggccaggatggtctcgatctcttgaccttgtgatccacccacctgggcctcccaaagtgctgggattacaggtgtgaaccaccgtgcccagccatcagattttatgaacagtatatcaaactcaccaaaatgagtttttattggctgtttataaattgggggtgggggggacacggtaattatcattaattaagtgcctataaagtgtttgtttttttgttgttgtttttttgttttgagacagagtctcactctgtcacccaggctggagtacaatggcacaatctgggatcactggaacctctgcctccagggtttaagcaattctcctgcctcagcctcccaagtagctaggactacaggcacgcaccaccaccccgcctcactaatttctgtattgttagtagagatggggtttcgccatgttggccaggctggtctcaaactcccgatctgaagtgatccacccaccacggcctcccaaagagctgaaattacaggtgcgagccacagcccccaagtaggtgttttaatatataagaactctgtggccaggcatggtggttcacacctgtaatcccagcactttgggaggccgaggcaggcagatcacgaggtcaggtgttcgagaccagcctggccaatatggtgaaacctcgactctactaaaaatacaaaaagtagccaggcatggtgacacacacctgtagtcccagctactcaggaggctgaggtgagagaatcgcttgaacccggaaggcacaggctgcagtgagccgagatcacgccactgcactccagcccgggcgacagagcgagactccatctcaaaaaaaagaactctatgagatagaatcagcccaattttacataaaagaaaattaagaatcaagagggtaaacttaatcttcctcaagatcatataggagctgaactgagacccacagccaaagaaagaaagaaggaaataaaaaaggaagacaatgactggtaaagggggtaaaaaaaaaaacctttttggcactaatatacaaaagaaacaatcagagaaataagccaggcatgcatggtggctcatgcctgtaatcacagaactttggaaggctaaggtgggataatggcttaaggccaggagttcgagaccagcctgggcaacatagcaagacccccatctctatgaaaaaaaatttttaattagaatttaattttttttaattagagaaatacaatttccagaaaatatcactaggtaaaatattcttatagaagtatgcaataacaaatattcaagcaaaatgaaagaaaaaatagaactgtatttagaaatctacactgtaagggtggatatcttgaggattagaatccagaggagaaatcccatttcagccatgatgttaaccagttgtgtgtgtgtatatatttacatatatatgtaaattcacatatacatatccatatcaaaacttccctaaacctgaatttaacatacaacttagaatagattaagaaaatgttctaaaaagtgtcattacatatttaacgtggtagtctatatttatcatccagaagaatttagcatataatcctcatatttgaagttcactgtacaaatacattactccaacactccagtgttaaggcaagcatctaaaagtaatattttgctgggtatcgtgactcatgcctgtaatcccagcactttaggagaccaaagtgggagaactgcttgaggccaggagtttcagaccagcctaggcaagacaacaaaaccccgtctctacaaaaaaaaacaaaacaaaagaattagccaggtgtggtggcatgtgcctatagtcccagctacttgggaggctgaggttggaggatcacttgagcccaggaggttgaggctacagtgaactgggatcacaccagtgtacttcagcctgggtgacagagcaagaccctatcacatggccaggcacagtagctcatgcctataatatcagcattttaggtggccgaggtgggcggatcacttgaggccaggagttgagaccagcctggccaacacggcaaaactctgtctattactaaaatacaaaaagtagctgggcatggtggtgcacacctgtaatcctagctactcaggaggctgagaggcacaagaatcacttgaaccagggaagcgctgaaccagggaggcgctgaacctcggacagggaggttgcactgagctgagattgtgccacagcattccaacctgagtgacaaagtgagactctgtctccaaaaaaaaaaaaaaaaagaagacgaagaagaaaaagaggaggaagaggaggatgaagaggaggaagaggaagcgtaagaagaagaaacaacaacacaattaaacaccactacaaacttactagaatgactaaaatttaaaacactgataataccaagtgctgacaaggatggagaacaactacagcaactacattactggtaggaatgcagcatgctacagccactttggaaaacagtttgacagttcttatgaagttaaacatacatttaccataccaagcacactcttcagtattcacccaggagaaaggaaaacatgtccaccaaaggcctataggcaaaggtttggggcaacttacccaaagtaactggataaacaaattgtaattacatccatagaatagaatacttctcagcaaaaattaaaaaagaaacaagcaacttaattatgcaacgacatagaggaatctcaaatgcaatttgctgagtacaagaagctagtcacgaaaggctacttgctacatgattccatttttattcaacattctggaaaacaaagtgacagggacagaaattagatcagtggttgccaggggatagggatggggaagagagaaatgactacaaaggggtaaaagggaactttttgaggtgggggaaatatctcatataccaaatgtgatggttgttatatgaccgtatacatcaatctacacaactcaaaagggtgaattttattctatgtaaatcataccttaataaacctgacttttaagatgacaaagatgtaatctctgccttcaagctcatgatctaatgagagaaatatatataaacacataatttgaacaaggtaaatgctatagtaagttatgaacaaagttctgtggtagaatggaggaggaataaagtctgtctcagagtgaggcaaaggattctcagagaaaataacatgtaagctatgtcttaaaagtaacaaggctgggcgcagtggctcatgcctgtaatcacagcactttgggaggccaaggcaggtacaatcactgaggtcaggagttcgagaccagcctagccaacatggcgaaacccagtctctactaaaaatacaaaaattagctggacacagtagcgtgcgcctgtaggcccagctactcgtgaggctgaggctagaaaatcgcttgaactcgggaggcaggggttgcagtgagccgagactacaccactgcactccagactgggcaacagagcgagactccgtctcaaaaaaaaaaaaaaggtaacgagcatgatgatgacagaccaagaagaaaaggacccaagcagagagaacagttgagagaaaaaacacagaggtatgtaaaggcaagattagccatgtgagagacagtaaacgaagtgtaggatgagttagagcatcagaggtcatgccatacatgataagatttgtgttttagaaagataagtataaatatcatgtgggaaaatatatggaggtatagaatgactggcagagaacaagaacagttttgaagggtgttacaataatcctagaaagagatacctggggtctgaattaaggttcaattaaaaggctatttagtgaaagactacttatgggaataaggaagaaaagacaagttaaggttaattgaaatttctgcaaagaacaagtgatcatcaataagatgagaaacataaaaggaaatacagatttgtttgataatccaagttggggggagaatcatctggcttccattttcctatctactaactctcttccttgtaggcatgccttctctaactaaaactgatatttattatgacttatctacttgaactattttataaaataactataagaagtaaaggcaacacagcaaaacctcagcaaagtttttacagtatcttagatatagcagaatagttattttaaaggtaaaaataaggccgggtgcagtggctcacacctataatccacgcactttgggaagccaaggcaggaggattgtttgagcccaggatatcaagaccctagcctgggcaacatagcaagactccatctctacaaaaaaataaaatttaaagaaattaaaaataagttttaaaaaagaaaacattgggcagtttggctagagcataattattagaacagataattagatttcctagtttttcaaaaatttgaattgtaataaaaggaaatttcaatgttctatttcaattttcagcagcaaataaatgtgtacaaaaaggaacttaaagaataaaaaataaatgaaaataggagaggaaagaataaatttaaatactgcatcgccaacttatgtaataggttccaaatttgtctttaaaaagcaattatgtgatggctaggcatagtaggctcacacctgtaaccccagcacgttgggaggccaaggcaggtggatcacctgaggtcaggagttcaagaccagcctgaccaacatgataaaacctcattgtattagtccattttcatgctattgataaagacatacaaaagactgggaagaaaaagaagtttaattggacttacagttccacatggctggggaggcctcaggatcatggagggaagcaaaaggcatttcttacatggtggtggcaagagaaaaagaggaagatgcaaaagcagaaacccctgataaaaccatcagatctcatgagacttattcactaccacgagaacagtatgggggaaactgcccccatgactcaaattatctcacaccgggtccctcccacaacacatgggaattatgggagtacaattcaagatgagatttgggtggggacacagagcaaaaccatatcacccatccctactaaaaatacaaaaattagcctggcgtggtggcaggcacctgtaatcccagatactcagtaggctaaggcaggagaattgcctgaacctgggaggcagaggttgcagtgagccgagatcataccactgcactccagcctgggcgacagagcaagactctgtctcaaaaaaaaaaaaaaaaaatcaattatgtgaaatttagaatatattgccccaaagaaacaatgtgacactaaagcatagctaaacaatactagggtattacaccaacctgctgaataaccaaccccaccaccatcaccaccaccaccaccactaccactaccactaccaaagtacagtgttgaggagaacagggtgctctgaggctgcctgaggttcaacatcttttgtgacctcgactggggtaattaattctacaagtctaatattcctcacctttaaaatggagatgataaaatcacctgctccacacgagttactgtgaaaattaaaagagggaacctaaagcacttagcacagtcatccatccaacatgtatttattaagcacctactacatgttaggtacaaggccccaaggccctggcaatgaaacagtaaacaaaaaaagtaagtccctacttttatggagtgtgtattctaataaaagaaaacacgcaataaaaaaaatctgatggagttaatgctatgaaaataaagcaggatataagagataaagagtaacaaggagaaggatactattttggtagtggggaaaggttctctaataaggccacaaattttaacaaagaccataagagaatgaagaagagggtcatacagagaactgggggaagaaatcagatccatttctggcaatatggtagactagatgcccagaaaagtacttgtgattcagaatttcttaaaatgctgaatattaaaacaaaaatagtatttttcatgagtggctgagctgaaagaaagaaaaaacaacaaagcattggtgagcactgaaaccagcctctcccctgggagcatccatcaattccccagtggcttagaagtcagtttaagggactggtgagaaggacataaaggttggggcctaaacaaggtgggaaatctgaaaagcaacactcagtggatgaactgcagaggagggtaaacaacatgctaaacagagatcacagttggcatgtttgcctttcccagtctcggtggaagagaaaaaacgaagtcacccttcgctcactccagtttaaggacaaaattcatactacctatgtggtctagaaaaactcagactaaaaattcagtttcgagagattctgggttggaagagactagagcatgacagaagcaaacaccaatccagccaagaggagtacactaaacccaagccttcagtgatattcacaaataaaaatccatggaagattatctcacaattaaaaagaaattcacaaaataatgaaaaaagcccccaagaatcagcagaacaagcctttcaggaacagaagaaacgatgaggaacatgaaaataatcagatatataatataaaaatgttaatgtttaaggaaataaaagagatatagaaagtatgactgaggaaaagaaactgtaaaaaacatgaatatgaaaaaatcaaacaattgtaatgtttctggatagaaacattacaattgcttattgatagtcatacaataattggatatttgagaggagatcattctaggcaaaggaaaaaataagttcaaaggccctaaggtaagactgtgcttggcttgctttaggaagtacaaaagggccatggcatccagagttgagtaaacaaggaagaaaagtgggaagaaatgacgaccaagaactggtacttaataggtcacaaaatacctcaataaatattatttattatcccataatttctattggaaaaatttggatattagaaataataatttcttctttaccatttctgcattaaatatagaagccagagcagagctacagaggatctcaagtaggttcagaaggaaataagaaaatattccttttctatgaagtagggagagtcttcagtagaggtcccagtgccaaggaagacatctgggtcttgtgtgagcaaggtagaaatgaagtgattcagaagatacatttctggaaataataatgatcaacaacaaccaaaaaaaaaaaaaaaaagtcaagatggaattaccatttcaaagtaggagacatttcaaacttgggcattaattggtaatcaggacatcctcagagtactcaaaaatttcacggttcaagtgaacgtttacatcctatgacaatgagaatttagcataaatgaaactcccaaagatatgccaaactttttaactatctggtttaattctcaactttttctaaatattttcaaaagacactaacaagtagcaaaatagtactactctgatttttcttttcttccatattcctaccctcagactaaggtattgcctaaaaaagccatgaacaaaacacaagtaatacaggttaagaataatattcataagccacaactagaggtataatcaatccctaaatattaaagagttggtcattccattttttcctgattagcaaaataacagaaaattgactggtggatatcttaaatacatataaactaccatgcaccatttgacacatgaagaaatagatgcaaagaatcaaagtatgcattgttaaatcaatgataaaagttttaaaataattcattttctcaaagcttatcactcttaacaatgtttctaattatcataacctaatacaattcctgacaaatttaatcaaattaggttctaatacaagaacacaacttatattaataatcacacagtataacatggtacacacaaaattcaaaatcaaacaacctgagtccaaatgccatcttactaactatgacacttgagcatcattgaccactccaatcctgttttcatgctataaatcaagtttaataaagtactgccccatggagttgttacatggaaaaaataaaataatcccgtaaaacacttatgtttatcagcagactcagatatacaccctgacttacatctaggttccattctattataactggatcataaagcaaagcattaatttctttttttatttttattttattttaatttaagttcaggatacatgtggcattaatttcagtctttccttctgaagcaccacttaaataacttgacgtgactgttctcacacagtgcattcagcactatagaataaagtcagtgtctaacaataaaaactagaaagatatttgtgcaatatgttatgctaaatgtagaacttggctaaattgaaaattttctgaaatactttatgtaaataaagaaacagagcagtccctacaaatagaaatgactcctgaaatttttatgtcaaaagtcattgtgtcaatttatgtgtaatattcaagtgactaccaaatggtcatcatttgactcactcaaactattgtgtttcaaaagttcatccccatgcagataaacatgttaaagatagtataattcactaaaaatagtcaagttctctattgatacaaatgggatttctatgcaggttacttgtattcaatctaaatgactaagaacttataaagacttaagacgatcctgcaagaaagatgcctaaggggaaaaaaaaagaattaagataaagtagtattttgctctaggttgtttattttaagtgtgtagcggttggggaaaaaaacatgactcctttatattatcctaaaacattctacaattctttttttttttaataatcctttttgagacagagtctctctctgtcgcccaggctggagtgcagtggcgcaatcttggcttactgcaacctccgtctcccgggttcaagcgattcccatgcctgagcctcccgagtagctgggattacaggcgcacaccaccacgcccagttaatttttgtatttttagtagagacagggtttcatcacgttggccaggctggtctccgactcctgacctcaagtgatccgcccacctcggcttcccaaagtgctaggattacaagcgtgagccactgcacctggccaaacagtctataattgtaaaagctatgaaaactcttttttttttcttttttaagagatagggtctcggccgggcacggtggctcatacctgtaatcccagcactttgggaggccaaggcaggtggatcacatgaggttgggagttcgggactggcctgaccaagatggagaaaccccgtctctactaaaaaaatacaaaattagccaggcttggtggtgcatgactgtaatcccagctacttgggaggctgaggcaggagaatcgtttgaacccagggggcggaggttgcagtgagccgagatcacgccactgcactccagcctgggtaacgagaacgaaactccgtctcaaaaaaaaaaaaaaaagagagatagggtctcattctgtcgcccaggatagagtacagtggcataatcatagttcgctacagtctcaaactcctgggctcacgtgatcctgccacctcaccatctccagtgggtaggactacaggcacacactaccacgtagacctgatttttttgtttttttgtagatataggatctcactatgttgccctgggtggtcttgaactcctggcctcaagcagtcctcccacctgagcctcccaaagtgtcgggactataggcatgagcaaccgcacccggcaggaaaattcacttaattactaaaattttaaaacaccacctccacacataaaatcccccatgaataaatctatattttgttttggtaatacaaggttgctttctaagataacaattgctcatctgcctgtatgtataaatacatgtaagcatttgggaaagaagaaaaatgactaattttatcttcctacaatttcttcagtgatctacactagaactccattatctgaaattatctaaggtattcctaagcagaaaaataagttggtcaattgtagcctaagttggtcctatatttattcaatggctatcacacattcatcacttcgttataccttagacttccagcagataatgaatataacctttaaatccatcactttacaaatgcctacaaatattaggtaaatataacaaaaaatacttttcaatgtagaactgagcttgagtttgcaaagaaagaaagaaaggaaaatccccgagcctaaagtgaagaagaaacagaaaaataagtatctgaacttccattacaactgctgaagaggcaagaaagaggaagctagtactagggggcttgaattttatttcctttttagaaacaaacaaaaaaaaagtattcactcaagatggggaagtagagataaaatctctatataaatatgggatcctcaaaaggttgaccctcaggaaaaagtagattcttcctctcccccacaaaaaaacttccctggcacaggaaattacaaataattagtctttggctgggctgctgatttcctttttttttttaattctatagagataaggtctatgttgcccaggctggtcttgaactcctgggctcaaatgatcttcctgcctctgtctcccaaagtcctgggattacatgcatgagccaccgtgcctggtcactactgattatttttaagtttcctctaagatagtaaaattctgggatttcctctaagatagtaaaattctgctattcacataggaagtccaaatttacactactggcatgaacaacaaaccccagaatgacaaatttaaaaaacaaaacaaaaaaaaaaacaatttcaggtataatataccccctgaggctccaggcaaacttaatccatacgttctggtaataaacatttcctaagcacatactatgtgtcaagtactcttctaggggctagggatgcaataagcaaaacagacaaaaatctctactcttatgaaacataaacagtagtccctcttgatctacagggtatacattgcaagacccctagtggatacctaaaaccacagataataccaaatgctatatacactatgtttttttgtatacacacatacctatgataaagtttaatttataaattaggcacagtaagagattaacaacaataactagtaataaaatagaacagttagaacaatacacagtttccaatttttgacagtttgacttacaatttttcaactttatgatggtgtgaaagcaataagcattcagcacaaacctcaatttaacaatggagttacatcccaataaactcattgtaagttgaaaagtcaaaactaccataaatcaacaagtattttcaacttacaatattttcagctttagatgtaagtgcatcaagtcaaggagcatctgtgtaattcacaattacatggatagaagattcgtacatactgcaaaccttagcaacctcagcacatgattttttttccttgtaagtcaagaacttccacctattcacttaaaaaaagtgctttacaatgtctctgtgtcacatccaaattgccaacatcactactcttgtcccgaacattattaagtaaaataagggttacttaaacactgcaataccatgacagtcaatctgatcgtggagagggtagtcacttagtaaagtgactaaaggacaggtagcatatacgtagagcatggatacgctggacaaagggatgatttgcatcctagtcaggatggagcagaatgcttgagatttcatcacactactcaagagctgcacacaatttaaaacttaggaactgtcaagggcttcaagatggctgactagaggcatctcctacttgcctcctccactaggaataaccaaaatagtgagtaatcacaccttgaatagataatccaagaaagaacactggaattcaatagaaaaatgacaagaaacacctaaagaaaggaaggagagggaaacaagacagcctgctcggctgggagccgagagacaatccccactgcggggaaacagtaagtgggagactccctgtggtccacattcccactgtggactcctgcaattctagccattggggagcccctaggacctcatgggctctgaaactaacataaggatctgtctggaaatggtgcaacagcaccactccactgaggaaaattgcactgggtcccataatccccctaagtcctaagcagctacaacaaggcaccattttgacaacccagcccacaacagactgagcactatcctggggcccagcagctggtgcacagacagaagtaagaaacaggctgccaccaccaggactgaggcacaagcggggcatgtgtccccgaccgccgacctaggctgccaccattaaaggcagcctcatgttccccagtagcagcagcacagcacagccactgctgcccctcacccaatcattccagggcctgggaaccaccctgtcccttcttaccacagtaggtgtctgcacatattgttggggggcctgatgacatgccagcccagcttaaccaggtccccatgccaaagcgtgcagactaggggcctggggattgtctccctcagcccactaccattggcacctgaacacaacacctatcctgaggatagggctaccccccacctgccgctaccaccacagctggcatctacctgcatgaacaacctgcaaatctagagactggcaggcctagaccatcacacccaccgccaatatacacacacaccactcaggatccagtgggtcatctctgcctttacccatactatgctggctacccagaagactgagagtgcacccacccacacagcctatcactgccactaccagaatcacagcaatccatctggaagcccaggaattggttcacctcaacccactgatactggtgccagtgtatgctgccctagagcccaaggacaggcattctcagcccactgctgtcaccactgaggcctgaaaagtgccaaacatggcacctcagtccccagcaaaacttcaccacagcctccattaatagtccgaaccctaaggcccccaaaaaatcacagacgccactgacactgtttatacctgaaaaaaaatcacagagactatactaccacacagacccagaatcaaagccaatgcactctgcccaaccaacatcatagatacgtcttcaaataaaaagtcctcccctatgaaagcaagttcaaataatttgaaaaagtcattactacaccagaggaaagatatcaatgtaacgacagaggaaacataaaacagcaaaaaaaaaaaaaaaaaaaaaaaaagggcacctccaaaggaacataataattctccagcaacatatcccaatcaaaaacaaatttacaggccaggcacggtagctcatgcctgtaatcccagcactttggaaggctgaggcagatggatcacctgaggtcaggagttcgagaccagaccggccaaaatgatgaaaccccccccactaaaaatacaaaaattagctgtgtgtggtggtgggtgcctgtaatcccagctacttgggaggctgaggcaggagaatcacttgaactcaggaggcagaggttgcagtgagctgagactgtgccatcacactccagcctgggcaacaagagtgaaactccatctctcagaaaaaaaaaaaaaaaagaataaataagctcagtgagagacacaagagaataatgaaaactactacaaaggaatcagaaaaataattcagaatatgaataacaagtttaccaaagagatagatgatattaaaaaaaaaaatctggtactgaagaattaaatggccagatgcagtggctcaagtctataatcccagcactttgggaggctgaggtgggaggattacttgagtccaagagttcgaagccagcctgggcaacatggtggctgggcaacatggcaactacccccaaaaaattagctgggtgtagtggcacctgcctgtggtcccagctactcaggaggctgagatgagaggatagtttgagcccaggaggtggaggttgcagtgaaccgagatcgcactactgcactccagcctgggcaatagagcaagaccttgtctcaaaaaaaaatatgtgtgtgtgtatgtgtttgcgtgtgtgtgtgtgtgtgtgtgtgtgtgtaccaacatcatttttcacagaaatagaaaaaaacaatcctggtcaggcacagtggctcacacctgtaatcccagcactttgggaggccaagatggacagatcactttagttaaggagttcagatcagcctagccaacatggtgaaaccccatttccactaaaaacacaaaaaaattagtcaggcatggtggcgcacacctgtaataccagctacttgggaggctgaggcagaaggatcgcttgaacctgggaggcgaaggttacagtgagccaaaatcaagccacttcactccagcctgggtgaaagcatgagattcggtttcaaaaaaaaaaaaaaaaacaaaatcctaaaactcatatggaaccaaaaaaaagccaatagtcaaaggaatcctgagcctaaagaacaaagctggaggtgtcacactacttgacaagatgtatatcacgtctatcataaaagaaaacagcatggtactggcctaaaaacagagcgcataaccagactgggcaacatagtgagacaatccccccagcccccgccccttctctgcaaacaaaattttaaaattagccagctgtgatggcatgtaccatagtcccagctactcaggaggctgaggtgggaggattgcttgagcccgggaggctggggttacagtgagctgtaatcatgccgctgcactctagcctgggcaacagagcaagaccctgtctcaaaacaaaaagaaaagaaaaaaccaacacatagacgaatggaacagaatagacagacaatccagaaatgaatatgtgtatctatagccaactgctgtgtgtgtgtgtgtgtgtgtgtgtgtgtgtgtgtgtgtgtgtgtgtgtgacagtctcatgctgccacccagactggagtgtggggtacagtgacacaatctcagctcaatgcaacctccacctcctgggttccacaaatctcctgcctcagcctctccagtagctgggattacaggcatacaccacgatgccaggccaatttttgtatggtttgttgatacagggtttcgccatgctgcccaactgggttcaagcaattctctgcccggcctcccaagtagctgagaatacaggtgcctgccaccatgcccggctaatttttgtatttttagtagagagggggtttcaccatcttggccacgctgttcttgaactcctgaactcatgatccaccagcttcagcctactattatactttggggccactattaggtacaaatatgggtcacttgaatataatcactgcaatactgccgcaatcaatctgataacggagacggcaactgactaacaggcaggtagcatatacatacagcatgatgctggacaaagggatgattcacatcctggtgggacagagagtgatttcatcacactactcagaacaacatgcaaattaaaacttactaatggtttatttctgaaattttacatttaatattctcagaccatggttaacggaaggtaatagaaactgggaaaagctaacatgtgactaaggcagggtactcttgtaatggacagaaactgacaaaaagcaaaatatattaagttacataatatattagaagataaatctgttaagaaataaggtaacggctgggcgcggtggctcacgcctgtaatcctagcactttgggaggccgaggcaggtggattgcctgagctcaggagttcaagaccagcctgggcaacacagtgaaaccccatctctactcaagtacaaaaaattagccaggcatggcggcatgagccttgtaatcccagctactcgggaggctgaaacaggagaatcacttgaacctgggagacaggggttggttgcaatgagccaagagcatgccattgcactccagcctgggcgacagagcgagacttcgactcaaaaaagaaagaaagaaggtagggaaaaaagataagaagtggaggagagggaaatagtcaagaaatagtcaagaaagatgttaaacttacacaaactaatctacacaggattcccacaaataaaatcccacaaaaatttagttcagaatccaagattataaaacaccctgtaatggccgggcacggtggctcacgcctgtaatccagcactttgggaggtcaaggtgggcggatcatgaggtcaagagttcaagaccagcctggccaacatagtgaaagcctgtctctactacaaatacaaaaaattagccaggggtggtggcaggcgcctgtaatcccagtgaggctgagacaggagaatcccttgaacccgggaggcggaggttgcagtgagccaagatcgcactattgcacttcagcccagacaacagtacaagactccaactcaaaaaaaaaaaaaaaaaaaaaaaaaaaccctgtatataccacattagatgagagctaatgaatgaatactagaaaactatacagagtagattataagagacttttgaaaataatgacactgttctttttttttttggagacagagtcttgctctgttacccaggctttttttttttttttttttggagacgtaatctcattctgtcacccaagctggagcacagtggtgcaatctcagctcacaccaacctccacctcccaggttcaagcaattctcctacctcagcctccctagtaactgggactacaggtgcccgccaccacgcctggctaattttgtattttttagtagagaacatgttggccaggctggtctccaactcccgacctcaggtgatcccacccacctcggcctcccaaagcactgggattacagacttacagacgtgagccaccatgcccggcaacactgttctcttaagggtaaaacagactaaagtaattcaaaattgtacaatgaaaaatacaaactgcctaacaaataacttcataggaaacaaaataataaaggaaatatgcatcaaggttttaacaatatatcttttgcggaaaagaataatagggcagggcatggtggctcacacctgtaatctcagcactgcaggaggccaaggcaggcggatcacctaaggtcaggagttcgggaccagcctggccaatatggcgaaaccccgtctctactaaaaatacaaaaattagcagggagtggtggtcagctactcgggaagctgaggcaggagaatcacttgaacccagaggcggaggctgccgtgagctgagatcacgccactacactgcagtatgggtgacagagggagactccgtctcaaaaaaataaaattaaataaaataaaaataaaagaataataggaactaggcttcctaaagattgtacttttattttaaaaattaagacatttccatttaacacttttgaagtatcaaaacacttcaaaaagttctggagatacaaagataaataaaataccttattgtacatctatataagtattataaaacaaaaatgcattgtggacatttctgtttcaaccatataaaaactattttaaaatattttcaagaatatgtgtgtgaaaagggatgctttataaaaagtgaatataatagattagttcaactaggtcagtatgagaaataaaaagcttacttagtttttctattaattcacaaacaggaaaaaaaaatctgattttccagttcccaaatgatttctcagtttaaaataaatcaattcaaaggtcaacaaaactgtatgcttgcaggaacctaaattatcaagtctgtcacttccaggaaactttgaagttttaaaatttcaccaattcacccaaatttcttgtaattatcattaatattaatatataaccaataatatctactcatgatagctagtaaaatcccagcttgcttttttacaaaaattgatacgctgatcctaaaattcacatggaaatgcaaagggcccagaatagccaaaactgtcttgaaaaggaagaataaagaggtcttccctattttaaaactcgccacaaatcttcagtaaacaaaaggcaatttggtactggtttaagaatagacacatagataaatggaaaagaattgagtccagataaatccttacatttatgctcaactgatttttgacaaaagtgccaaggtaattcaatgggaaaagaatagcctttcaacaaatggcactctagccgggtgcagtggctcacgcctgtaatcccagcaccttgggaggccgaggcggacggaccacaaggtcaggagatggagaccatcctggcaaacacagtgaaaccctgtctctactaaaaaatacaaaataaaactagccaggcctggtggcaggcacctatagtcccagctacttgggaggctgaggcaggagaatagtgtgaacccgggaggcggagctttcagtgagcggagatcgcgccactgcactccagcctgggcgacagagcgagactctgtctcaaaaaaaaaaaaacaaaaaaaaaaatggcactcttaacaattggatatccacatacaaaataatgaatgtaggccgggcgcggtgtctcacatctgtaatccctgcactttgagaggccgagataggcggatcacgaggtcaggagatcgagaccatcctggctaacacggtgaaaccacgtgtctactaaaaatacaaaaaattagccaggcgtggtggcgggcgcctgtagtcccagctccttgggaggctgaggcaggagaatggcatgaaccaaagaggcggagcttgcagtgagccgagatcgcaccactgcactccagcttgggccacagagcaagactccatctcaaaaaaaaaaaaaaaaagaatgtagacctttcccttacccttatctcacaccatacaaaaattgacttaaaatgaatcataggcctaaatttagcagctaaaactataaagtaatgaacacaggatgtaaatgctttaaaattagattgtggtaataggtgcaaaactctttaaatttactaaaaatcattgacttgtatacttaaaatgagaagtttttttcttttttttttttctttttgagacagagtttcattcttgttgcccaggctggagtgcagtggtgtgatttctgctcactacaacctccgcctcccgggttcaagcaattctcctgcctcagcctcccaagcagctgggattacaggcatgcgccaccacacctggctaatttttgtatttttagtagagaccaggtttatccatgttggtcaggctggtctcaaactccagacctcaggtgatccacctgcctcagcctctcaaagtgctgtgattacaggcatgagccaccgcacccagcctaaaattagtggtttttatggcatgtaaaatacagttgtcccttgctatactggggacattggttccaggactcctgcatagaccaaaatctgagcatactcagataagtcctgcaatggccctgtggaacccagtgatataaaaagtaagcccttagtatgcaacagtttcacatcccaggaatactgtattttcaattcgagtttggttgaaaaaaaaaatcaccatataaatggacccatgcagttcaaactcatgttattcaagagtcaactgcatatctcaatgaaggtttaaaaaagccacctctaggctgggcgcagtggctcacgcctgtaatccgagcactttgggaggctgaggcaggcggatcacgaggtcaggagttcaagaacagtctagccaacgtggtgaaacgccatctctaccaaaaatacaaaaattagccgggcttgctggtgcatccctgtaataccagttactcaggaggctgagatagaattgcttgaacccgggaggcggaggttgcagtgagccaagatcacgccactgcactccagcctgggtggcagagtgagactccatctcaaaaaaaaaaaaaaaaaaaatatatatatatatatatatatatatatatatatatataaaatggtatttttttttcttatacagacaaggtcttactatgttgcacaggctggtgttgaacttctgacctcaaacttctgacctcccacctcagcctcccaaactgctgggattataggcatgagccactgtgcccagctcaaattttcaaatatagagtacaactgtttatatagaatttacattctattaggtattctaagtaatctagagatgatttaaagtatatgggagaaagccgggcatggtggctcaaacttgtaatcccagcattttcaggaagccaaggcaggcagatcacttgaggccaggagtttgagaccagcctggccaacatggtgaaaccccgtctctactaaaaatacaataattagctgggtgtggtggcacacgcctgtaatcccagctactcaggaggctgaggcaggagaattgcttgaacccaggaagtggaggttacactgagccaagatcgcgccactgcactccagcctggtgagggagcaagactctgtctcaaaaaaaaaaaaaaaaactagcgggttttggtggcatacgcctctaagtcctagctactcaggagactgaggcaggagagcagcttaagcccaggaatttgaggctacagtgagctatgatcaagccactgtactcaagcctgggcaacagagcaaggcgcggtggctcacgcctgtaatcccagcactttgagaggccagggcgggtggatcacgaggtcaggagatccaggccatcctggctaacacggttaaaccctgtctctactaaaaatacaaaaaattagctgggcgtggtggcacgtgcctgtagtcccagctacttgggaggctgaggcaggagaatggcgtgaacctgggaggcggaccttgcagtgagccgagatcgcgccactgcactccagcatgggggacagagtgaggctccatctcaaaaaaataaataaataaataaataaataaataaaaattttaaagagatgatttaaagtatacggaagatacatgtaagttatatgcaaatactataccattttatataagagactggagcttctgaaaattgtggtatccactaggggttctggaaccaatcccccacatatcaaggggtgactgtaattacttaacaaaaattttttaaaaaatcatgaaagtatgtatttgtcaccagctcatgggaatcactattcttgaattaggtagcactaaatacctttaaatacctgatggaagccttaaactcagcagcaagttcctgaaaacatgccaacatatattaattattctgggtctaaaagtttgacaaattactttaaaatacagatgaaaacaaaataaaatgttttaaactgcaacaagaaaaatgtacaagttgaccagaagtttgaaacacttgactacattggtgcactgttaatcaaaatttatctgcaaaacagatttgcaaaagaaattataaacagggtagtaaatttcaaagtaatttataacagactaaggtcaagctacattagcaaagttggaaggtagcacttaagaaaaaactctgggccaggcacggtggctcacacctgtaatcccagcactttgggaaggccaaggcaggcagatcacctgaggtcgggagttcaagaccagcctggccaacatggtgaaacctaatttctactaaaaatacaaaaaaattagccgggcatggtggtgcgtgcctgtagatccagctactggggaggctgaggcacaagaattgcttgaatccgagcagcagaggttgcagtgagctgagatcgcaccactgcactccaacctgggtgacagagtgagactccctctcaattaaaaaaaaaaaaaaaaaaggccgggcacagtggttcacgcctgtaatcccagcactttgggaggctgaggcaggcggatcacgaggtcaggagatcgagaccatcctggctgacacggtgaaaccccgtctctactaaaaatacaaaaaattagctgggcgtggtggcgggcacctgtagtcccagctacttgggaggctgacgccggagaatggcatgaacccaggaggcggagcttgcagtgagctgagatcgcaccattgcactccagcctaggcaacagagcaagactctgtctcaaaaaaaaaaaagagaaaaaactctggaaagttatatggctctaccatgtactatttggacacctctggaggagaggaacttgttcaattttaacagtataaactttattgtttaagtagctaatatttaggccaggcgtggtggcttaagcctgtaattccagcacttcaggaggctgaacgggtggatcacctgaggtcaagattttgagaccagcctggccaacatggtgaaaccccgcctctaccaaaaatacaaaaattagtcgggcctcatggcgcacgcctgtggtcccagctacttgggagtctgaggcaggagaatcacttgaactcaggaggcagaggttgcagggaggcaaggttgcaccactgcactccagcctgggcaacagactgagactctatctcaaaaaaaaaaaaaaaaaaaaagactaactatcaattaggaaatatttacgtgtagcagtactaacaacattgagatggactaatttacagaatcccaatactttcgttctaattttttttttcagggtgttgctctgcatgattgtagctcactgtagcctcgaactcctgggctcaagggatcctcccacctcatcctcccaagtagctgggaccacaggtatatgccaccatgcccagctaattttttatttaatttttttttttgtagagacagggtctcactatagtgcccaggctggtctcaaactcttggcctcaagtgaacctcccaaagctctgggattacaagcatgagccactgtgcgcagctgcttccaaagattttctagagtggccaaaaccccagataatccatgaaagagcatgaaaagtattttaagggacaatggaaggggagaaactgctacctaatattctcagcaacttttcctgccctacctgacaagcgaatgatattgaagaggagggtaactaactgaacagactcttctctctccttctatccaggcacctactatcctgcaaatacgcagctttgaaggacttaaccaatgaccttaaaatctataccaggtctacagttctaggaagcgtataagcaaatgctgctatagaatttggattttctttaatgataaaaatgcaaatgactcacgtttggtcatccactccaacacagcacattctaaagaacaggagttcaaatcctccttctgccaaaagatgttgtgtcttcacacacaaataagtaattatggattatattactaccacaaatttctgtttctcactgaaggcatatgacattttaaaaaagaacaaaaaatcagaaaggaaatgtttcaagtctattttgaggtaaagcaatcaatttaccatttatcttcctcagacttacatatgaaagccccacacacatgcgcacacacaagatccccaaaatgttgacaactgttgaagctgcacaacggataccagagttcattatactattctatttttgcatatatttgaacatttccataatatgcagttttttaaaatatgcatgtgtgtgtctataggtgtttatacataaactcccaataaactgacatagaaatatccaattgttcaaagctttcattcttcaaaagtaagtgaatttcttttttttttttttttttttgaaacagtctctcactctgccacccaggctggagtgcattggcacgatctcggctcacagcaacctccacctcctgggtacaagcaagcgcatccagctaatttttttgtatttttagtagagatggggtttcaccatgttgactaggccagtctcaaactcctaacctcaagtgatgtgcccgcctcggcttcctgaggtgctgggattacaggcgtgagtcaccacgcccggccagaattccatctagctactttcttattctagaagttgtactgcaggtgaccagaccattagagaaggtctagtgaaagaaataattaactgccccagaataaaacaagcctaaccttgaaaagaggcaaagggaaaggtgctaaacagttattacaattaactgcatgtttatatttggtcctgttatcctctaacacaggtgggtaggtagaaaagggggaagtattttagggccagatttccttttgattctttaagttgatgggcaagagaggctggaataaagaaatctaaaaagtctccattataaatgataaccaagccaggcacaatggcgcatgccagtagttccagctacttaggagacaagaggggagaatcgcctgaacccaggaattcaaaactagcctaggcaacagagtgagacctcatctctaaataaataagttaatgaattaattaaaggtagaattgtataatatatgaattatacctcaatttaaaaacaatttaagccctatacagtgatgcatgcctatagccacaactactcataagactgaagcaggaggatagcttgaacttaggagtttgagaacagcctgggcaacatagagaggcctcatccccctcccacccccacccgaaaaaaagcattcatagctcatcttagtataatcagcaacttccaatgactaactatgctttcctgctagacatgaatttataaaacacataaaaattatactgtatctgcttcaattccttttttcatattgccattcaattttcacaagattactttaaatgcaatcctaaattcatcaccaatttaacttttgttagttatgtctaaaaataaaactagtcaaaattaaaaatactaactttgcagcaaattaatcttgcatcagcactacaaacaaatttttaaacttattgtagcaaaacataacttcgacagaatcaaagacattaattctcaagtccaaaaaaaggtcacaagaaattatttaaagtggtaaagggaaacgcagacttaggcatacaagccaagaaaaaaaaaattagagataactcctccgctagaacctccccccaatacttccatagcaacaattatttccttagcacaaaagtgatgtgttcactttcacaaaacctggatcatctaagtttgcacaattcccttcaatctaaaaaacagatgaaattgtttcatttaggtgagtagaattttgtgtccctatacacgaaaaaagtcaccatcagtgtgagtaaaccacatggctccagctttaagatcttgttccccaacccactgaaaagagtatatgcttataaaatattcatggacttaccaggttaaagacagtttctacaatatccctattggatacttctccaacttcaaccaaaccggtcaacacggcaaatttcattctgatgcccctgatggggagccctggtttcagagacaatgcacccccttcagtaggggtttcttctctccctccacctcccccgtcatcacctgttggtggcggggaagggacacgattgtcttcgctagccattgctagctcacgataaaggacaactcagagtcaccctgggacggcagtcgctgcactggtaatgagcacaacacacgcaatgcaaaacgaaagggtccctcttccaacttgtggagataccccaaagcagttgatgtggaaagtccttggcgtcgccctcctcctcttggagaatatttgtccaatctctctccccgaggctgacaacaacgccaaaccctattggaagattaaatatatgttaaataggctaggttttgttttagggttttgaggggacaagagggaaatagttattgtcggtcaagtaagttactaaaggcaccccactactagccacccgcttctcccgggctcaaaaagctgggttctgggtgaaggcaggtccaagaggcccccgaacaggctcactcctcccccactctcgtgcaggttctaggcgcagggtaacctctcctcacaggtgcactagaaagagaaactgtcgcggggaaaggagggatcggaggaaagaaggggggcccacaagctatcacagaggtagaaagttcttcctcacccagatactccggactcgtcctcaccccccgcccaggagcagcgagaccgaggtggcggcggagat

SEQ ID NO: 1850 - DNA, 750839 bp, Homo sapiens
ttcacaacatacaaagaatttatttatgcaatacaggccttttctcaaatatttttcacagaattccacacagtaatctactagaaaagtagaattatacaccaccaaataacattgtttcgtttcttagtacaaattgctaatcaaaaggaaggtggagatgatagtttaataacaaatagtaaaacaggtgttgctgaatacagcacccggtagcctctatttgcaaacccggggagggaagggggtgccccaacaaaacaacagtggctccgcctcattgtccaggcacaggcaaaccgcagtagtgagctttggtacttgcatttactttaaaagaaaaacaaatgttgtgagctcaagagcatttccatcatttcgttttgttgtgctatgaagatgacagatcaggaaaaaatggtaactatttcacacttgctataaattagattccttgtgctaaccacacaataaaatagcctcccccaaaccatacttttctaggtctaaaacatgcttgaagaacaatattgatagacagacttaattgagatgttttaaattacatttaccataatttaaacattactatttaaatcccagaaatattagtgctgaagaagcacagttgtttggaaaaatacaggacccaaattacagcatcaaattttcctattccaatattgtaacccacttccccactgtgaaaatcctatttctcaagcttgtagatgcatgggaaatgttcttcataatattatagctggaataagtggtttacttgctccactgtatgtttccataattggtgaaaatagacttctcattatgactaaaaatatagattttttaaaactacagaacccagcagccagttttctgctttgctaatcccccccaaaaaagtcaagcaaagactacaaaaatagcaattattaataactttaaaaaatattttgcttctttgagcaaatttaagttacattcagatgtggtagaagagaatgatgctccaggtacttctgctcatcctaggggcagagttgatgtacagctgtcaccatcagtagcgggtttggtattcatgatgccaccggttaaagtcgttgtaaaatagcacaatgcttcctgaagccatgccagaaatgatgcacctaggagaagcacagagagaaggacttttacaaacctgtgtgtcctagagatgttactaaaaactgctctccccaaatccacaaggtaaatatagaagctggcagtgaaggctccaatttgtgggaactaaggtatgtatttcatgactaaaatgtatccctgagtaagctcagagtactgcctctgacactccacaaggatccaagccacagcttgctttttcattgaaagggtacggacagctggtatgtgcaggatgagtaactaaaatctgaacagatttgtaactaaaatctgaacagatttggtaatttctaaagggggactgggctggcaagacccatccattatataagcaacagactcaaaagaaggaaccacaatctcaaagtaactgctggtggaaagaagcagcacacactcaagtgacaagagacaccacctctgacaggtacagaatcaatgaagagtgaaaaagaagagtgttgttgaccataatttaagctggtctcccctctgtggagaagtagtctatgtccatcatgctctgggtgaggacctagtcctcgtaacacagtaactcaccgaaatcactgaagataagaacttctgcaagcttcttggtctcctgtccccaaagaggtggtgcagggaaagagatggagaacataggtgaacctaaactgagcatagccagatttttctctgtgtagtttggttaggaccagcccttagaagccatattcagtatccttcctagtacctcgtatcaaaattaattaggaactaaaatgtgtcactacaaaaaaaatcaactaaaaacaaaggaagacagtaaggaggaaatgagagacaaaactctaaggcagagagaaaattaaatagaaaagtggcaaaagtcagtctttccttatcagtcattaaagagattaaattctccagccaaaaggaagagattggcagaatggataaaaaacatgatccaactatatgctgtctacaggagacccacttgagatctaaagacaaacatcttgaaagtgaaaggatggaaaagatattccgtgtaagtactagcaaagagagctgaggtggcttacactaatatcagacaaaatagtctttcagtcaaaaactgttacaagagacaaaggacactacactgagaaaagggtaaattcacagaaatataacaattatatatgcatttatcatcagacccccaagatacaaagagcaaatattaacagaattgaagggagaaatggttctacagtaatagttttagacgtcaataccccactttcaataatgggtggaacaaccaggtggaagataaggaaacaggacacttgaacaatacgataagccaactggacctgacacacgtatatagaacaccttcccaacaacaatagaatatacatttttttgcagtgcgcatggaatagtctccaagataaaccatatgttaggccacaagtgttaatgacttagtaaagattaaaatcacaaagtagcttttctgatcataatagaatgaaactaggtaccaataactgaaggtaaactagaaaattcacaaatatgtggaaagtaaataaatgatgagtcaaaaaaaacaaacaacaacataagagacatcagaaaatactgagacaaatgaaaaggaaatacaacaagccaaaacttatgaaatgcagcaaaagcaatgctaaaatggaaatttttagctgtaaacacatagatttaaaaatatctcaaatcaataacctaactttacctcttaaggaactagaaaacagacaaaaccccaggctaggcagaaggaagaaaataataaagaacagagtagagagaaataaagcagaaaatagtaaaatgattgataggaaaaaacccaaaaattggttctttgaaaaaataacaaaattgacaaacctctagctagactaagatgacttggctgggcatggtggatcatgcctgtaatcccagcactttgggaggccaaggtgggtggatcacctggggtcaggagttcgagaccagcctggccaacccggggaaacctcgtctctactaaaaatacaaaaattaactgggcgtggtagtgggcacctgtaatcccagctacttggaaggctgaggcaggagaatcacttgaacctgggaagcagaggttgcagtgagctgagattgcaccattgcactccagcctgggtgatagagtgagactccatctcaaaaaaaaaaaaaaaatgactcaaattactaaaatcagaaataaaagttgggacattactgatttggcagaaactgagttcagagagactattagaaacaactgtataccaacaaatagggcaacctagatgaaatagacaaattcctgaaaacagtataccaaaactgaatgaagaaatagaaatgattagacttatgacaagtgaagagattgaatcagtaatcaaaaacctcccaataagaaaagtcctagacaagatggcttcactgatgaattctaccaaacatttaaagaagtattaacaccaatccttctcaatttcttcttccaaaaaattaaagaatccagaacacttcctaagtgattcaataaggccagtattaccatgacaccaaagccagttgaagacattacaacaaaagaacacacagaccaggatacaaaatactagcaaactgaattcactagcatggtagtgggaatgtacaccatgacccagtgggattcattctgggaatgcaaggatgactcaccatgcaaaagtcaaccaacatataacatactacattaacagaacaaacaacaaaacaagcccacatgatcatctcaactgatgctggaaaatttgacatgtgacaaaattcatcatccttttattatgaaaacaataggagtagaaggaaactacctcaaatgataaacagcatgtatgaataactcacagctaacaccacactcgatgaaaaaaagtttttcccctatgattgggaacaaggcaaggatgcccactttaatcactcttatccaacagtactgaaagtcctagacagagcaattacacaagaaaaaagtatccaaattggaaaggaggagtgaaactgtctctgtttacagatgacatgatcttgtatgtaggaaatcctaaaaattccacaccaaaacaaaacaaaagagctaataaatgaattcagcaaatttgcaggatatacaacacgaaaatcagttgcatttttatacactaacaaacaatgagcagtccaaaaggaaaattaagaattgcagtgagccgagatcatgccattgcactccagcctgggtgacagagcgaaacagaaacccctaacagccaaaacaatcttgaaaaagaagaaatatgttagcagttgcacattttctgatttgaaaacttacttactgttgttacaatgcgacagtaatcaaaacattgtcacactgatataggcagaccaacagaagagaaagttgagaaataatccctcacatatgtgctcaaatagggtgccaagacctttcaacggagaaagcaccttcttttcaacaaattatgctgggaaaataggatgtccacatgcaaaacaatgaaggtggactcttacctaccattatattaaaaaactaaaaacagatcaaaaacctaaatacaaattaaaactataaaacttttagatgaaaacatatgggaaaaccttcatgaccttggattttgcagtggcttcttggatatgatatcaaaacaaaagagacaagataacaaaacaaactcataacaaaaaataggacttcataaaatgtaaaatcagggctaggtatagtggcttatggctataatcccatccctttgggtggctgagtcagcaggattgtttgtttgagcccaggagtttaagaccagcctgggcaacatagtgagaccctgtctctacagaaaataaaaaagctgggcatggtggcacatgcctggagtaccagctaccatgtagctgaggcgggagaatcatttgagcccaggaggttgaggcttcagtgagctgtgattgtgccactgcactccagtctgggcaaaagagtgagaccctgtctcaaaaaacaaacaaaaagtaaaatcttttgagcatctaaggatattaggaagagagtgaaaagacaacatcactgatcattagggaaatcaaaaccacaatgagagaccacgcctgttaggacaactgttaaaaaatagagcaaggtgttgataaggatgtggagaaattggaacccatgtaaaatggtacagccactgtggaaaacactttagggtttcctcaaaaagtcaaacggaattgccatataacccagcaattccactcctgggcatacacccaaaaggactgtaaaaagggacttgaatagatatttgtatgataatgttcatagcagcattactcaccatagccaaaaggtagaaacaacccaagtgtccatcatcaacaggtgaacgataaacagaacacagaatattcatataatattctgatacgtgctacgacatgcaagaaccttgaaagtgttatgccaagtgaaataagccaggcacaacacaacaaatattgtatgattccacttaacagaaggtgcttagaagaggcaaattcatagagacagaaagtagcatgcacatgagctggtgggagagagagtcattaacatgcagagcttctgtttatgatgaaaagggtctggaaatggatgatggtgatggtggcacaacactgtaaatgtacataatgccactaaattatatatcgaaaagagtttagatggaaaatattatatgttgccacaattttttttaaaaggaacaaaaatgagtgactatacgttaagaggaaataaggtgccagataaagatgatccccccaaaatctaccacttgagagcttttaggaaataagccctatctttcaggggactctccatatgcagagatatgcagagataaaggcattttacattaaacatctttacagctctttcaattttatttactgataaagatgatgatacttcttcaggctggcaatcgccgaataggagcagatctggtctgcagctcccagtgagattgacgctgggtggatgatttctgcatttccaactgaggtacctggttcatctcgttgggactggttggacagtgggtgcagcccacggagggcaagccgaagcagggtggggtgttgcctcacccatggaagcacaaggggtcggggaattccctcccccagccaatggaggctgtgagggactgtgccatgaggaatggtgcactctggcccagatactgcgcttttcccacagtcttcacaacctgcagaccaggagattcccttgggtgcctacaccaccagggccctgggttttaagcacaaaacagggcggccgtttgggtagacactgagctagctgcaggagtttttttttttttttcataccccagtggtgcctggaatgccagcgagacagaaccgtttactcccctggaaaggaggctgaagccagggagccaagtggtctggctcggtgggtcccactcccatggagcccagcaagctaagatccactggcttgaaattcttgctgccagcacagcagtctgaagttgacctgggacactcaagcttggtggggggaggagcagccagggagccaagtggtctggctcggtgggtcccactcccatggagcccagcaagctaagatccactggcttgaaattcttgctgccagcacagcagtctgaagttgacctgggacactcaagcttggtggggggaggagcgtccgccattggtgaggcttgagtaggtggttttaccctcacggtgtaaacaaagcctctggggagttcgaattgggtggagctcactgcagctcagcaaggccactgtggccagactgcctctctagattcctcctctctgggcagggcatctctgaaaaaaaaggcagcagccccagttaggggcttatagataaaacccccatctccctgggacagagcacctgggggaaggggcagctgtgggtgcagcttcagcagacttaaatgtccctgtctgacagctctgaagacagcagtggatctcccaggacagcatttgagctctgctaatggtcaaactgcctcctcaagtgggtcctcaacccctgtgtctcctgactgggagacacctcatacaggagagctctggcggaggcccctctggaatgaagcttccagaggaaggaactggcagcaatgtttgctgttctgtagcctccactggtgatacccaggtaaacagggtctggaatggacctctagcaaactccagcagagctgcagctgagaggcctgtgagaaggaaaactaacaaacaggaatagcgtcaacatcaacaaaaaggatgtctagacacagaaaacccatccaaaggtcaccaacatcaaagactaaagaaagatagataaatccacaaaaatggggagaaaccagtgcaaaaagctgaaaattgcaaaaaccagaatgcctcttctccaaaggattacaactccttgccagaaaaatggaacaaagctgaacagtttgagaaattaacagaagtaggcttcagaaggtgggtaataaactcctccgagctaaaggatcacgttctaatccaatgcaaggaagctaagaaccttgaaaaaaagttagacgaattgctaactagaataaccagtttagagaagaacataaatgacctgatggagctgaaaaacacagcacgagaacttcatgaagcatacacaagtatcaatagccaaatcgatcaagcagaagaaaggatatcagagattgaagatcaacttaatgaaataaagagagaagattagagaaaaaagaatgaaaaggaacaaacaaagccttcaagaaatataggactatgtgaaaagaccaaatctacatttgatttgtatacctgaaggtgacagggagaatggaaccaagttggaaaacactctgcaggatattatccaggagaacgtccccaacctagcaagacagaccaacattcaaattcaggaaatacagagaacaccacaaagatacttctcaagaagagcaactccaggacacataatcatcagattatgtgaaggtagaaatgaaggaaaaattgttaagggcagccagaaagaaaggtcaggttacccacaaagcaaagcccatcagactaacagcggatctctcagcagaaaccctacaagccagaagagagtgggggccaatattcaacattctctaagaaaataattctcaacccagaatttcatatccagccaaactaagcttcataagcaaaggagaaataaaatcctttacagacaagcaagtgttgagacatttagtcaccaccaggcctgccttacaagagctcctgaaggaagcactagacatggaaaggaacaaccggtaccagccactatgaaaacataccaaattgtaaacaccatcgacgctatgaaggaaactgcatcaactaatgagcaaaataaccagctagcatcataatgacaggatcaaattcacacataacaatattaactttaaatgtaaatggactaaatgctccaattaaaagacacagactggcaaattggataaagagtcaagacccatcagtgtgctatattcaggagacccatctcacatgcaaagacacacataggctcaaaataaagggatggaggaagattttccaagcaaatggaaagaaaaaaaaaaagcagggttgcaatcctagtctctgataaagcagactttaaatcaacaaagatcaaaagagacaaagaaggccatgacataatggtaaagggatcaatgcaacaacaagacctatcctaaatatatatgcacccaatacaggagcacccagattcataaagcaagttcttagagacctacaaagagacttagactcccacacaataatagtgggagattttaacaccccactgtcaatattagatcaatgagacagaaaagcaacaacaaggatattcagaacttgaactcagctctggaccaagcagacctaacagacatctacagaaatctccaccccaaatcatcagaatattcattcttctcagcaccacactgcacttattctaaaattgaccacataattgaaagtaaaacactcctcagcaaatgcaaaagaatggaaatcataaccaatagtctctcagacgcagtgcaatcaaattagaactcaggattaagacactcactcaaaaccgcacaactacatagaaactgaacaatttgctcctgaatgactactgggcaaatactgaaatgaaggcagaaataaagatgttacttgaaaccaatgagaacaaagacacaacataccagaatctctgggacacatttaaaatagtgttttgaaggaaatttatagtacgtaatgcccacaagagaaagcaggaaagatttaaaatcaacaccctaacatcacaattaaaagaactacagaaggaagagcaaacacattcaaaagctagcagaagacactaagatcagaggagaactgaaggagacagagacacaaaaaacccttcagatcaatgaatccaggagctggtttttttgaaatgatcaacaaaatagaccactagccagattaatacacaagaaaagagagaagaatcaaatatacacaataaaaaatgataaaggggttatcaccactgatcacacagaaatacaaactaccatcagagaatactataaacacctctacgcaaataaactagaaaatctagaagaaatggatacattcttgggcacatacaccctccaaagtctaaaccaggaagaagtcaaatccctgaatagaccaataacaagttctgaaatcaatagcctaccaaccaaaaaaagtccaggaccagacagattcacagccaatttctaccagaggtacaaaaaggagctggtaccattccttctgaaactattccaatcaatagaaaaagagggaatcctaactcattttatgaggccagcatcatcctgataccaaaacctggcagagacacaagaaagaaagaaaatttcaggccaatatgcctaatgaacatcaatgcgaaaatcctcaataaaatactggcaaaccaaatccaggagcacatcaaaaagcttatccaccatgatcaagtgggcttcatccctaggatgcaaggctggttcaacatacacaaatcaataaaagtaatccatcacataaacagaatcaatgacaaaaaccacatgattatctcaatagatgcagaaaaggccttcaacaaaattcaccaccccttcatcctaaaaactctcaataaactaggtactgatggaatgtatctcaaaataataagagctatttatgacaaacccacagccaatatcatactgaatgggcaaaaactgaagcattccctttgaaaactggcacaagacaaggatataccctctctcaccactcctattcaacatagtattggaagttctggccagggcaatcaggcaagagaaagaaagaaagggtattcagataggaaaagaggaagtcaaattatccctgtttgcagatgacatgattgtatatttagaaaaccccagcatctcagcccaaaatctccttaagctgataggcaacttcagcaaagtctcaggatacaaaatcaatgtgcaaaaatcacaagcattcctatacaccaataacagacaaacagccaaatcatgagtgaactcccattcacaattgctacaaagacaattaaatacctaggaatctaacttacaagggatgtgaaggacctcttcaaggagaactacaaaccactgctcaaggaaataagagaggacacaaataagtggaaaaacattccatgctcatggataggaagaatcaatattgtgaaaatggtcatactgcccaaagtaatttatagagtcaattcaatgctatccccatcaagctaccattgactttcttcacagaattagaaaaaactactttaaatttcatatggaaccaaaaaagagcctgtatagccaagacaatcctaagcaaaaagaacaaagctggaggcaccatactacctgacttcaaactatactacaaggctacagtaaccaaaacagcatggtactggtaccaaaacagatatatagaccaatggaacagaacagaggcctcagaaataacaccatgcatctacaaccatctgatctttgacaaacctgacacaaacaagcaatggggaaaggattccctaattagtaaatggtgttgggaaaactggctagccatatgcagaaaactgaaactggaccccttccttacaccttatacaaaaattaactcaagatggatgaaagacttaaacgtaaggcctaaaaccataaaaaccctagaaggaaacctaggcaataccattcaggacataggcatgggcaaagacttcatgactaaaacaccaaaagcaatggcaacaaaagccaaaattgacaaatgggatctaattaaagagcttctgcacagcaaaagaaactatcatcagagtgaacaggtaggctacagaattggagaaaatttttgcaatctatccaactgacaaagggctaatatccagaatctacaaagaacttaaacaaatttacaagaaaaaaacaaccccatcaaaaagtgggcaaaagatatgaacagacacttctcaaaagaagacatttacgcagccaacaaacatatgaataaaagctctttatcactggtcattagagaaatgcaaatcaaaaccacaatgagacaccatctcacacccttcagaatggcaatcattaaaaagttaggaaacaacagatgctggagaggatgtggagaaacagaaatgcttttacatcgttggtgggagtgtaaattagttcaaccattgtagaagacagtgtggcaattcctcaaggatatagaaccagaaataccatttgacccacaatctcattactgggtatatacccaaaggattataaatcattctagtataaagacacatgcacatctatgtttattgcggcactattcacaatagcaaagacttggaaccaacccaaatgcccatcaatgatagactggataaagaaaatgtggcacatatacgccatggaatactatgcagccatacaaaagaatgagttcatgtcctttgcagggacatggatgaagctggaaactgtcattctcagcaaactaacacaggaacagaaaagcaaatacctcatcttctcactcataagtgggagttgaacaaagagaacatatggacacagaggaacatcacatacgggggcctgttgtgggggtgggggcctaggggagggatagcattaggagaaatacctaatgtagatgatgggttgatgggtgcagcagaccaccatggcacatgtatacctatgtaacaaactgcgttctgcacatgtaccccagaacttaaggtataatttaaaaaaagatacttcaaagaaatataaaaagctttgcatcactgtaatcagagcctttgctacttaaattctgtctattccttgagaactcagcctttgtccaagagtggcaatgtcatcagaaagaaaatcacactttttaaaaaagtgttcttggtttgattgtacaggtgacccccacaactcaactccatcagcccatttaaataaattccctctgcaggttttactatacaattttgaaaaaaaaattttttttttctgtagagacagggtcttgcaatgttgcccaggctggcttcgaactcctgggctcaagtgattctcctgcctcagcctcccaaagtactgggattacaggtgtaagccaacacgaccagtcccctctgcagtttttgaaacccctatttgtagcccatgattccagtgttacctctggtcgtaagacagcgccatggcccggattccagcgtcacatcctggataggcaaagagctgcttgaggtccgacacctgccggaccacgaccactcctctgtctcctcctgtgagcaggtactgcccatctcggctcagctggatggcctgtgagacacagcaacattcagtagaaatgtggttctaggaaactttcggcccccaccctgtttttgagtcattcttacaccagctactacggtgcagagagaagagagagagatcctcaggagtttttagaaaatcgtgagttgtagaagatctgccatttttcaaaaaccaaatggacaaagttcatcaatgcttgagattgttttggctttgcttttttaaatactaggtagcaaactcttccagttctacaaatgctactggaatggtgtgtgttgtggactgggaccagtgctctaatgagaagccctggcatctcttcatttgcactgcagacatgctaataagcctgttttgtcccaagacttggcagatggtgccacctgaccttacatcccctctaatcccctgcaactccagctggagggaggcggccagcagcctcggcaccttccctgagcctgctggattttgacagcagttgggaagaagactttgtagagagctacaacaacttccagggtgattaaatctcagttcagcattttcttgctccagggctgacagtgctccagcctgtggtttagtcagctctaggctgtgcccctctgtcctttcctactagcgctgaacagacagtacaggctcagaatttgctctttgatcctgtaaaatgggcatccatgaatgaaagcctgcgggccaagtgcagcccactgcctgtttcatataattgtttaacattttttaatgcttgaatttttcatgacacatgaatatttatatgaattccaaatttgaatccccataaacaggtttttttttttcccccctcgagacagggtcttgctctgtcacccaggctggagtgcagtggcgcagtctcagctcactacaatctccacctctcaggttcaagtgattctcatacctcaacctcctgagcagttgggattacaggtgcccaccacaacacccgtctaacttttgtatttttagtagagacggggtttcaccatgttggtcaggctggtcttgaactcctgacctcaagtgatccacccgctcggactcccaaagtgctgggattacaggcgagaaccactgcgcctggccttccataaataaggttttaccagaacatcgccacacctattatttgtttatgactgctttcacaggtagttgcagcagagaatgcagaaccctcaaagctgaaaatatttactttctgtccatttatagaaaaagtgtgattactcctaattgtccctccctcctccaaaagccaatcctattaccccttcctctcctcctgcctggtacctccaagccttgctttcttagcttattaagatacaaatttcctttctttagtggatggcatcagagttttaaagccactacaaacacctgtaatcgcatgtccacctggacacaggggaatacagattgtgctggcaagccagaaagaaaaaaacctaatttctgatacattgacactgttctacattcagttctagcatagctgccttaagtcttcactgtttgacatatcttttaaaaaatcatagaaaggcaaagactttcttagccatttatttcacattcacccaaatgccaacttttagtagtcccttaaatacagcttattctcaagaacacaaaaacacatctaggaaataaaaacccatgtgtggaagacagttagttacatattctctaagttttgttaacacagatattaagatattttcaagatgagcaaaaatcagtatccttttcccccactcatttcacaaatggcaatctctaggggtgtctgggaactgcagtggagactaggacaaacaattatttgctacacttataaaattcagctgatgaaaatccattaaccttatggttgtagttcatttgaatttgatacttgaagctttttactggataagtgttatactaaaacaaaaccactgatctttaattctttgttctagtaaagaatctctaatcctgcttccatctgaaattaagtaaaacctgggctttagggactatacagtcatcagcattcaaaacattttaatgaatcagatgcctcccaaggtgaaaaaagatttcgctggcctctttcaggagaggccaaattcctctggcggcaagagccagggtaacatttagcaagcagcacctgatctcccactcaaattctgacaggccgcctccgcatccaggttgggttgtgactagaggttttcagagggccccagacacatgttaatctcatcccctgaaatcctgagtgctctggacaatgccgtggctgcacgggttttaaggaggtagtagcaggccacagcaatctgctggggatgaccacattctaaaacagcctcaggaagggaaaacaaatgcattcccctgggtgaatggtggttctcccttgtttaggacaaaataactttgctgctctgtacaggctgcctccttaaatatcagctattcataaagacatctcaacactgtctagttgatggactgtgatatgctgctaaccaaaatgccacagagcaatctggcatctaaaataaaaataggtgggaagtgcagagcttccccaggctgcctgcctgcagggttcttggtatttcacagaaacttaatttctggtctgagctgatgactaatttgtttccatggtgtccattccttatatgggctcagattgaggaaggagctggagattctgccctgtggtgtcttggattcccagcctgtggcttccttcctcgcctcccgaggtagtgagctgtgaaagtatcagtctctggagctgtgggcaggtattgctcattttaggcaagctcgctttaatcacacagttgccacttgcaagttagcatgataaagtgcaggagtgctgggaaaaaggcaatggattgtttaagcctaaaatccagtgggaaatattaaagagggaaaaagcaatggctacagggcagagaggagaagcatgtgtgtatgaatggtctgcagaaagcctcccactgctgcctcaaggaacttcccagagcccctggtactaactgaaatgccacagaaattgcttcagtcagccagggatctcaaattattttacagatttattagcgtagctgacaatataatcgcaactcaaagtgacagattatccacattattattgtaaagaaaagaggaaaagaaaatcctctgatgtgtacttggtttaaatgcagcattatgggaaggtagggaaaaataaaagcgagtacgagtgtgtctctgtgcgtgcctcgtggaggccggcagaatgtgatggagagaccgcagagaacagtggagacaagaaggaagccgtccactgaatcaagaaatgaatcccaggagacagagcagcaagggtccttcatttcctcaatgtaacctatatgtaggagctttgttccctgagaccagtatttacttaggagaagggggtgatcagactagatctgggaaagtgggagaatttatgacatctaagctgcataggtcagaatagcaatgagtgaaatatccagagctagcccaacgccagggtagaagcccctgtgaccctactcctgcccccaacatgtcctgggtcccctcattgtatacagctcacatgccccgccctccagcctgattctggaaaatgaggaccaccccagctttattttactttaaccttcaccaaggagtttggaggtaagaaacaaaggaccttgagaaactagcctctgaaaagaatagttcttactctttttctcaatgtctaatacttgtggagtcctgtcctggagatgaagcaagagcccagaaggtccactggcggtgccatttcgggtagacccagtgggagaaaatgcctgcctaattcatatcataatttgaagcccagcttctttaacatgtttttggtcttgttgtccataaagaagtcatagctgaaattaataaacctaaatagtcataatccctactgctcccaccaccaagctattcagatgtaaagagaatccagttttaagtgtcatctaatgtactatttcagctttcatactcagaaaacaatgtgcagtgcattttcttagaaaaaaagaaatgagcagtgccactaaaagccacccaggatggcttcagaagcccctaagaaaacctcttctattgaaggaccgtcctcagctgcgctgagtgacgtggtcagcacagctggcactgctgtggtgtgtgaagtgtgtgagccttgtctgagtgctacctaaagattttttgttggtatggaaaagaggccctcggcaatccaaaaatagaggtttctttcgcgaaccctctccctccccacttgacacacgttgaggtaaaagtcgtgaatgctgaagagtccccagggcactcactcttatgttatcatctgtttccatcgtggcctggagttttccattcacactgaatgtacagaagaggccgttttcatagaatatgacacaatgaccctctcttgaagcctgaatgagttttggtttcaggcagttttcaggaccctccaaggtcctcaacaagtctccattcatggaatgtatgagacatggtccttctgagaagagaggagaaataaaaggcaaaattattgaatgaaaacagacaatatgatctgaatcttgagcacagatcaaacaggattatagaaccacactatagatgtagaaagcctttaaaaaacttccatcttacgtgtaagttattttgcaaaatctcctcttcatgtttgccagatctcaccttccactcaggagaggagagaagccaaaccatgtaagtccaagttcactttcctcaagagacaggaagttactctatgaaattcattatgctaacaggcaatacaaactggaggaactgagaaacaggataagcttcaaattctagcacagcttcaaggaggctgggatgcaaacaaacaagggctgcgggcaggtacactaagacctctccctgcaccttgcaggagccccaacggccacggcactgtgggcctatgcagggacagccagctcaatcagcctctgagtgccttagccctcttcccccgcaactgctcactactttttttacactgaaagggggtccctggtagttcctctcaacctccaaaaaattcacacaggaacccttcggccacttctccttggcaactgagtgaagccacctccctgctgccttcacagcaaggagcagcatctaccactcccaacgcctgggtggaccaccaggccaaggtgccagagaaggacaggcagctactgggagcccacacacagccaagctttttgtttctgttgagtacctgctgcatgcaaggcaaagaaggaataaggaacaaaaattgcttgtgtgatgagcaagttccaagagatagtcagataacgggggtcactggggtatgcgccctgctactctactggctaaattactcatggccacatggaatcgttgccttttccccacaatgactattgaaagcttgcccttttaaaaataaggcttttagctctttcttgaccactcaggtagttgataaattttttaaatatccacaggcagtgtttgctttacacagttccagcatgcatgaatttcagttatcactccttaaataacaccagccctccaataacatagttcaaatttaggttgtcatagtaattgcataaagtatgcacttttgtggctagctcttcagtccacaaatcactatataaataacagatgtgcatcatcatcatcagtgaccaatcacatcactcctttcaaaatatgtcgatgactgctcactgcattatctgttattcagttcccacacagacagcaaactgtgcagctgtgttgcttttttgtctcccagtgataaagccatgtaacatttcacaaaaatggataatcaaaaaggggtattggccaacaaagatgaaactgcagtaaagaaatggaaaatgataaaactgaaagtacaatttgaattgaatataaatggaattatagaagagcgagctgcctgtgggatgctgaccctgctgagacactgtagatatgcagccaggaagggaatgaaggaacttatcagtgtaagttagggaagaaggtgtaacaaaaatgtcccagaatttaaaccagcaaaagcctcacattaaaggaattctagggaatatttcatgacattgaaagcacaaaagataaaatgttagatgctggttccaacttagaaaagagtatgacagctccccaaggcatagaaaagatgctagctccttacatgtatataacaagaaggcagtaagcactgttcaaactactcttgatatgtttttcacaaataaaataattatcaatgtatcaaatgttttaaattacagtgtattaagtacatgtgagttttactacttttttcatgttatatgtataactgagtatgagtttttaatgttttgacaaaattattcttagagacagggttttgctgtgtcacccaggctggagtgcagtggcatgatcatggcttactacagccttcacctcctgcaatcctcccatctcaccttcccaagcagctgggactacaggtgtgcaccccatgcccagctaattcttaatttttttgtagagatgggggtctcactatgttgccagactggtcttgaactcctggcctcaaatgatcttcccaccttagcctcccaaaatgttgggattacaggcatgagccaccatgcccagcctgacaaaaatttttaaagaccatggaacaattgtaaaatttaccaatgattattcagatcactttgtatggtttcagttggcgtgctcacttttacagttccatactactgtgcaaagaaaagatgacctgtaatatataataggttcattttacgactcctgttggctcaggacgtatgaaattattgagtataagggaaaaatccagtggttatagaattattgctatcattattactatttcaatgttttgaccaaatttataaacataatcctttaaatatttaaaacaccttattaactagactaataagtattacattttaggacacagaggagctgatccaaatactctgtttccccaccagataaacccaaaagatgtgagatataatactttgttgtgtgttcagacttcagctcagagcagagacagagagatggatagactattatgatgggataagtaagcaacgaattggaaacagctccattcctagtcagatcctgatttgttgcatgtgctctaagctcgcttaatatcttgggcctaaatatataatgctgtttccagcacaaacctccaggcaaaccagcttaagtatctttctactccactctcaatgccactgtggcccctgcctcattaaaacagacagggtcaggggcttccattcagatataagacggaacctggcccagtaatagctcagaagaataaacaaatatacaaagacgttccttgttcctgcttcaggggaatatgaatattaacaggatatgtttgtaaaaacatcttaaactccttagagcagtgctgtgaaacagaactttctacaatgatggaaatgatctgtatctgtgctgtccaatgtagtggccactagccatatgtgagtactgaggacctgcaatgtggctagtgccacgaagaaacttacattttaattttatttaattttaaataatttaaatagttccatatgactaatggctatcataacagacagaagctttagaaaaaaggtaccaaattaatctttggtaatttgtttctagaagacagcaagaaatgcatccattttgtgaaggtaccacaggtttaccttgtgaaccactcaacaccaggcctagctccgcacacaccgcagcacatgtgacctcatagtcatggccggtcaaaatggcccgaggagcagcagtctcacctttaggaaaaaacagataaaaagaacaaatcaattcaatttcatgcatattaaataatcaacaacttgctcctaatttccatcatgcctatttaatttatagtttgggaatttgtccagcaatcctactttaggactagatccaagttacatactatagtttgattatgagggccacatcctgctaaaatgtcaagtaacctttatgtgattatcaagcaacaatggttgaaaactcagggttaaatacaacaaaatctgcattccaaaatgcctcataaaaaatcagcccctcaattagatgttttatggtcagatgattataaaattaggaactttggctcaatttacatttcaaagaaaggcctcgcccctccttcctccttcctcatcctttgtgggccgctgaaacccatcataatgaagacagtctgaactagacttctgctacccccacagtaattctgcagcccctctcttaaatatgtattctctctactaagcttatgtatttttctgatatataaatttcatggatatatttctctgtggttcattcaaataaccgaaaaaaaacccaatataagaaacacctaaaaaaaaaccaaacccttacagataagtctacagatagtgattgaaaatgaggggcggtgggtagagaaggggggacagaggaggagtatccaaaaactggcagatattgccgaatactttcacaacttgaaagaacaagtcatcctgtatgtctgtcccaaactaaaaagaaaacgtatggttggttggttggttggttaataaggaacccatcatgactaagtaaaatggtaatggtcttgatttgtggatgggttcgtgccaagccacaaggataaactggattccatgtctagcctgaagaatatgatttgaagactaaacggatcctttacttttatagtctctaaaggtaaagatacaaaaagtctttccaagtggagagcaggattctattagcattcccgatttcttgatttggattggttttatagtatgcttgataactaacactgtgtaatccagaagagacaaatgtgcccacagagtaagtggctaccaccagctatggaactctgtggaagagaatcgcttgtatcttaaccccagacacctgactatccttggagcagtcacccactcagaggaaggaagtccagcagctcaggggaaacccactggaaacctactgtacttggaaaggcaaatgctgctgtcagaaaactaacccggcttccaaagcaagggttcttccagtaggtcactgggttatttgaaattttatgcaaaatgtatctacatgcctgtttttctaggtagcaggggaggaaaataagttttactgaatggacagaggtccatgaacaagaaaaggtgagaggcttctaccctgaagggaggtctggtctctgtgcttgtagccccacttcacctggagccagcagtcacttcaggtctagcttttcacaggacagttccaatgcatgtaccagagtacataatgcacggccatgtccctacaatgtccttcaaggctttggtgactgtaggtaatcctgagtgagacttaagttgaaggaatgccacacggaactttgcaccacactggcgtgctatgtgcagccagctgctggacctagcctacaggcttagtgataaagggagaccaaaaataacatacaaagaggcaagggggtaggcagaacaaggggcttcgtttcatttgattccaagttttaacacttctttgggaggcaaacttaccttaattagaaagttgacatttcccaagccacaaagaatttgtcacaagagcaattttgtttcttacaaagtccagaaatttgggaaaattttaaagaaataaagcaaataatgtaagccaatctgaactacttaagcttctgttaggatccacaaattttttttttttttttctgagacggagtctcactctgtcgcccaggctggaatgcggtggtgcgatctcgactcactgccagctccgccttccaggttcacaccattctcctgccttggcctcctgagtagctgggactacaggcgcccgccactgcgcccagctaattttttgtatttttagtagagacggggtttcaccgtggtctcgatctcctgacctcgtgatccgcctgcctcggcctcccaaagtgctgggattacaggcgtgagccaccgcgcccagccaggatccacaaattttaggaagaagtatactgttttaaaaagttattggccgggcgcaatggctcacgcctgtaatcccagtactttgggaggccaaggtgggcagatcacctgaggttacgagttagagaccagcctggccaacatggtgaaaccctgcctctactaaaaatacaaaaaattagtttggcgtggtggtgtgcacctctaacaggtaggagaattgcttgaacctgggaggtggaggttgcagtgagccgagatcacgccactgcactctagcctgggcaacagagcgagactccgtctcaaaaaaataataaaataagaagttatcaatactttagccctgattcttggttttccttttccccagaaggctgtacattccacaaaaataccatacaatgttgtttctgaaattactgtctaattagatccattggcaactttttttttttaccagcaattaaaatcactaagatctaaggaatatatttttggtgtgattgttcttttttttttttttttttcttaagttaccatttcatggatggtgaaatttgtgttttaacttgaattgtcttggaattcctcagtggaaagtgaaggtttgaaggaaagctgatggcaaatgaaggcattctaagtataagacaaagtaaacaaaggacagatagataatggtggtcccagaggatgatgtcacttaagaacatcaatgctaactttttgttttcttgggagcatggtggaagaagggagaggattgctgtcaattttctttctttctttaatgtaaaagagttgaaatactgagcattttctatgactacaaagttaagagtttaggaagcctcgtgattaactccagaaggtgggttaagatataagcattattttttttgtaaactcgtaagatttttatcattatgctttgtttacaaaatactagtttccaataatccaaactttattaaatcatttttcactccacagatcagaacacacacacatgcagagtaatttcaaaactggaaaaggatttcttcttttcctagggcctgatctctaaataaggaactattcaatgctaggactttggcttcaaagtttggcaaaatgtttgctaatcccggaagcaggttagacagttcaggaaatacaaaagagagagagagaaaaaaagaaaaagaaattaaaagcataagggtagacttatgatcattaggttctcaggtaaccagttttacagtcactggatttccagtaaaaagacagcgctacttaactttcctcacctataggaaatgtacattactggcctctataaacccacatacatcaatataaggagagatatgtcatttcctctaagaaaagctgtttccaatcttctttaaagattgtattccctttattatctgctgtacagattgagcattctttacattttctcctcatcaaaaagtacattcaaaataaatacctactacttgatttttataagttttataataaagagcttgaaatagttacacttcaatatagcagatatatgatatgggatttaaatctaacaggtcaaaactgtttaagttcaatggacattttgggaaccacttgcaatgaaattactgagggtagcggggataatcggaggcagagcagaggctttacatgtggctcacagaatcgatctttttatgtctctgtagttacactgtatacatcatcctggatcacagcagagccaaagtgacaacatcccacagaaaggaaaggcaaaatccctccatatctgtgtacatttctgtttggaaagcctagaaacaaaatcttggaaccatataactcattctcactgcagtgttctcagaaatctgcccctcccaactacttgtcagcccacatagttaatacccagggagaaataatcagctcaaacaagatgattctggccatatgttacttttcaaagatgccaaaactatcaataatctctcattgaagtctctaaaccaaacgaagaacaagaaaaaaaaatcttctgaaaaatatcaagttaattcttctgataaaaatttgcaatagttaagggatacaaaaagtctttacctttgctttctgagatagtaggatctcccaaaggctagaccataaagcagaacagattcccttaagaaccttttaaagtcttactgcttgaaaaattgtcatggccttcaataatgctgagagaaaaatttatcttgctgctagtttaagggactacatttcaaactcttcttaaagaaaaataaaaagagaaagaggacagacttctaggactgctttgaaaagcttgagcaattacttcaaaggaaagggtgtctttgtccagagagcacgtttatgactactgatgcaaatcctaaccaaaggctgaaaaggatacccagtgcatctttatggatggccttaaaggaagatgaacaagtcaaatgagattaaagacagcccaaattctgctgcaaataccagggcacatcaggttttacagaggcacttctctcagtacgtaatactagatatcaataccaacttacagagacaactataacaacctaacttgcatttaagcaacacaagatctctatactaaccacttagcatttatattggacttatgttttatttatttattttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattaaacaccaaaagcagtggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaacgatagactggattaagaaaatgtggcaaatatacaccatggaatactatgcagccataaaaaatgatgagttcatgtcctttgtagggacatggataaaattggaagtcatcattctcagtaaactatcgcaagaacaaaaaaccaaacaccgcatattctcactcataggtgggaattgaacaatggacttatgttttaaaacattaggtgaaatattttaacaccacttggcagaatagcaaacgttttcattagttgtgtttctttggtgccctcgcaacattaagtatatttatcaaacagactccgaaccacttaaaattacacctgaaagaagagaaaagaggaatttctctagtatcttgctcataaatatccagtgagaagaatatttcataaggcctatatccatttaggaaaacaggtgacaatccaggtacaaatagatctgacatgtattttctggcaaacttgtagttactttataaaaagtgaatgaagttcttggtgttttggcgtcatctccttactcttatgaaaatcagatcactttgaaatgcagtataacgttttcacttgtaggttaaatatgttgttattagcagagtgaatcctcttcattccattttctcaataccatctattaggaaatgaagcgggattaaacattttcctattcctagttttgtacaactaaaattatttcttccaattgatacttagtttagatgactcctggctgggccagaaaatcacatatcccacttgttcacccattcattccttcactccttcattcacttaataatatttattgagtttgtattcttaagatatgtgaggtactatggaaataaggaaaggagtaaaacacagccttttatttaaaaataacttgattttaaaggatcattggatctggttttgtcaactgtactataaacctgcaaattataattataaatatctatgcttgtaaaggtcaacataatagtactgaagtccataccacttgtaacaactaattttgtatgcaaaatcaatatttaacaataattaacatgcttaaagaccaccaatataattttcttcattagtaaaaatgtatcatctgaacttttatagaggaaaatcaaaatataaaacctggctttataaaaaaagtaataatttcaatagaaaacaaattaagaaataaaatatatttgtttaaaaagcccaaatacataatgaacttattaggcatatagattatagataaaaaacaaaaatatattatacaatatatgccagtcatttcctaaagacggatacctctattttacatgtgccttttgtaccatttagttacaattgattactacaaaacattcatgtgaaaactgaatactaagctttctcatgcggctcaccataatggtaaatcaagaaaggaaatggctttgctaaagcggaaatgagcttagatattaaatgtttcttaaaccttttccattaacttcctagttttacaatggaaattatactgcattttaattatgcttagaaaaactacttgaaatttgtcctatacatttcatcttcaccaaatcttttcccttcccctattcatcatggtctctttggtgaaaaatcacaatttgattagacatatagactatagatgataagccatagctgcatttagagtacaacaaccatcagacaggaaattttagtagcaacttcttgtaaataatattagaagtattaatgcaagacaagataatgttggtacaaagaacaactgtaagtccttggtatataacatttctcctcttctctctatgatacatataaatgttggtaacacgggaatcaccctctaagactaaggttgacccttgaacaacataggtttgaactgtatgggtctactcatttgtggattttcttctgcctctgccattgagacagcaagaccagccctctgcttcctcagtctactcggtgtgaagacaacgaggatgaagatctttatgatgatctacttccacttaatgcatagtaaatatattttctccttacgattttcttaataacattttcttttctctagcttactttattataagaacacagtatatgatacatataacatacaaaatatgtgttaaccaactttatgttatcagtaaggcttccaagtcaacagtaagctatcagtagttaagtttctggggagtcaaaagttatatgcatgtttctgacggtgtggggggttggcaccccgactcctgtgttgttcaaaagtcaactgtacattagaaaatgggtttatatgagtgtgtacctgcaagtgtatacttaaaagtataccccttaaatgtatatttgaaaaatacaaaatcttaccatgacatgtactgtcataagaactcagtataatacagttgtctttttgtgtctctcgcaaatactaagaatgctttagtgataggattgcatcaacttctctatagctgatattctaattaaatgtatagtttagataactctgacctagactgcctgagtttaaatctaggctccagcacttgctagctatgtgagctcccttgggcaagtttccataattctagtaaggagatcctaaaagtgtcaaggcccagggcagaaagtaaaggcatatttataatttctccatgcctcatctataagtcaaggatactaacagtagataccacacagggctactgtgaagattaatgagttaatatgtaaagcactcaggatggtgcctggcatgtagtgagcacccattagtatcatataagtagtagtagcagcaggccaggcgcagtggctcacgcctgtaatcccagcactttgggaggccaaggtgggcggatcacaaggtcaggagattgagaccatcatggccaacatggtgaaaccctgtctctactaaaaatacaaaaaaattatctgggcgcgctggcgcccacatgtagtcccagctactcgggagctaagtcaggagaattgcttgaacctgggaggtggaggttgcagtgagccaagatcccaccactgcactccagcctggtgacagagagatactctgtctcttaaaaaaaaaaaatagtagtagtagtagcaacagaatgatcccttttttcactctgttataaacactcctttcattgaaagtatatttcatcctatgctgcataaaagctaattagagatggttctctccttgataattcatataaattctgatacaactactaatatttggcagcctagaggctaacagtggggagtgaaggtacagtacagtaatttggtgcattccccaaattaaaatagctttttttttttttttttttttttttaagacagggtctcactctgttgcccaggctggagtgcaatggtgcaaccacagatcactgcagccttgacctccctgggctaaggtggtcctcccacttcagcctcctgagtagctgggactacaggcaccacacccagctaattttttttacttcttgtagagacagcgtctccctatgttgcccatgctggttttgaactcctgggctcaaacaatacccttgtcttggcctcccaaaatgctaggattataggcatgagccactgtgcccggcctaaagtatctttattgtctctgattatcaaggtagtacatgctcattataaaacattcagatacttcagtaaagtatgatgaagaaaatgaaaaattgcttccaaatcccactacctataaataaatgttgctaatatatgtcttgtgatcatttcatactttttctatgcataaatgtacatagaatacaagtgtatacacatataggcataggtacttacatatgtagcttcgtgatcttttacacttagcaatacaaagagtgtatccctccatgtcaatattacaaatttatagtatctttgttaatgcctgtacaggacttcattacatggacatatcattactatacttaactaatgtgcttcttttttcctacttgcttgagacttcatttgttgttttcccatggaggggcttggtctttggttctaggtaagctatggctcctgtagctgcatatgagtgtctggtaacataaacatggtaaaattctaccccccaaaaagaaaacaggtagaaaatttgctgaagtgaaatcttattcagatttgttgcaatgcaacattgtctgatttttatgaatataaattaaaactgaaaattggttttatctatttatcctaaatacccaaattatttaaaattctttataatacatcctccttaacatttttaatgttcttttgttaaaaatacgtaagtaagggactctgaaaactatagaggagtttcatatctttagctattaaacactcctgaccccactcacccaaaggaaataaggcagtctctcagttgtgcaaagttacaagctacaagaatgaaagcttaaaaagctcaacagtcatgcagccttaagccacaaaaggcagaaacaattcagagaatttttttcctatataaaaacacttcaaatccaaaatctgaagtcttatcaaacacattcattttctcacttgaatgtgaaaaaaattactgttaaaaaattaccagataaatgaaatgtaatgatatacttagataatggccctgttaaaagaccaagaaaatcaatttttaaaaatttgttaacacttataaacttctgctctgtaaagcgatataaatgagcatagcacataaaaattgaggtaactagaaaaaatagggtttaactgttgcttcgtaaaaaaaaaatcagagatttaaatattgaatttcatataaaaatggttatcttttcataaattatcagtaatatctagagtaaaatgtgagttacataggcacaaagctgtcgtagaatttctcttacgaaatgagcgtttttggaaggtagtaaagtcagtctactatgttgttccaggaagctttaattaagtgtatccttggtagttctaccaataatgttatggaccacccccccgcgcccacccccaccgccggcacagagttctgcaatattttaaaagcagaagaatcctacgtttagttgactagaaggaatttttactttcttagactaatgccaactattgtttgaaattaaatttcccatatgagcataaagtgtcaagacaactttctttggcatggcactattaaaaaggtctacatatgaagatactcaatctgagggtataaatcatcaattcttctgttctcatatttatatggctataacctatgggctgaatggtacagtcatttttctctgcaaccaaacaaggtaaataaatgtgatatattggcatatcaccccaccactctgcatatggtgcacattaaggttgtattcatttgccatatgaatataattcctttttaccacatctactattagttacaagcagtaaatacagagttgttttgctggaacttgagggcctgcattgcatcatggagcactaaacatcctggaccttctggagaatttcatagacatacttttaatgtcacctgaacttgaacactgccaacataccatttgaaaacgcttcttgataaatgcttcaaggaaaaaataaaaatacagggtagctgtagtgtgacagtacattccaaatgcaggcccagaagggaaggtcttgatgagacacacacaagaactcttgttcctgacaaaggatcagatcaagagtcatatccaggtataaaatggtttcttgtttcaagcattactttcttattcagaatctagtgaacataaggaacctaaacataaaataccatccaaataacttcctcaacggtaacttattgaagagctgtgatcaagaagctaacaagtttatttcatcaccaactgtggtgctttgtttcattaggcaaatattgtgcttgctttttccttacacaaaatatttatcgtacagttgcaaatccaggttagggtagggtaaaaggaggagtaaagtgatttctttttaagaactcatatggttcaacacaaatgtacataccttgacatttgtgacccttaaataatatatcacaggcaattaaaaacaaagtacacctgtcttaaccaagtaccaattttcatgtttcccaacattaagtccccaaatgcatccagcagatggtgctctaggacacctacttacagagagtaatattgtttatattacatccacctaaattttggcaagacaaagaataagaatttatcagtagcttcagtaaaacatactaggcttcacaataaaaaggacataattcctaaatatgtgtacaaaaatatgcatacacataagcacatgtgcacagaggcagccagtaaataattcacacctggacatgttatgatactacttttcttacagacttgatgagtagtctatgtgtatcagtagtatttatagtcacatggcaagatcattctaaattcattaaaaaaaatttagaatgccttaaagttagaattcatttttaattatagcaggaatgtctcattagggtgatactagtaaaattaacaacagtaggatttacggtaatgacttaagtgattgatgagcgtataacaaaatgaagttttagacagagaaaaagcagggcagctatggcatacagtactttaaaaaacagctctgtggtctgttagtgctagccttatggttaataaaaccttctttctaattaacggtgctgaaatattcttaaagaacagaatcttgttgttatgaagaaaagttaggtttttttctcagtagacgccaatcccataaaggagaaagctgacatagattagcatgtctgattgcaatgaggaaaagaaaaaaaatgccacctttcaatcaaatcaaaaccagaatgcgagaatggaaaatgtattactgaaatactacacacacaaatctgtgcaacaccctcacagttagcaaccatttgcttctgaagctgatcgaatgtggctttaaaagatattattcagatatctaaaaatacctaataaacatttaattttttaaatccatgtttatgaatataaaagtgaataaataataactgttttgtatatattcatcttgcttatctaaataagatcatgtcaaagtttaaagtatttatttatcaatggaatgcactggggaacattttctccaaaatttaaaaatgtacagtctggagagcattattctgaaggtgaaataactatctcaggaaaagcactttggtgacaaggctcagtcctaaaacacagagtactaggacaaggagagagagatgccatgctttcatgtacaaaacatctctcagtgaaatattcttggttaatttcattttttaaatccctaattaaatggaatcctatattcatttttcttctcattgaaaaaactgcattccacaggagataattattacaaaacaatagagtcaaagatgaaaaactatctggtatacaggaaaataagccttttgctatgtagtctaggcaggcttcataaaacatttacactttttaaagccccaaattacagtatttataggttttacacttgatcttagccaaaaggctgagaagcgatgtatttataggttttatccagtttgaattagcctgagattgccaaagcagtatgtatattaatattagataatatgatatttttaaaactttgtcatacagctatcaactttacatataacatcaatattagatatggaaaaaacagtgtatgtaggcttatgaccctagaaagtaaaatgactacctattcccatgattttttaaataaaaaaaccctgagatagacctataaaatgcagaaaaagcaataacctggttttcttttatctattttcccttcaagaaagaaaaagtctacaataaaaaatttaaagttgaggtattaatgtgcatttatagaacatattgcaattatatgtatatacacgcttcaccacttcttaaaggtcatttacattgtatctaagaggtacaatataggaatacacataacctaaaacccttcatctgaaaagctctgacttcagcagctgcattgtggaaccatcaatgagccagaggcttataaaatccgaaccagcttgcatgaatgtttgaaacagtttacacacggtaacaatgtctttgtttttgtttgtcattttcttttgaaaagcgtagattgcattttccatttttctattctaatatgtgtaaattctcattataagaaaaagtgcctatttgtctttctcctggattcatctttcaaagctgaagcaaaattaaatcggggcatcagacattatacaggggcttgaaaggataaggttcactttgagaaaggtaatttaattcagtcaagatacattacaattttctaaaatttttattagatgtgctgttatattattcttttattgtttttcttttcattgctagcattactaggaggtaatgtccaccatactgcagacaatgagagggtatagatgaagtacgctatgaaaaatataacattataatatttactctaatgccaacaagatggtgttttgtggtgatttatttgctctaatcatcctgtgcttctgataacaccttaactcagttctgttgttgctttcattttacagacaagacagaaggaccacagcaaagcttggaacttagattttttttttactacaaaccccaggatttgttcagtcctacttaattcgttttttaaaggccatgcatgtaaaaacaatctctaggttgagttacaaagtatttaaacatatgaaaatatatttaaatgtatacatatatcatgatatatatcatactttcttcctttgcgaagagctgaaaattcctaactttaaggcatacttaactttctgaaatgcaatagtaattacatacaagtgtagctaataggtctttagctgctttttagaatacacattggtaatgacggtgtataacatagagaacatgattaagtaaaataaaacaagaaaccaagaacccaaatatctatgtgtgttcagatttctttatgtgcatgaaataccttacatttttaaggcaagaaaaagttcttaaatattttgagataaatagcaaaatggtagatttattatcaattttaaatataggtttgcctgagataattgagtgaatctcggtaactggatttacagaaaccagaaaaaagaaattgaaaggagtcacttattctaagaggacagacaggaagaaggaccagaatattgtgttcatgatgaaaagaacatggtacttttcaaaagaatatgaaaaacaaaatccctgaaatttgcatctttgtaatttctattgtaattacagagatgtctgtataaatgtgaaatacatgtacacctactccccgacatatacacacactacaatttgatcacaaagtctgtattatcaatagcatcacaggcttaacattatttttcatatcctatttgcataggaaattatcccttttttgattaaaacaggaaatatctattagacgttcattgaataaaaactgtatttacctatcacatcaaagtctataatgtacataataagaaacagctttgaaaaatacttcacacacacttcttttaacattatactagcatttgactaaatgttttgaaaaaaaggttcattttcatacaaatattatacatttaagaacagctttgagaagtcaatccaagatatgatggacttaaacatatttagaccatttcacaatctggggtggagtgacagagcaaggaccgggtattcaggtaaagtcatcaggaagaatgtgatccttccttaaccaaatacattgcaacttgccttaaattaagaaactgtaaatatttaagagcagttaaaatgctctaccttctgaagtaaaaatctaaagctattcttgcaggaattctacagtgttgtcataatcattttaattaaattctcatttttcaggtggtccctttaattgttttttcctacttcttaatgtgtttttctaaagccatttcttttctgcagctgtgtgcgattggttttaatggtagctgcttccttttttgccttctgtgaattacaattttaaatggttacacattttttgttttactgccttcagcatagtttcataaagatgtttaaggctgttggtgaacattttcatttcccatctgaaaaaccaagagccaatttgagtattccacattggccttttatgacctgttttatctttttaatacataaatgaaagcataattttatcaagactagtttgtttctatgaaattattatttttattttgttcttttaaaatatgaattcaataaacaaggtaatatgtgattgctcttttatgctgtatcttcatgaataaaaactactttatttggtgacagctatttccaatgaagaactagaatttttggatcataagaatagcctataatatgaaacataagatttcatgcttagattttaattatcaatggtcacaaaattgataatgaggctatttggatcattcttaaattataataaataaaaaatacttgataatcctgtctcacttttaccataacaaaaaggtaactttactgcaaaatgttattctctacatccttgtaaaagtttacttaaaaaatgagtcatacttactgcctgggttatctccaatcccactgcattttccattccaataccacagcaaaagagttgcatcacgtgaccctgagagaatgtagcaatttcccccaatatatgactcagaacgagcaaggcaagtgacgacatcccaatggccaaacaccacttggatcaatcttcctgtaatgcaaaacaattttctttaaaaatgctattaaaaaaataaaaattctagtgaacagataacttgtaaaacaacgaagctatatgaactctgatggtcataattcagattttataataatttgacatggtccaacctaacagttttctttgcatgctaacaagaacaacaaaaaaacaattgaaaattgttaacatttttgaaaggcatgtgttaaaactatttcaacaaataatacttgaggaccatggcactgtatcattacaaatggcttctataaattacaaatgaatcatgtttactgattaaagcaggcccaggagaacccttttggaaccattttaacactttcttgagttactctatatgattcaaaattaaacttagttgcttttctgtaaaagtactcataatttagatgtcactaataaaaacctatttctgatttactgaagatttaatgtatttcttgttttaagtgatctatacaaagacaatataagacactttggagagcttctaccttttcaaatcaggattatatggaaattatgatgaaagaactaatatattgtgattgcaatttgagccaggtgattctttgtcttaattttctgatgaaaattccttgagggtgaaatcaagatggtaatgactggggacaaaggagaggaacccagtaaacttactatatatctagggcttcaaacacagaacagttgttcatgtaaaggtgtcagaaaaaaagtaaagccctcacccttttttgttatttttatttatttatttttttgaggcggagtctcgttctgtcgcccaggctggagtgtagtggcgcgatcttggctcactgcaagctctgcttcccaggttcacgccattctcctgctcagcctcccaggtagctgggactacaggcacccaccaccaccacgcccggctaattttttgtatttttagtagagacggggtttcactgtgttagccaggatggtctcgatctcctgaccttgtaatccacccgcctgggcctcccaaagtgctgggattacaggcgtgagccaccgtgcccagcagccctcaccctttaagaatctttgtttaaccagatatggtggtagtaattcacacaaacttgtctaaacaattaaatagctgtgacagacccccattccatctttagaatttctagcttacatatttcctttgaaatgtctacagagtctacagatgaatgccatacaatgtctacccttaatattcagcatggctttctttttctttaaataagtttttatatttcgattataaaatataattccgatgttcaagaaaaaaaggctactaagctgaaaattaaattaatatgcctaaataggttatgtgtttaacccgtaatacattgtaaacttcttaaaaggttaaggtcccaagtactggcatatcaagtgtatttaacttttcaagataataaatataagataatatttacattaaatttttaaaattcttgattttaataaatctaaggcttattatgaaggctgaaaatttagaaataaaattctgaaatattatctaaatcagatggaaaagtcaaatacatgttttcattcatgagtggcagtcttgcatatagcctacttctaataaatttaaaatcagattcacttcaatctcaagttgcaaaactaatatagtactttttttctcctgtgattaagggagagcagacttcaaagcaagtgtctctagctgctaaatgttcaagatgttcacttttgaatttcttcagccttttaagttgacaccaaaacatttcattaaaaaataagcttatatcaataaagaataaaaaagaatccaagaccttcaagaactaaaaaaaattgagcaaattaaatgtgaaatatataataatttttacttcatttccaatttacatgacaaacagaatgtggaggttcagtggtaaactggcggggatcagattacacgcaggccttacataggataagacaaaagttaggtagctgaaagcagtcttattaataactagaaaatcaaaggttaaatccatgtattttaactactgaaagaaatacatcatatatacatcatacatcatgaatacatcatatagtgatgtgatcatagagtatatatatgacttctgctttagcctatgcctaaatgctgagagcacataaaatataggtgtgatttaaatagattatgtatgggcaggcttatttcagatttgaaacccaacaatcagtgggttgtaggagtgaggaggagtgaaataactaaccaggtacttgaggtagacgacatagaggaaacccaggtgttcttagtgcagtaggaggcttgcaaagaacagctattcacttggtaacttaatttccaactcatgtgaggacaaagggaaaaaatgtagctgtaaaggtgggatggattaaatataggggcagagttttacaagagtcacatggtaattctcatgagttgaagtcactgctctgtttctccaatgtcagtgtaaggaaacatacattcagtcatggtggttccttttcaaaatttttagtgttttgattgttttccaaaaagttatcacaattagttttcattcaacaaatacttagcacctattaagtgccaagcattaggccttcttacctgtatacagtggtgaacaaatagacatggtccctgccctcatagcctttacagtcttgtggggcagacagtcattaaacaaacccagactggtatataattatgaatagggatgagtattataaaagaacaaggttggattaatgacaataacaagatagaacaaatttacactgggtgtcagggaagatctaaatgagagagtgacatttaagcagttacatctaaagggttttatatgttaacacaaattaactttattctttacaatttatactttgggctcaactctggaaaacattatttttttaagtttactttttcctgttctggcagccttcctcagcaatatttgttattgctataaggttgaggttcactcctcctaaataaatcacagcatataaatacctgctgctctttttggtaaattattttctgataatcttataagtgttcctcaacctttattttttgtttcctttaataccagtccacctctccacacactaatatcaaatattaccacaagcactagaatatcccttttttgacagaacaaattttctagttaatgttttatttgacagctgtgctacaaataaaaaaattcaagctcaggactctgcaccactgaatctaaaatgtggcctgaaaataattccgactgccaggggaaggttttattgttgcctctgctgttctggttgtggcccgaaaacatgatttatgtttaaagaatttcctgttacaatccatgtttctcctccctcctccccaatctaataagagaaggatttttttttttggcttgtgtgctaaaatataattgaatttaacacttgtgttagctttgccattatatattactgatcatatgattttcccttgattctgtgctaaacttaagaaaaaatatttaatattcctattgttgtaaaatcacagacacatatttaccttaactgaaattattttaaataaaactagcatcagagtttttatacaagatattaagaaagacaccaggactatcgtttgagattttttttatacaacttttctggtaagtataaatatttttatttcacaagctaagtcagtcccactgaaatgaagtttaaggctattccttatttgtacgttttatacacacaaacacacacatttttaaagacattagaaggtattttgaaagagggaaaagaatgacatcaggtttattaagtctaatgtaacatggcaaacatactaggaacttagtgttacaaattacagcattttcccaaaaaaatcagtgactgactggtaacacctagatgagacaacatgctatgatcacaaagtgtgctacatttaaaatttaaaaagctaggtccaaggcctacttctgtcactattagctacatacatttcaacgaattacataatctctctaaacctcagttttattatctgaaaaatggggataagacacctgtctacttcacaggattattgtgagactgaaacaatatctagtatgtgagagaattttataaattctataaaattgtgtgaatataggattttaattattagtgttatatgaaagtgaagttagctttactttacaaatgttaatactgagtgtctttaaaaaacaataatatagaatgtcaacaaactaaaaacactcaaatgtcaaaaccaaagattgacatggtttgtgattccatttatatgacattctgaaaaaggcacaactaaagatgaggaacagattagttgttgccaggaggttgagggtggggtaaaaagttgacttctagtaggtggcacagggtatttgggggcgctctgcaccttgattgtggtggtggtgaattactctatggtttgcactgtaaaccaaaaagagtggtttacagttctattagttctatattacagtgtaaaattcattttcatgtttaaaaatgttttaatcacttaaaaaatatatggaaaaacaatatgaagtccaaaagaatatttgagaaaaactccaggagtttaagaccaccctggacaacagagtgagaaccctgtctctataaaaatttaaaaaaaaaaaaagcaaaaaaaacaagaaatagctgggtgtagtggcatgtgcctgtggtcccagctacttggcaggccgacgcaggaggagatcacctgaggccaggagtttgaggttgcagtgaactgtaactgtgccactgtactccaactgtctcttatactgtctccaactgtcttctttaaaataggcagaaaaaaaagacatgtccaagactcaaagaggagtgtttaggttcaatagtaatccaccccatagacttaaacatctagtaaaagcccaaataatcaaaaaggcttgaatggtgatgttttctttcctacacctacagaataaagatgcaaactataagaaaaccatgtcatcaattccatataacaaacaataaagattaaaaagatgttcaagaacaaactccttgaataaccaaaaattaattgttctataaactatattaaggcaggagtatggactcaaacattttataaagattattaataagactgaaagatgatttaccataaagcattcaaataactagaaattttaatttaaaagatttttcaattcctacaacattaaataaagatatatgtaggcctttgttccagctgaaatatctactgtcataatatacagtcatgagctttataacacaactttttggtcaacgatggaccacatatatgatggtggtcccatgatattataatgaagctgaaaaattcctgtcacctattgacatcatagctgtggtaacgttgtagtgcaatgcatcactcacgtttgtggtggtgctggtttaaatggacttactacactgccagatgtataaagatacagcacatacaattatgtatagtgcataatacttgataataaataactctgttactggtttatgtacttattatcccatactttttattgttaaagtgtagtctttctacctataaaaagaaaaagttgattctaaaataggcacaggcaaacccttcaggaggtattccaaaaggcagtgttatcacaggagatgaaagctccatgcgtgttcttgcccctgaagaccttccagtgggacaagaatgtggaggtggaagacagtgatattgatgatcctgaccctatggaggcttagcctaacttatatgtttttgtcttcgttttctaaaaattttttaaaatagaaaaaaacctatacaataaggatatatagaaaatatttttgtacagttgtacaatgtgtttgtgttttaagctatgtgttattacaagaattgaaaagcttaaaatcattaaaaagtttataaagtaaaaaagcttcagtaagccaattattagtaaagaaaaaattttaaaaacaaatttagtgtagtctaagtgtacagagttttataaagtctacagtagtgtacagtcatatcctaggccttcacattcactcactgctcactcactgactcacccagcgcaacttccagtcctgcaagcttcattcatgggaagtgccctatacaggtatgccagtttttatcttttattattattattttttacttgcagaagacaatggaatggtttttatctcttataccatacttttactgtaacttttctatttttagatgtgtttagacacacagatacttaccgttgtgttataattgcctacagtatcccatatactagtatgctgtacagatttgtagcctaggagcaataggtgaccccatatagcctaggtgtatactggaatatcccatctagtttgtgtaagtatactctataatgctgcacaacgataaaatcccctaacaatgcatttatcagaatgtatgcctgttgttaagcaacacacgactgtagatcaattagctctaaagaattaagagctcattttaattattttaaatatcaaactatatatttactataactttatttcatcctgtaacaatttctaaaatattttaagggacaccattaaatttctcaacgtttctcaatttcttacatgcaaaaatttgtaaacatttactcagccggatctcctacagtaatactgagctcagcttggtttgtcccttagggagatgcatgtaaatgaatatatagactgaaaatttttatattttaacaagagctcctgtcacacataaaagcaatagtcagctacttttcttcatgatggtgtagatttcagcaagattctaggcagaattgggtggaggcaagatatctactgccaagagttagacttaatgagtctttcaagtaggaaaaagaaaatcctttaaataatacaaaagtgagaaaatacacttctgtgtgtgtgcacttgccgtaagattatgcatatactcatgcatggtatttacataccaggatttgccttcaaaatgaatcatttattctgtaagcatgagcttgggtcacaaacctataaaaaactgtctcttacaaacatgctgtagcaaatttaatagtggactatatatagtagattattatttgaagagggaaaacaatgccctcttctccctattttgtaaattttaggattttgtaatttttggaaggaagcagataagaatgcatcctaagcctctcaatactacttatagtaaactttagttcactgataaagaaaatgaaaattacctgtgtctgtagaatagactctgaaacttttatcccagaagccacagacgagaatatagcggttgtctgaagtgatgacaaagcactgggaatgcacttgaatactttggtctaaaaggtcagtgatttgcctcctgtgcattcctgtattgctggctgtaagaatagggaggaaaaacaactattaaatccacatgggcaaagaaattctatagtgagggagaagaggagacacattcccagataagagtacttgatccttaattctaagtataataattgaaaaaccgagtaggaaaacatatccaattgctggaaaaatgtgggtagctaaattcaatatctcagttaaaaattttgcttagaggaaagaaagaataacacactactatttaaaaatagaacacaattcacagaacatgctttctagctcttgggcagaaccaaactagattacaatctccagattgcatcacagttaggtttgtgtttctgacaatctcattacatttattgtcatgagaatggttcatgttgtgacaatctattacctttaacattttgtcacaaggaagagatattaggatttaaatgtcatatatttgaaatattgtagcatcttgtactactttggctttaacgggtctttaatttgactagatgggaactcccatttcccctgtttacaactgcacttgcatgtaaggaaagggtagaatgactgtttattaaagattcctgtaattgaaaaagtcaaagcacagcagactgccactttcttactccttatttaagcaataaaacaagacagccttggcagtgtgtttcaaagtgctacggtgcacctgagacggggtttgtcaccaagaaaaaggtcagacatagagcaacaccgagcacatgggaagagtaataatcgtccagaaatacaccatcgactgtgccattatcagaaacggaatcttcactgagatgacttttttggcattgaggccaaccaaatagaaagctttgtttctagtgatctaagggttatttcaccatcatctctccagtacaagtaaggattctgatgctgctaaagaaatttgattgtaccagaaatcagaacaaacaaacttctgcatccgattattaagcttttcaccataattttcaattttttgaaaaatcaaacatagaaaaatatttatatgctattcattgtatgtaataactatattaatgtgggtagtttaatagaaagctcaggaagtaaaacagaagaaaaaaaagtattcaaaatactctccagtgctgtgctgggagccactggggacacagaggactgatggatctgttgccctcatggcacacacaacacggcacacacgtacacatacatgtgcaacactgcagaaattctgctaatgtctgtggacacaaccatttaagattattggataactgtttgataatggaggcttcatatgcttttggaggattaatgggctagaaagtgacagcagtagtgaaaagggcagaatcctagttgggaatcattttttccctctccttctaacaaagggaagttgctggcagataataaaagcttttgtggatatcatagtgttactacagagagacagtgtccaccaacagcaatcaagtatcccattgcaatgaagttgtatgatacaatttttttttaaattccaagaaatctagcaattaaaacaaggtatgtggtactttctgcactggttactgcagtactttgttccacatgagagctgtaaacatgtttattcttgtcagtgtttatgtgacttttgctcctatgatataaactttcgctgaactttcttgggggattgggatgatctcttgggaggacctcagcagatttgggcatgtacataattttgaattgagtgaccacaaagtacccattggcaaaggcttgatgccccctcagcacacacatgaactattttctaagcaagtgcttacttgtaatttaacattgccaagtcccccatccagctaaggtatatttatctagataagcagtcttcaaactagggtatgcatacccctggaggtgtaagacttcctaagagatacacaggttcagaagttaataccagtaattttctaattcctcaactttaatatattctactgcttgaaattgatttgcctgagaactctcctgtgagttttcctttcttacctcttctttctcacgcccttcttctactagataaaataaagacatatttcccttccacacagaatcttactatgtgctttagctgagtgtaatttcttgcccccaataaagggacaattcaaaatactgaggtaatactgaaaagtgaatgtataagtatcaaatcattctgcaagtcaggtggtttccaatttactgctttcaataaaatggaataaggatccaatcatgctgtcaattggtagataattaaaaataagttttaatgatagactgttaaaattatagattacttaataataaaccataaaaataactcttaataatagatcactatatgaattgccactaatgcagagagttcaaagatttgagtggtacagttgaaacaaagctctttcccatctattttcctaagtgagtaacactgctcagaggttccatctataaaaacaagtaagatagacctgctgatgatgtatttttaataaatgttcattttatgtaaataaacatttattaaactttataatataattaaataaatacattaatatttgtaataatcactcaatacagataaacttattttaaaggctgagccttatggtcataggaaattttaaaatttaaattgaacacatatgcttaattttgcaaacacatttttatggctgaaaagcataatagggtaatcaattttttaaagttaacataaaattatctgggggaagtagaatgaaaatataaattcaagataaaaaagtaataatgtgaaatttccatatgttaaggggttttcaatgtattttttagaaacagaaaatattgaatatcaattcactctgatatttagattctactggatatattaaaattttgtttactgagtatcaattcactctgatacttagattctattggatatattaaacaatttttacactatgccagaatgtataacctttgcaactatttgaacttgtgatgaaaacttttagatgtcaacttaaaaattgtctgagaggatacatggttttaaataattcttttaggaggtagaagtgtaaagtctgttgaccagtgatctagggcagggacagcaaaactagggccaaaggctgaatcctgcccatgcctgattttgtatatgtagttttattagaaaagagttatgttcattcatttcttttttatttatggtggcttttgtgctatactggtagagttaagaacagcttgagtttcccttatctgaaacacttgggaccagaagtgttttagatttcagatttttttttcagattttggaatattttcatagattgagatatcttggggatgatagccaagtctaaacacaaaattaatttgtttcatatagaatatatataatgtatatatatatatatatatatagcctgaaggtaattttatataatattttaaataattttgtgcctgacataaagtttggactgtgtttgaatgtgacctgtcacatgaggtcaggtgtggaattttccacttgtcttgtcacgttggtctttaaaaagtttcagagtttggagtatttggggcttgggatttgcagattagaggtgctcaacctaaaatatttactatctggccctttaccaaaaaagtttacccatgcttaccctaaagggttacaacaattgatgaattcatttaattagacttgatagcataggatattcattgtcaaggtgcaaagaaaatgatgggtctaaaattcagaaataatgctttaaatgactcagcaaatgggctttattattttcctgacttttaaactacccaagtgagcattttagtttttttaatatatggcaaatcatatctactcaaaacaaaacaagatttaagaaccagagtggtatttatccttcatgtagataattacgtattagatttctgattatacttggggaaatgataaatgaattggtttagagcttaaggttatttctgttcatcctgatagtctacctgctaatggtagccatttagctctccattgaaacaatgccttttaaagacaaaaatggtaactatataaagggaacatcttggattttaaaataataaatctgcttcattcatatgctttctttaaaaacattaaaattctaacaaatttatttgtgccaggaaaatctgacaaaattacaagccaaatatctatgccgatagcattacaccacaggtaggcaagtaagtttttattctaaaagttattaaataacatcttcaaaatcgaggcttaacattcttagtgatgccacatttgaaatccccacacgtaaggatgaaaaatgctaaactagagatttcgactaatctactcaaaaagcctaacagcaattaaatattctaagtcatctgctgcagatgctcatttcatcccaatggctctttctggtcgcctccctatttttttctcccctgaacaaatttaacctccaatggcaatttattgggctgtaggaccctaggaaaatgaatacaaatatcttaacactaccattggctgggcaatatatttcaactttgaaactgctctgcaattgcacattaatcccctcagactgaacagaaggtctaggaagaaaggattgatctcctttaatgatgaaaccctggcactacagttttatttttcataacgcagtgctgctaagaaccccactgttattatgaaaattttcctagcaaaggagctccatcacattaccggtgcaccaattcatcataacgtgccttgctcctgctcatcaacaagtctgagtgatgaaaagatccaatattatcctgacagtacttcatgcgcattctcaatcacacattattacagcatccatattaattttcagtgacacgcgtcctaggcctgttcaaattaggcaaaccaacgagggggagttgatgaaataccagcatagccacagctcattgcattccaatttgcatgcaaatggtttatcaggaaaattccattcccagcaaccagcaagtgaaaaacaactgtaatctacacttcagggccaccatacagagcttaatgaatcgcaaagagagaaggaagtgacagacctatgagaggatcgatttccactggcagctggtatggctggtcttgtacagcaccttgatgagctggaattcacaaaagataaagaaaaaaggcattattttttatatactaaactacataaaaatgcataagtcaaaccttatgtagaattgtttccaatctctaaatctttcatgcagttttgtgaaatttaaagaacaaaaatccaggtgcttttatggctagcttattaaacatttattttagattagtgccgctctgaactgtgccatcagcagtggctccagtcctaggccataagctatagcagatgcttgactggcaacctctgatgctgcaacaaaacaaaattaagtggtaaagcgcactgaaaacaaaatgtgacaaccatctgctgactgtagcaaatactatttttttgttacttcttaaaaaggcagttttgaatgctacagcacaaaggatctacaaaaatgtcaacttatgatggagaaagggaaagctctaagtcagggaacatttagtgtttcatccatcacttaaaatcaatcaattgaaagtttgaataaaaataaagaaagctatccgcagataaatgttttagttaaatgcatttggctgaaatattttcttaaagattggattgagggtttaaaaagaagttttattaatatttaatatttccatggtttcaatttaaaaatactctgagaaggagatgaataacaaaaatcaatctatcctaagaatactttgttcaattctcaaaatggttttaaagattcaggcatacttattttataattgaagagaggttttgcaggctgtttccctctgaaagggagaaggactttcggtagagaggaagtatatcaggaatcaggaactacctgatgcaaccttgtgcaaatcataaaccctaaaacagggttcagaatagattatcttttcagcttcatagttctgacagttaaattctgggcccttttccaaactattttccccaaacgactcagccattcaccctgctcagtatctactttttatagactcacaagcattcacattattgcttggttggtattagagctctgcttaatgccattgataccggtgggctaggggaggtccccaaacaccagtgggacctcaaccctggctcttgacactgtggtgagaagaaactcaaggacaagtcagaaaatagtgaaagtatggagatttattgcaaagcaaaaagtacacactcaaaaggggagtgtgggtgtactcaagagagagtcgtggacaaggggcgttggggttcctatctttatgggtttctgttaaccaaggggtggaatgttcatgaagattcctggaaaaaggtggcaatttctcagaactgtggtgccatccatttttacaccaaatatgagtgctcctggaacggtcatggccctggtgggtgtgtgatttgtatgttaatgagcatataatgaggtcctatgtgaaacctagatcaaactcagcaccatgttgggtccagacagtctcagccagcttggcctgcaccctggttttttcagggtcttatcagatcttagcttctgcagctatttcaacagtttccttttgatagtcaagaaactgctgcctggaattttctattctcctgtgattaccatatattattcctgtcttaccataagattttaggaaatctatctgtctttgaggggctgaaaataaatatggggtacatttcaataagttcattagattattttatacttactctgtcatagtttctccagttagtaaataccaactttttaaagatgtttggaaggtcattaatactgataaaacacctaagtacagtattggcactagaaattacagtatgtataagaaactaaagtagctgaagaaaagaaaccacaacggctcttttaaaaaaaacccaaaaggtatttgtctttgctgattactgtctctgctggcaaagaaatcacaggatactcacaagggaggaccaggaaaaatgcactacagcctctggtctacccaatagtgccacttacttccagcaataccagtgtcaatcaacattaatacctttagaatttccctctacttctctgataatctgagatcttagaaacatttaaaccaaactgtcagtgaaatgggtttaaggaggtttgctgatgcttcaaatcctacttctgccactgactggctgtatgaacttggtcaagttatgtaatctctatgtttcaatttcctgatctataaaataggttagattgaaccatatgaaattgccaataactgactgttttgacctataaaaaaacgcgatttcatatggtttcaacctaagtacagaacctacatcctcaggttgttaagaagattgagttaatacacataaaatgattaaaacactacttgaagaggcatgaaagtttatctactccagccatgttttgccagtgaggacactgagcccagggagctcgccttattctgcatcaaatatgcccagtcagtggcagagtttgagcccaggttttctcactcggattttatgaccacctctcccctctttcattagagcaggaaagttgggacctggattcagcactgttctttttggccaccagttagaattttttttaagaagaaggaaaatcttagaaactagaaaaatgctctataaacatttgctggtgttattctaatttttggaggttttcaagatcctttgaatgagaagggaggttaaagattatttattttctaaatcagacactactcaaagaactgaggggaaccagctgtctaatgaatgagctatggaaatcatagatcctcagaaaagaaacagaacctaaaattaaaaaaataaatattgtaatatggatttgatatttaccaaagaaaaactgtcagggatttttgatgtttgttttaaatcaaggcatagtgacaggtaaaggtagcaagagatagaatgaaaggttagatttatgtaaacatacctaaaatgaagcatagacttaatataataaacgcttaatattcttagttgcaggtgcagctcaaattggagatcacattctagaaagataactgcctgtggtgtattcccatatgttatcgctttttgtatttttctggtgaaaagttgctgtgtcatactgtaaaggcagtatgtatggaaagggtgaagacaaacatctctaatgacatggttatagacacaatgaaagctcactgaacagaaatataggcaagattctgcagaaccttgcagttcccctagctatcttacagaaaggtgagccaggactgggaacagttggatgcatcctaagtggtactccagcagtgagactctacccctaaatcactttacatatttatttatagaaaaattggaagtggagaagataatacctgaccactaggtattaagggaagcaagctttgtagtgagggacaccagcttgctggaaaggtgaaagccagaagcttagtcatcaacgcgtagggtcttaaatgcttagggttatcagtgctaaaacttgaaatcagctggagaccgaggagccctgtggttgagccagctcagttcccgttgagccagctcttcctaggctaaagtaaagatgggggcagagtacagtcagggctttccagcagttgcaaggtttgcccctcctcacatctgatgtcactctgtttaaactgaagaagctctcagggctgccacaaacagccacccaggataagcatcatcattggtggtcctgaagtcacacatgctggtgcaaagctctaagggtaaccgcacatagagtaggtaaatcctctagtgtatttgatagaacatatcaccagcatgtttttcttctaaaaagtgtttagagaaacaaaaaaatcacgtttcttaaataaattgtaatatttagtcccaaaatataagtatgttattttcataaatatttacttctgtaagagaagtttacttaaagaaaaaagaataaaaggacataataatagagatattaaatatctgcctccatttttactgtctctaccttttctgaaatctattttgtagtcaaatattggcatttatttgcatcgtttcatttccaatatacccaggaaaatggctatatttaatcaattctaataccaactacagattctttgtggtaggtataccttattgagcttagtcaatgtaccaagtttttgtttgaatgtcaattctgttcccttgtgaaagctgttgcatttaatttggcatgaggtccttgttcaagaacttgtatttttgcaaccatttcaggtattctaacgagcagtgctttatgcacacttcagagatttaatgacaatttcatgaactattaaaatgtatcttttaaatttgcctacctaaaacaacggcttgggaaaaaagtctataatctccagaagtttaaaagattttccttcttcttaaaaaaaattctaactggccaaagagaacagtgctaaatccaggtcccaactttcctgctctaatgagagagaatacattacagaggggtggtcataaaatctgagtgagaaaacctgggctcaaactccgccactgactgggcatatttgatgcagaataaggcgagctccctgggctcagtgtcctcactggcaaaacatggctggagtagataaactttcaatgcctctttaaatctgcactgtttatgattctaatggttatttcagttgagcatgactgtgttgagcatttaatggaagaacagaaggtacttacagatattcaatattttggctatgtaatttaagtgttcttttttttttctattatcctcaacaaatactaccaatactaccatgccaagcacaaaaaggtacagtttctggcacataatagacaatcagaattgtttactgtggctggacatagtggctcatgcctgtaatcccaacactttaagaggctgaggcaggaggactgcttgaggccaggagttcaagaccagcctgggcaacatagcgagcccatctctacgaaaagttaaaaaaaattagccaggcatggtgctgcgtgcctgtagtcctagctaatcaggaggctgaggcaggaggattgcttgtgcccaggagttcaaggctacagcgagctatgatcacaccactgcactccagcctgagtgacagagcaaggccttgtctctaaaaacaaacaaaaatttgtaaaaacccaagtgtttattaagtaaaatgaaagtaaaaaagagaaacatttgataaataaataaatatatactgtttatggacataatatagaatatcattatattaaaatactatattagaaacaatatttatctccaagaataaagataaaccaccagaagctaaaaagtagtttatgtttttaacatttgtactatatgcctcacgtgggccttttttaagcctttcaaactattaaacaatttgattcagactaatgcttgaaaattaaaagcttaaatgttgagatatgctatatttaagtgggtattacacagtgttcagcagttaccatgccttataatggtatttctttacttaccaggaaggttgtgccatttgttcaccgcaaataacctgttagcagtgactgtgatcacagcgggagttgccaaaccaggctgggtgttggctgccacgtgagtaacaggggagttggagggaaacttgaggaccatgataacatcctgctgggctttgtctgtgaacatcaatggactctgcaggaggagatactgttgagtgggcatgacaagacccaaatagacaagaaggaaaagatgaagaaagacaagaaagagagggggtgcaggaaaagaagaggaagaccatattaacatgagttgtaagtggaagcacagtgagcagaaaggcttgtagaaacagcagtcatgatctgttattcatgtatgtcgttagttggaattttgggggactgaagtagaatacattaacagaaacactttaaaatttataaattttatgagctccctttccctccccactgccacgaaaaactaaaagaatgatttgatttagattctacacaggcaaagtgctggggattgcattaaaccattctggttgctatcgtgtcacataatgatcttttagcactaaaaaaacagtaagaatggacaacaggcataaaagcaagacaaggtaatttccaaagatcatcaaaagttgtgttgagttagcaggaagattttgacaactacaaagaggtaatgaaaacaaatacatttataaacaatagttagactgcatgcatatattattacagtagagaaataacttatgaacgtaatatacaaacttaattataaaggtgtttgaaagcaatgcataaatgtacttgtaaaaacaatatatttatatagtgtaccaaatcataaacactgcctattgtaatgcaaatgctactgctttctgctgtagctaggaataaagagaaatacctaggtgttcctcttccctgttggttaaaaaacaaacaaaactagagctcaagacttttttgatttctccttcaaaaaacagagtaattgaaaatgttaaatgaaacactgtctgttctaataaccagcaaccaaataaatcttgaagactactaaggatttggaacattcttacaacccatatgtcataatccaagacatatataacactgctctgatttattggctttatttatactttgtggtggtgtgctatcatacagtaattgcactgtacattttcagcaattctctcctaccatgtctgttttctaatagctgattagtatcattcagaattgaaacactttgatgaaatgcttctggctgctttccttctgccatatttcaaaacaccaggtaatatgtaaatgtggaggcacatatatttaacacatatttattcagaactggtaataaaaaattaaatacatttgcatttttattatcagtccttttaaaaaagttattaagagtacttagaaaaacatattgcactaagaattcctatttgcactctttgcataaaggtgtaaataaaggcaactaataagctacccggacacccttctgagcaagtggctaaaagccaatcaatattatgagttaatcctccctggatgctcattcaattaaaggtgtcagtaatgcctcatctgatgtggcctcaattaagtccaactatctgatggtgtgaaaacacagggggatacagcaacagcagcaaaaccagacaaataggcagccttcgtgtgcctgctaattactacacctggtgtatattatggttcatgcacttaacgcagcacgaggtggctttaatttctgctatatttgtgtgtgtctctgtgtgtgtgtgtgtgtgtgtgtgtgtgtggggatgcattgatggttgatgggggagctcatctgaatgttactaaaaacaataaatatgtggcctttgatttttaaaaccctagtatcactagtttttgtcacacaaagaacgttttatatagtttttaaggaattctgtgaaattaggtaaaaatgagaaacagggagcaacatgaaggaaaatatcccataagctaattttaaagaagtcctgggaaaaggaaatgaacatcatttccaagtaccaagtcttatttttcaattatgtagtttttaaataatatttacgaaagtcaatttataaactcagagaaaatcagagtacaacataatcataaaatctcactgaaaggaagtacatacatatttctgagcttaacagctcatactataaatataattaggctcaaattgaatagttccaatgtttatgcccttaaaaaacacaaaaaaaatctctcatgtgtaggaagaatgtcttgtttacatagtgactctggtgggccaactctaagccacacggcaaggaccagccaccttccacagcaagctgcagacaccatgtccagaaatgtccactgccttcgtacaaatatctgtccctctagtctgctcctccataccccatcctgactagagctcctgatgcaggcaagtagcaggaaactctcttgggcgtttcatcatatatccttggctaaaaagcatgaatgagaaacaccagaaataagaaaaccataccccacactactaggctactctgcagtgacagcagcagctgcagatgagcagagcaactggtaaaacagggataagagaaacaaagcctcttttaatactgggtacctctgtgagccaaggctggggtacaagtaggaaattgctagccaggtttcatcagttttcccagattaagtatacatttgttgacaactctggtttctttttaaactgccttttccccatgcacatatggacaaagcgaaaaacacaatttgtgcaagtctgaagaggagttcaggtattcaattcagaggataaaggtaatggaaaagacggcctcccatccttatatgagcatgagccttccccgccttctcaccctcgggatagcaaagctgctctgcctgtatgagccaataagcctctgccatggaagaaggctgggcagtgaccccagcagaaagtcaatggagcagaggaggtgcttccatttgccagcaccaatgcagcctgagtctcaatggcaagctattactaaagctaattccaaatgcaaacataaatcattcttactatttttatggcactatcttccattgttcttgctaaatgtttgctatctatgtagtcttctgcccactaaagtcactcttcacgttcatctaaatctgattttactgatttaaaaacatgtaggggaaagagtgatgcaaacaatttttaaaatgtgtatagcttatgatggccaattcatactgctagataaagaaggagaaaaaatcttggaagaagaaagaaaatgacaaagagcacagagggaaaaaaagacacagaaggtgatgtgggaagagaaaggaaaaaaaaaaaggaaaaaagagccagaggtagcagggcctcctctctatttcttactttcttcactgctactctttccttcccagtatttatcaaaattctgctatctctacaccacaacatggaatttgactttatataattgttaattatatttacgggaacagactttgtagtttctattcttaatttaaaacagcaatgagcaacttctttttatgagggacaattgaaaaacaatatgtatagtctattccttaaaaattattttaatcacgcacttcaatttgttactctgccaatttttttttcctcattgaagaattttccccctgaaatttcaggaactataaaggtaaaatggccaccttattttgtagctcaagtctatttccgtacccatgattctgggctgacttttgacttgctttgaccaatgaaatgtggcataaatgatgtgtaggttcaaaagcaagcctcaagaagtctggctgcttctgtctgtcttcattctcatgggactgctcctaccatgggagcggcctggtctagcttccttaaggatgaaaggccacatggaaagagaagcctggctacatcagcccacccccaagcagtgtgtgagtgaggcgaggtgaaaagagcagaaaagattttcatctaaccctcagaatcatgagaaatacaatacatgattgttttaagccactaagttttgggtggtttgttataccaaaccatcatttttctcctcactgtggtccctgaccttcagtaacaatatcttatgtattagaatttgttttaaaattcccaaactgaaaaatatattgggatgtaaagaataaacacaacagcaaaactaatctagaaactcagagaatcaaaccagaaaagtcatcaaccctatgtctggagtcctttatcctacagtgaggattcatgacaattatggacctttcaattctgtaacacaagacaccaactgatgaaatacaagagcactggagcaacatttaccttctcaaagattccaggagacaatgcaataacatctgctggttgttagcaggttaacaaatattgcataaaaaaacaaacccacatatggtggagaaactcaagcacaatgaaagactgttatgaatatcaagcggatctgaaggagaggcaagaaatgaggagagtaaaaatagcacttaccacttgcatggcagaacctctgggaggatggggctctatgagtagttgagaaggagtctgtccaaaacttcggatttgagcttcaacagcctgaaaagggcaggggcaagtctgaaggttaagaggtgctaattacaggaaatagaaccccaactgtcacctgaaaatatcattccatactctggcttgtttcatgctgaaaatcaacctgtgttttcacagtggggctaaccacctggcaagggcattgagggtgaggtcatcatttagaaccgcagaagctgttcctctaaaactctgcaaaactttctcatcttgctcagtgatatgaaacagaaaccagctattacaatcagaaattgtcctttttggcttcatctctgttttcttgcacttggttttcctgcttgcatcatccccaatgatgaaaagctaatcttttacaggtatagagaaaaactattgcttctttgattctaggtcccatttcatcctggggagtaaaaaggaggaaaaaagaaacatagcacctgtgaaagtggcttgatgctatattaattttgccataggaagagcattattgttgactgtctctttgaagttagacaactaaataacaaagtaaaagccatatgttgcatctaagcatgagatggttaaaccagggagtcactaaacatgaggaacgtgtgtatgtgtgctctttttgaaagacgtgtgcttttgcaaggcactctcctactatggctcttggtgcacacatagcacacaaatgcccatttccatcaccaaccacccatcatgggaaactgctaaatgccaggtgctatcacatctgtaagcattgtgtttacttgtttatatctgtttcttcccagtaaaatacaaaagccatgaaagcaggaccttatgtatcttcttcactgttagatccctaaattggctgaatgaataaatgctacatgctgggtgaggggagagaaggaagcaaacacatataaaggctacttcgacactcccgtaacagtcagtatgcttaactcccaggctaaaaggatgaggaaaaccctcaaattaataagaataaaaattggagccaaaaggaagtgaggtagggactaggatcattttcagaacatcatctcaaatattttctgatagagtgaaattaatttatgattaaacatcaagaacaagcttgagaaaaaaatcataaaatgggaacctgaaggctaaaggtagtcacaaagaaggaggtagcaacactgctaatttatgatatatgaacttatggacttagtttatgaatgagaactttatatctttttgaagaacagctggtaaggatgggcatgatggctcacacctgtaatcccaaaccaagacaggaggatcgcttgaggccaggagttcaagaacggcctacatagtaagaccctgtctctacaaaaaataaagaaaattggctgggtgtgctggtgtgtgcctcaagtcccagatacttaggaggctgaagtaggagaacagcttgaggccaggagttcgaggcagcagtgagctatcattgcaccactgcactccagcctggacaagagtgcagcctggacaagagtacagcctgaacaagagtgcactgtacaagccagacctgtctccttgacagttgccttctgtggttcctgcccggcagcccacatgcctccctgattaaaaggggagggaggtggcaaagaacttattgcttcagcacttggcctatcatgtcagatggctcagagtgctaatcctgactgtgacacttatctgctgtttgactttaggcaattagcttatctccgtttcccatctacaaagagatagtaacaatacctagttcacataattgtttggaaaatgaaataagataatgcatataaagtgcttagcacagtacctagcacatacaaagcactaaataaaatgctgtactgtattattatttcatgtgggagttggtgtattccccacttaacacagctaaaataaagaaggaagaaatgcctcaggagtttatgtaggaagagaatgagaaatacattatttaagaaaactgaaatctggcttgggatttcaaaatataccacagggctaagagcctagagacagagagatttctttggaggttctgagagcagtccaaaacatgaggaattatacacctgggtccttatggaagctatggtaatagtaacaaagagatgaatatgtgaaccagctaaggaaaaatcaacaggtcttagggactgatgactttgagcaataaagaaaatacaaaactaattccttttcttaaaaaaaaacttgcatgtttcagagaatagtaaagcaatgagcagaaataggaatacaggagtttctgttagggaaaacaagtttggcaggagaaagacagtaaattttacgtcagacacatggaatccaacgtgatagtgataaccatttatctaggtcagtatgtccaatgtgtaaaagcctaagaatggctctgaggtgagagaagagaggtattgattttggtgtcattcatataaaagagaaatttaagttacttttttttttatctttctctcttgttgtatatgtgtgcatgtttttaagcagcagaaatgacctcctttttgaaatgaaatatcacatgaaacctcaatacatggagatagggttattcaactttacaggggtgaaaccatccctaacaagcctcctcatcagcctctgagacaattctgagaattctttagggctctggagcacagtttgaaactatactcgttaagccctaggatgaaaatacatgagacccagacacaaaagcacctagagcagaacctcaagaagtatttatatttagggtacaaatgaggaagtaatgaagaagacagagagagggcagtcagagggtgggtgggaggaaaagcagcatagagtgatatggaagccataggatgagggttttgaagagagaatgggcagtaacgccaactatgatagagaagctatgaatgatgacattgtagcatatacatctttattatagatacaaatttaatataactggccttaatattacatatagtgttttgcacttaacaatgttttgagatgaaaggttatggatgagacaacttctgaaaataccaatctcctctttttaactaacttaactttaatcttaacattttaatacaagtggcacattactgaaaactctgaggaaaaggcttttttaaatcacgtaatatagtggtctgattattctatctcaatgacagaataaaagctatagtctctcacacaggttaaataataatcaattttctttccaagtcttgaaggcatctgaaaaggctgtggaattctcagacacaaatgctttacttcttaacgaacctttcagttcttgatattaaaaatgcaacagaaaggactttttcaagtgtgaaaattatagaataagattgtaaggtaatgactatgatctcaaaactttatagtcacactgtatatcatcaactgataattccagttctcctccttgtttttaaaattcatttgccatttttcattcatcttaatctctgaagcaatttacagagattctcccttctgtggcttcaatggcttaatgcttagactggctctgtagtctactcctttaatctctgtcttttgctgacttgtcatccataaataaatttattactgtgagttctcttttagcactatgattcactcaacttaagcttgctttcttggaaattttttctactgggcctcaaactctgcccctatctgaaaggtttccagtcctatgaccagaggattgcccactcccatgaagtttgccctggccatcttgtgtgtaagcacatgtatgtcttagcacatctaaaatcttaaaatactattttttattttagcatttctcagtcaagaattagattcttctgattttttaaagctcagaatcttgtctacattttaaaaattttacctgtttcacatataaagtcactaagcccaatcacttcgaagtttatcacattcatcactcctttctgaatctaggccccttataatttcaagtatcgattattataacagtctctttgctggttttccccctctattcagtttctgcctccagcatatcctgcagaactaagttttcccaaactcgcctttatgcaatatttctctgatcaaatgtcttcaagtgattccagtaattaaaagataaaagctaatgccaggcattgcaggttttcctatctctctaacttttattctctcattctatctattaccttataccagtgttccttttcagtcaagctggttttcttctacaaatataagccatctctgccttacattttctaccatgccactgaccctcctagaatggtcactcttatcttcagttttctaagttctactcctctctagaaaaccctgtttgagttctaccaagtttccctaatcttgttaaataatattacacctgttcatactgctcattacagtatatacttgattcagaatttcctgtaatgttatttatgtctgtcactacaactacactataaggcactggtccccaaactttttggcaccagggactggtttcatggaagacagtttttccatggacctgcttggaggggtggatatggttttgggatgaaaccgttttacctgagatgaccaggcattagattctcatagggagcgtgcaaccgagatccctcgcatgtgcagttcacaatagggtttgcattccgatgacaatctaatgctgtggctgatgtgacaggggtagagctcaggcagtaatgcttgcccaccactcacctcctgctatgcagcctggttcctaacaggctgtggctcggcggtcagggacccctgctagaagggtctgaataccatatatgtgcaacaggtggaacagtaccttgcacatagtatttagacaacaaaaaatttactgagtgcctgttatatagcaagctagccaggaacccttatggctcatctatggttggactggggacaaaaccaagcttgagagatgagcacacttcttgatgagggctgactgaggttgcaggggaggataaggagtgttaagtaaaggctggtatttgctattagaaagaaaccaaatgagtctctcagggaagctctgaaagatgtcactaaaggcagtaattctcatttcttcagatccagcatactggaggataggacaacactccattgtctcactatagtagtaattcttaaggtcaagtgagaaatcctggggtaatatgtatgatttgaaaaagtccctcaagtgattatgtttcttgccttatcttcacttgcctattcagccctctatatagagcaataaaaaatttaaaggcataaatgaggtgtgaaataacaggaaacatacaagcatccttaaaccctgtacggttcagcaaggtgggttggtaatagggtagcttaacagacattaccaaatgcctcaactgctcttaatgaactctccttcacctagagagttttggtgctaggtgatcactttttagacattcagttatgtaacattttttgttatggaataggataatgaatccccacatatccattagccaccttcaataattattaagacattttggctttaggttatcttaaagtcgggtcaatctagacaatgtcctagatagattcattgaaaattaacagagtgcttctgcctttaaacaatttattttttttaacttctaatgcaagactatactgagaataaaagtatcttacaatgaccaaaaatataagcattagctggcagccttcatatttcttctaaggggctgaatatactcagacttgcaaggagatgttcaatccttaagttgcaaatttgattatgtgactcaaagccttccgttccaaatccttaccctgggtagcaccacagcataggattaagtatgcagacactggaatcagacagcctcagttcaaatcttaccactatcacatattagctcagtgattctgggcaaggtacttaaccttctgtgccttaatttcctcttctaaaaattgtgataataactgtcaatattttattgagttgtgaggattaaatgagataatataaagcacttagaacagttcatggcacatactaagctatcagtaagtgtgtgatattattacagcatatatattaaagacttaacacagtgcctggctagggttaagcaagcactcaataaatgttaccaactactcatctttaagatgaatagttatctagccccaaccactgtccatttcaccactctataatgtgacatataatcaacatcatattgcctttaaacccttgtatatattttctattccttttctctgtgtggtttctttcctcctcattcttgaagacttagctcaggcatctctggcctctgggagatctttcttgacctcacccagactgttgctgtccctccctttttgctcttgtagcaacatgcataaacttttactgcctatttatctaatattctaattactggtttaattttccaacttattgatcagactataagtctcctttagatcagagactgcctaatatttctgtgcttctacagcttggcacatagtaggtgctcagtaaatatttacccagtgaatgtccatgcaaatcaacttaatttaggagggatgcagctaagaaatgcactactaccacaatcacagagcagtctagtgttgaataaaatattatattaaaacatttcaaaaaaagcttgctttattaaatattcttattcatcaattcccaattatttctgtaaatagcctgttactactttctataataaaacctgaagtcagcaggcagcattccagatgttgagatatatagtaataaaaaagactatgcaaatacttcaagacattgcagtaaaaccacatatttatattttataaacagcatctcaaatattacctagagaatgtattaatggatcttcaaatggaaatattatgaagagattttcaacaagctgtgtattctatagtttttgtgtgtgccaactatttcatacttgcatgattttatagctatatatagaaaaagagacaatatatatagagagaatatacatacacatactagacagaatgaaaggaagaaagaaataagagataaaagtaaaggaaagtaaacttggcttagtgacagtgtagtatttggcttcaacttaacaaagactattttagtctctctgacctaggctttttaatctaactgaggaaacaagttaactcagtacagcacttagtaaccaacaataaatattgtaaaattttatttaagatgtagggtaggggagaaataacttaaacatatggacacaattaatatatatgcccttttttttaagcacacaactctgatattgtattttatcacctacatatttacatctgaacgcactataaaattggaatagggaaatagagacaaaataatttattaagaaaagatatgtcatttattaatatattaaaactttctcacattaccaaaattaagttcaagaaagctgctgtaagattctaatccacctctttaccaagaaatgtttaagcattccaacaagacttcatagattaaattcttttcaatatttaaaaagtcacactaagaccatccagtgatgtctactgtggtatcataccattacttgtgccagttttcttctttcccttcagatgtttgaacttaaattgtagaacacttgctggatatttgacaggtttctactcaaagtttactgtctagctgactagcctcagtgtcctttggaggtatggttcaactttagcttcgatatcagttaagtttaaaaacatattaatcaaatgactacttaatcatgatatggttacgtttgtatttaattcctaaaggaaaaaaatcctgataatattgtaactgctaaggccaaaaaaggacccatagcaagtaaatatatttggtaaaaatgggatgaaaatcccaaaagagaaaatcagagatgtttggatgacatctctatctggcttaaaagaaagaaaggcaaagcatcattagaaacatttggaaaccagactcccacttaaccttaggaaagaaatacaaagttattaatagtttttagttgtcagagcaataaattcacaaaattaaaaagtagtataatgaacctaactcaaattatttaaaaagagtcttctaagattaaaatgtaaatattttaaatgcctgagaaataaaatacagaattcaaactttataaagcataaacataagagataaatagtttttcaagaaaatggatacaccaggatatggaatatttaaaactcaagcagataaatgttcaaaatatacagcagaggatattttcaatgaaatttgcaaaataatctattaatacatagaagagtaaatgaaattcaacagaagtgattctatgtaaatttggacttgaaagacttaatgtttttagttttgagaatgcagacataaagacagatatctaagaatttagataaaagtcaagtttgtatgttatatatatgtatgtgtatatatatataacacacatatacttacatgtgttatgtgcatacatacatacatatgcatgaacacttgcatgcaaaatctggggggtatattccaaactattatttgctattttctctgatggaggaaggatgaaaagattggcagaataaaaatttatactttcctcatttttataccaattgatatcttacacaaagcatgtattatttttgaaataagcataacaaaacaattttcattttgaaaaaatctaaaagacaatttaaaaaaaaaggtctgcaaatatttggtatatcattattaagttttttttgttttgtcttggttttttttttttttttttgacagagtttcgctctgtcacccaggctggagtgtggtggtgcaaccttgtctcactgcaacctccgtctccgaggttcaagtgattctcctgcctcagcctccctggtagctggaattacaggtatgcaccaccacacctggctaaattttgtatttttagtagagatggggtttcgccatgttgtccaggctggtctcaaactcctgacttcaggtgatccgcctgcctcggcctcccaaagtgctgggattacaggcataagccaacacacccagccccacttctatgaattttcataaggaaagaatcagatgaagacaaaaagatttagatataaagaaagttattatagcactctataacagtaaaaattggaagaaaaaaactacttaaactctgataatggaatactatgcagccattaaaatgagttgaatacacctgacatagaaactagttcataatataccaaagaaagaaaaatttctaactaccaaagtatatagagtatgaccttatttcagcaaaaaatatatgtgtatgtgtggctgtgtatatatatatacacacatatatacatatatatatacacgtatatatgtgtatatatgtgtatatatatacgtatatatgtgtgtgtatatatatatacacacacatatacgtattatatatgtgtgtatatatatatatacacacacacatatatgtatatataaagcacttagaacagttcatggcacatactaagctatcagtaagtgtgtgatattattacagcatatatattaaagacttaacacagggcctggctagggttaagtaagcactcaataaatgtttttgtttttgtttcttttttgagataggatttcactttgtcacccaggctggagtgcagtgatatgatctcagctcactgcaacctctgtttcctgggtgcaagcgatcctcccacctcagcctctgagtagcagggagccacaggtgtgtgccaccatgcctggctgatttttgtatttttgtagagatggtgttttgccatgttgcccaggttggtcttgaactcctgagctcaaatgatctgcccgccttggcctcccaaagttctgggattacaagcctaagccaccacgcctggcgaagccactgtgcttggcctttatgaagtttaatttatccattaacataatagcaagaaatacatatatttttaacttttattttaggttcagaggtacatgtgaaggtgtgttacataggtaaacttgtgtcctgggggtttgtggtatagattatttcaccacccaggtattaagccccgtacccaatagttatcttttctgctcctctcccaaggaatattctgtaaccatctaagaacaacttcagttgataaactggtcaaaaacttaaatctatagaccttgctataaaattaattttgttaatattgagtttacttttttaacttatctgtatctgattccaaggatcccttagttttagcaatttttgccatcatttagtattaattaaatacaaacttgtttaagtaaataatgtgttttcctccaagaagcactcagaatgcatcaggtaactggaaacaaatacatatcatgatggaatggagtacataaaaaataaagagaaagagcagcttgttaaataaagtaaaacatattttaaaataataatgcaaagaaaagggggagaaggaaaattagggagggaaaggagtatttatactagcatatctactcaaataatattattatggaagttactaatgtaaaatatgatgtaattataatttgtgaaaatgcacacagatttttccattagtgcctgtaacggagcccgtacttttcaggcacattaaactgagtcccaacccagcctcactacaatctccagttcttgtagctgtccatctactacagcataatcccagctgccaatctgaaagaaaccagctagtcagagcagacacaaccaacagaaacaaacgtcactcaataatgttcagcggcactgtgttcatggataatttcaaacagtatctctgtctagaacattgatgtgctcattcaaaacacctccatctctggctactggaaatgagtagataaagcagcctgcctagaaaaataagtggaatgtcttcaaagaggttgccaatgctaagaagcaaatgttgagaaaacacagtaaaggtcttaaaggaaaaaaactcaacaatatccagagagttaattttcacattaagaaggttaaattatttctcaaaaccaaacaaatatgtttaaactatgtcatgaaaagcagcagtcattggttattcatttgctaagagtgacctagatgaagtaaagatggtgcctgaaaggaaacaggggttcatgacaaaagtcatcagtataatagaacggctcagaattctgtaggtagttaataggaaaaaaaatcataaaaatattaatattttgcttcatgtccttgagtgtataatttagttacacctaacttaactagtaagtctgcaaaagacataataatgagcaaaatacaaagagtagctttactgacaactttgatgctcatttaattgaataagggaatttttgtctgattattgtggttttgaagtaaaagaaagtctggcataattttatggtattttaaatgtaggttttcaattaaaacctgactaatccttaccgtttatttggcttctcattgtacagttcctgccctgcactgtgtcaaatatgccatctgtgtaacacacttttggccagaggtacttcatgattatttctataacactttgaattgtggctgcatgaaatcttaacttcggtattcaatactcctaatttactatattgctacaaccactgtaatcgtgtcctactcttaaatctcaccacagtcacaacaaagattcttgcgccacctgcttgaaacaggcttacagaccactcccccaactatttaacaaatgttaacaatgctataaatactaattgtgtttatgctttctgaaagattcactgcagccagtgttctgcagcagtgttggagctgctgactcccaccaacagactgatggaattctaagccaaaaatgcttttccttggataagatatctgatttgctactgctgtcatgaaactggggtcatgtaaacttaaacactgctgctgcttcttttggaaaacagacctcagagtgattacgcatagctaagacagcatttggaaggataaatttggaagagggaaaaccaaccactgacactaaacacaacttagggaaaattttcaggttttactttcatgttgaggtcacttgtatacagtaattctttaaactgggcaatatcacggctctcccctctcccctatttatcaatgcaaatagagctgagttccattttcaaaaggaaatttaaaactttaattaatttctgaactcacataaacataaaacaatgtatttacgtgaaaagtaaagaagaaaatgacacttttagaggaaatgtaccaagtacttataacaaagtacaagatgaaaaagcacagataatattgttcatattaaggttgtctgacagcaacatctacctgcaagtatctttcagcctttgaagccccaccccttcttccaacctccagtgtaccccaagatctgccctggtgtcccttatacaacaactgctccagcctctgctgtgtttgtacttttcctttgatcaaaacctactgtccagtcttactcacagacagccacatgattggaaaggatttttttttaaaggatttgtaaccaaataagtgatctctaatggtagaatttcaggcattaggaaaggacaatgagttctgtagcagaggctttttttctttacatacacatcaaagtgcatcaaagaggaacttatagctagacattaacatgtgactctggcattagttaccaatttgaggatgagagctttctagtctctcactttatactttttgtattatttgactcttgaaatagttaacatgtattgctttgataaatacatttttaaagcactttgtataactatttaattatacacacacacacacacacacacacacacaagtagtgaacccagagttctagaattcaggaatcttaagccaaaagccttcttgcttttagataatgacaaaaactacaattaacagcgatacacctaagatattttccctgaaagtagaagtgttctttgtgctctccctcaaatatgatgggaaaaatgaagaaataaactcaaatgttaaaaagtatgaaaactcccatagctcagtggattaaataacatatatagaaaattaagagattggaggtactctgatttctgagtgagataaaagttaagaaattgtaaattccttcattcctgtcaaagttacacgaagatcattatagacggtcagtaccctaacaacattgaatgttgagaaagaacatggccaaaacccagaacgcaattacaaaagacctctgaacagccaaaaacgaagtcagtattcatatcctcatgttaacatacattgcttgttcaaattttcaagaagcagattctttccccctgaaaagggagaaagagttgtgtttggctttttttctctctctgattttcaagagacataattttttagaatatagaaagaggcaaattaaagaattccatgatctcattaaccaaagataatgaccatgaacattttggggtccataattccagacttttcctcatgcatttgtattttatatgttccataacattgtctattattcactgtaatatggcaaaatattcttccatggtaatacatatagatttacacagcaacatttttgatgatacacagtattctactgtgtaaatttaccaatatttaattaactacttctctactggaaatttacgttgctccttttcctttttttttttttttgctattatgataatacggtttggctgcgtccctacccaaatctcatcttgaattgtagttcccacaatccccacatcgtgagaaggaccccgtcggaggtaactgaatcatggtggtggtttcccccatactattcttgtgatggtaagttctcacgagatctgatggttttataacgggcatcctccttcgctcagctctcattcttctctctcctgccgccttgcaaagaaggatatgtttgcttcccctttcaccatggctgtaagttccctgaggcctccctagccatgtggaactgagtcaattaaacctctttcctttagaattacccagtctcgggtatgtcctcatagcagcatgagaacagactaatacatatgaactatataactgaatatttttttcacacttggtcaattattacttttggttagagttctaagtaaatagtacatgaacattttaataattgatacagattgctataaagattcaacctattttcatcctcaccaaatatatgacagtatctgttttctcatactgcaccaacattaaaatttttattatttttaatcttagataatctagtggacacaaatgttattgtgtgttcaatttaatgtcattgattaatagtgaggatgaactacttctcttactgggtcctgctctttgcccaggctggtctcaaactcctgggcctaagcgatcctcccaccttggcctcccaaagcattggaattacaggtgtgaaccactgtgcccagcttaaagtgcttttcatatgtgacttgcatttcatctttcatgagttttctattcctgtactttgttatttgttgttgctttagatgtacagaaacatccttttcatgtagtgtttatacgtgaatatattaatttccttaaggatttttagctttgatattagacttacaaaggccttccccttcatgtaatcaggaacagaaatgtcagtgtgacaggacacatcgatgaggaagagaacagacgacatgagatcagggaggtatgcagggccagatcatgtgagtcaagcagattttattctatgtttgatgtgaaataggaaagtttaagaaggaagtgaaatgatctgacttacagtttcaaataccactttggcagctcggtggaaagtggactgtaggtaggcagggacagaaaaaggtgacctggtctactagcgttagtccagtggggagagtatggtggcggcttgaactaatgatgaacagatatgaatggtttccaaatatgttttagagatctcaccagcctagctgctcttttgagacagagtcttgctttgtcacccaggctagagtgcagtggtgtgatctgaactcactgcaacctctgcctccccagttcaaacaattctcattcctcagcctcctgagaagctggaactacaggcgcataccaccacgcctggctaattatttgtattttaatttttttaggaacagggtctcactatgttgcccaggctggtcttgaactcctgccctcaagcagtcctcctgcctcagcctcccaaagtgctgggattacaggtgtgagccaccttgcctggcctatcaccaacttcttatgctctcccttcctaccacacgattttttcaagtcatagagccatactgtgctcttttccacatgccatactctccgctttgaatgtcccttccatttcttttgcttcactgacttaactcaaatttcttaaggattatgttcagacagttgatactttcttaacctgggttagaaatgtctcctttgtgctcccgtattcagtgactgtcacattgccatatatataatatatatatatttatttacatacacacagacatatgcatatatgtgtattttttaaaaaaatatatttcttacctactaaacttcatcaatgaactatttcatactaagatactaatgtctagatagctttcaacctttgtatattgcaaatagcatttatatgaaaattaatgggtgaattctggataaggatatagaattgttctagaaaccatgcctatagatatgattatactttaaatatattaatttaaggaaaatacttatgttaaatcttttagaagagggaaaattattttataaaatattcatcatgtatttaatttgtggatttcgattttaagagaatttttttaattcgtaaaaatagttattcttactcatatctgaccctgagttcaaatattctaatttttatcttttttgaaaatttcttctttccttgggttttacgtttttcaaaaatggggttagaaaggcttaataagattgtgtttgaaagaaaagacatgaatgagccaaatcaaaatcagcagaataatcagaaaatgaccaacttttatttatttgtcccttatctataaaagaatatatgtaatattgaggaactagaatagattaaaaaaatgttaaaggcagtgaaaaaaagaatagtgccaaaatacagagaaataaagaagagtaaacagataaagataagactatattcttaagttggggtcacaagatattttttgaaagattagcatatttgtccgaaaaagaattctttctggtgtgtgatatatgtaaatgcagacatagttgtatattgataacccagctgttttctaaaaattaaaaacaacataaaagtttaatgtgctgcaggctgtttctctgattactcttcctcctcttatggttattatttctatcgtttagtgctctttttatagagagattatttttatgatcacttactatgccatgtgtattaaccattcattataaaatggaaactttctcaagaagaatggcgcttttcccaaaatagtaggtgattacatgacttgtatgtacacaacttgcctctgtatgactgggaacgtatttccagactgaattaagtgtatagaagtgaacagaaataagtaaaagtatagctactgaacagaaattagtctaatttgcttttgatactggaaaggtacaaatctatccttgtaccatgattgtggttttgcagaaataatgctttaatataaatcaagcagatatacaaatgtgctaatattaatgatattaaagcaccttagagaaacaagattctgaagaaaagagaggcgtggcctggaggtgggggtggggagtaaattagtagaaggcaatagtgaaagtttcacaactgacatgaagcctgtgacaagacttgacttggaggctgtcccaggctgggcactgcagggacatgcttggctgtgggagagcagtaggagctaactccctggtgcccttgtttagctgtactccgatcctaaagttttaaaggaaacactgtttatgaagacagagaggcagtcattaaccatcccttctaacagttctccaccctcacagcactttgtatcaccttacccacttctattttctttatagcacttgttataattgaaattacagtctttaaattttattttctgtgtgccccattagaatgtgagctccaggagggaacagactttgcctgtcttgctcatctccacatttttagcatcctgaacaaaacgaatatttgttgaataaatgaattagtaatgaataaaaggataaactttcccagtttatcactcccttccttcctttcttatctactcaatccagcccaggttcacgtttcatcttttctacaacatccctttaacagtttcatcagccacccttgcaccttcaatcctttttcatacatttcaccatacttccatggcaaaccccacctgtgtctatctttctgtctctctctccacaaacacacaggcgtgcacacacacacatccctctctgttcaacttttttctacacctattctcctgatgttgaaaacacagaaaaacaatattgaaaggaaattataattattgagcagcacccattaagtataaatattatctcatccttagcacaaaccctcataaacagaatcttgttgcctttccacctcattcatacacatttacttacacaagtccccatgctatccgtctactctccaatctgagatgaggccctattgttccctcctgttcagtgcttatctctatctatgctctgggttttgttcttctccactttcacacagagcttgatagtgtattacacactttctctcctgcatgtctgacatgcttccctccttttggatctttcccattaatatagaaacatagtccaatatttactcattaaaaaaaaattatcctttagagcaactgctggcgcatataaagatttctttttgtggtgacaaaaatgctcttaaattgtggtgatgcttgtacaactctgtgaatatactaaaaactatcataaactttaaatgggtgaattgtaacatatgtgaactatatctcaataaagcttaaattattttctttatttactgtgtttacttcaacatctcccattcataacacaatcctctactttctaagctatttctctaagatcaccaatgacctcttagaaaaatccagtcagtactttttagttcttatttgttcaatcttctttcagattctaaacaaacatattagtaacatggggctatgtcaccaaccttcagtggttccctactgccttatgatgcagttaaaagtattattttttaaagatagggtcttactctgtcgcccaggctggagtgcaatggcaggatcatagctcaatgcagcctccaactcctgggctcaagcaatcctctcatctcagctagggctatatgtatgtgccaccatgcccagataagtttttcatctttttgtagagatgaagtcttgctatgttgcccaggctggtcttgaactcccagcctgaagccattctcttgccttggcctccaaaagtgctggaattataggtgtgagccaccatgccctgctgaaaattatgttttatggtattgaagactgtttaagatctggctcctgtgtctctctctctctcatctgctaacctttacttcattccacatataccatattctctagccatctcttttatctatgtgcaggaagggtatgcagttgcctctgtgtaggtaacttctgctcatgactctacccaatgatcttattcatccttcaatatgcaactccagcctctcattctctggaaaacatgcctggattctgtcagtttgggcttagtacctatcctatgcttgtgcatacatacttacatatatttatctctgtactgaatttatcagattatattataattgtttagttacacttattttcccattagataatgaactctagctgagggagggcagggactttgcctttcaaccctttaaccttattacatgattcgggtttagtaaaaggttgttgaaaaaatgaataaattaatgacctattcatgttttctgctttcttgcctcacttaacaatgaactcagcatgcatccactaggaaatggtctctgataacttctctagtgttaatgttttatgattctttctatgatctaatcagtagttcatattccttttatagctgtgttttctaacccagggatttaactgtgagcaacataagggaaagaactaacacttgctgagtacttatgaggggataggcaccatgccaggcggtttacatgcattatatgtcatctcatcctctgtagagtgggcattatcgtatgacttctatatataggaaacagagtctgaggaacacaactagtaggcatcagggccatgactcaaattcaaatttatttatttgtttgtttctttgttcattctattatatcaaactgcattatactataggatttagcactggtaaatggtatgaaaaggctataataaaagactattcccctcaacctttttttttgagacagggtctcactctgttgctcaggctggattgccatggtacaatcatggctcactgcagccttgacctcctgggctcaagcaatcctcccacctcccacagcacccaatagctggaattataggtgtacaccaccacacccaaacaatttttaaatttgttgtggagatggggcctcactttgttgcccaggctgctcttgaacccctggactcaagtgatcctcctgccgtggccttccaaaatgctgggattacacgtgtaagccactgcgcctggccccatttattttaatgatattcagaaagttttataaattaaatgtgtgtatttattttaatagtgctaagtaacaaagcgatatattctcatttcaagaatatcaaatacctaccatacttagaatatcacaggccatgtttaataaatgccaaatctaatacagaatatatattatatataagtctatataatgtataatataaaaacaaattaaggtgtgatgtgtggaagactatcagttaaggcttaattttctcataattaactacttaggattgtggtaaagaaaaggaagtcaaacttaaagcaaaagttttaacggtctttagcaaaagttgatcataaaaaataaatattaaaaacttatctgtggccgggtgcggtggctcatgcctgtaatcccagcactgtggggggccaaggctggcagatcatgaggtcaggagttcgagaccagcctggctaatatggtaaaacccgtctctactaaaaatacaaaaattagccgggcatggtggtgcatgcctgtaatcccagctatccaggagactgaggcaggaaaatcacttgaacctgggaggcggaggttgcagtgagccaagattacaccattgcactccagcctggcaacaatgtgagactctgtctcaaaaaaaaaaaaaaaaaaaaaaaaaaaaaacacttatttgttatgatgcttcttcaaaaagttaaacttggaattatcacataatccagaaattccatttctgggtgtatatccaaaagaattgaaagcaggcatttgaacagatggtgtacatccatactcttggccacattgttcataatagccaaaagatggaaacaacccaaaatgcccattgatatataaatggataaacaaaatgtggtatatatatatacacaatggaatattactcagcctaaagagaaaggaaattgtgatacattctatagcatggacaaatcttgaagatattacgctaagtaaaataagctagacataaaaagacaaatgttgcagcattccacttctatgaggtattcagggtagtcaaatttatagagataaaaagtagcattgtaattgtacagggactggggaggaaggaatgaggagttattgtttaatgcttagagagtttcagtttgggaagatgaaacatttctagagatggatggtggtgatggctgtacaagaatgtcaatgttcttgatgccactgaactgtaaactcaaaaatggtaaaaatggccaggggcagtggctcaggtctgtaatcccagcactttgggaggccaagggaggcggatcacttgagttcaggagtttgagaccagcctgggcaacatggtgagaccccatctctactaaaaatacaaaaattagccaggcgtggtggcaggcacctgtaattccagctactcaggaggctgaggcaggagaatcacttgaacccaggaggcggaggttgtaatgagctgagcttgcgcaactgcactccagcctgggtgaaagagcgagactctgtctcaaaaaaaaaaaaaaaacaaaggtaaaaatgttcaattttatgttatatatatttatcacaataaacaattttatttgaaattataatgtgttagtttaggtgaaagaaaaaatataattgagcttacacctatattcaaatatatatctaatgtctacatggagtattcccactttgaaatatcctaccaagtcaatttaacatttatttttccattgtctgatcacatatgctgaactcagagtaagaaaagatggtcaaagacaaacataagtcttctaactctctgctgtacaatgctgtagcctctagtcatctgtgcctatttaaatttatattaattaaaattaagcatttagttccttagtcacactagccacatttcaatgtacaataactacatatggttcatggtttattagacagtgcagatagagaacatttccagcactgcagaaaattctagacagtgttcttctagattaacgcacagtaaacttccttaaacaatcattggtgtgtaagtggggacagtggtcaatccagaataaaaataaaaagccaagcacatagagtgactcatagaggaaataactagctgattgagtgtactacttgttaactagccatgacaaacagatataggccaagtgacatttttaatcatgaaaacattgcgtaacctttaatgaaaagtagagctacttatgtcatcttggacataccaagagacaagtcttttaagtaataggatcttgcattgagagaaacagtgttaagcatattttcacagcaactctatagaacattacagaatttcaaaattagaaatacggagattgcatatagtgacacaaaaaatatatactggcatagtaagtacaaccaatttatgctggtacaaaaaacaatatgctggtatattaaatacaaccaatctctttttaagaaattataaaatcagttctacagtgagaattcagttatatatcagctatgtagagatatggataattactacaggataacaggagaaaacaaaaatagctggtatatttgttgaagaattatgggcatttaacagaataaagtattacgttcaaatattgccaaaatgaacaaaaaaaagaaagtaaataggcctatgctattttatcccaacaataaaactatgcagtgttttgtaacactacctgtatgttgctctcacctcaatacctttatggaatcctatgtatattctgtgtcatacagtcaattgatgttctgatcaaataaaatacccccagaaggagtattttcaaaaaactgaacaactggaagagtctttaagagtttatgtgacccaattctctgctaccacagtttttaaaactgaaacatagcaatttaaaacttgggcaatttaatgcaagtgtacatctagtacacagtgcttttgtgtgcatgctaacttatctagcacataagccaggtgataatatgccaatttatttaaatatgtacttacataccttccgcatgatcagatcttagtagaactataaaagaatgcatcaagtgctagggaaaaatggcaaatctcacacattacaaataatgttcccttcaaagtgatatataacttgccccatgaatcaaagctcctggtttcctaaacgcagttgtgttctaaaattgtacagattaaggttgtatcattcaattctataatttttcatatgaagtatattggaattagaaggatgcataattagattagaaatactaaaaaaagtaaggtcttctacagactttttggtgagtgctgcatttgccaaaatcatgttttaagtgttttacttgagaaaataaatgacaagaataaaacaagttcaataacatctaacaacaatttgatcacataggaaagatttggacttcaacccccccattaacttctatgtggttatatatgttcttaggtattacatataaatatgtgttttatcacatttcaataaatttatgctcataatcatatctctttaatgaattattactattttcctacaaaaatcatgagtaacccccaaagttatataaaattataaataagattatttataccttaacaggttcaaatagaaaaagccgtcatcttatattgggtcaaacattttgttggaaggaacctctgggttcaagttcttgctaggtcactgataaattattctgcttaaggcactttacatctagtttcactttcttcatcactaaaatcaaaggatgggggaggtgttctctagctccttctagtttaaatatacctgactataagttgctttctcaattcagataacttacctctctcaacacaggatcagttattgaattcagattgacagctccttcataggtcaagtaatagaacacattgagggctcggacagcttctggtccttgctgtttatagccaaaaatgagatcaatccattggtgaagctggcaggaaacaaattcactctccagggcctgaaaaaaggtatacattgtattactatgctgaattcctttttaaaaatatagagagacatttagagcaatcagtaaagtttaacactaactttactgtgaacaaagatttttaaaaaacaaaacttgtggccgggcgcagtggctcacgcctataatcccagcactctgggaggccgaggtgggcagaccatgaggtcaggagtttgagaccagcttggccaacatggcgaaacccggtctctactaaaaatacaaaaattagctgggtgtggtggcctgcgcctgtaatcccagctattcaggaggctgaggcaggagaatcgcttgaacctgggaggcagaggttgcagtgaaccgagatcacgccacttcactccagcctggaaaagagcgaaactccatctcaaaaaaaaaaaaaagaaagaaacttatctgatgtcctagtttctaccagaatctgtcctccttggtttataattagaggctttccggcacttggcataattaattacaataaatgtgtaagtttcagtatttttctaccgtactgacagcactgaggaccaggactgggcctatcttggtcacatttgtaactcagggcctgacaggtactcgatttatgcttcaaagaaaggaagccatacaaggcaaagactattttgggaaactaaatgtgaaaatgttaaaaatttaccatccacttgaaatatttattatttttctagaattaaaatattttgtagtctatttcaacatgtttaaccaaattatttagttatgttgattgagttcttatgctaacaaattagattttgtgggggatacctataattactgaatttttattctaggtattaatatcaaacctgaccaaatatttgatgctattaacataatagtgtccaataaataacgaatgaacacaatcaagtatttggttgagatgctaggcacaagatccatttcctatccatcattatattcccagctacaagcgttgtgcctaaaacataatagatgccaataatgtttggtgaatttaataacgttataaatactaaagacttttaaaaactaaagatattttttaggaaactatccatctttatattatttaatattgttcaaaatcattccaacatcaaagtttagcattatggattagtttaacgataaataattatattaaaatcaaagagttttcaaacataaactctaaagcttaattaaaagtatacagtaggccgggcacggtggttcatgcctgtaatcccagcactttgggaggctgaggtgggcggatcacgaggtcaggagatcgagaccatcctggctaacacagtgaaaccctgtctctactaaaaatacaaaaaattagccgggcgtggtggcgggcgcctgtagtcccagctacccgggaggctgaggcaggagaatggcatgaacccaggaggtggagcttgcagtgagccgagatcgcgccactgcactccagcctgggtgacagagtgagactccgtctcaaaaaacaaaacaaaacaaaaaaactatacagtaatcccccctcatccacaggggtatgttcttcgaagacccccagtagatgcctgaatctgtgaatagtaccaaaccctatacctatatgtactatgttttttcctatacataaatacctatgataaagtttaatttataaattaggcacagtaagagataaacaacaataacaacaaaattgaacaatgatatactgtaaagaaaaaccataataaatgttatgtaaatatggtctctgtctctatctcaaagtatctgattgtactgtactcacacattttcagaccttggttaaacacaggtaactggaattctggaaagcaaaactgtggataaggaggagactgctgtaccaacttatatctggtaatgtatctcattgaaattgatttttatttttagagtagtaagtctatgattgtgatgtattttcagtatggcttgctgctatgttataagagatctgttggttttaaaacaaaactgaccaacttgtatagcaagtaaccaatgagacataaaccatcttgtgacaaaagacgttcctattcctttacatgtggacacttgtgtaaagatacgctttattaaaataagtgcctatgaaaaagaaatgtttatagctaaatacaaaaaaaatttcctttaatatttaacatagctttatgatatatcacaaatataaaattgaaaatataattttgtaaacaaaactctatgcaattctcacatcccaaagtatactttaaatgaaatatgccttaaaaatacttagctaggttcaattgagaaagttattgttttagacatctcttctaaaatgctttacatttacaaatttattaaacagatatgacagcacaaaactgcttcatattttacttgaaataagaagagaggagcttgtgataactttaagtaaatgcctattttaagtacataaatttgaaaaaaatctaggaactactaatgcaagttacacacagaaatgatacgttggtttcattaacttagaccttgggtagggatgggggtatggggtaggcacatttacaatgacacataaaaacagcaattgtcttaatttgtgtgcagtgcactctacacaaaagccctaaatatgttcaaattagagcaagctgcttgattgtcactgcagtctcatgtcacattaatgcatgacaaacattaaaccatacacttaaatggcaatttatatcatttaaatgtttactgccagactagctcatcactcatttaaatgtgactttctgacagctaatttcagttaattttctccaattcacttaattagaactttcaatcagggaaggacctatgcatatcttcaggcttacatcctttttggtggctgttcgaaatctgagttcataaactgccgaaaagctctactataatagattagcatataatatctctgagtttacaaaaaatatgactctatgaagagtatatactcacagtatatactcttagaaagaacttatacttatttatgtaaatagtactcttgccagtagtttaaataaaaaacgtgtagttcatatacacacactattgaaacaataaacaaaccctgcatccaagctaattaaaaattaatgatttcaaaattgtttaataagataaaacagtcaggagtctcctgagtgtccatggtgttgtgatttgagaccataaaattctagaaggctcagcaaatgacaaagtacaaatgaattttctcaatattaaagctctaaaaactagggcaattttattttatgtgtcaccaaacaaagaactgttgaattttccttacggttgactacttctttatgcacactcaaaatggtaaagttggttagatttcgatgcttaaagctttacatcttgatactgcatcagaattttaagcaaaaatgctgaaaggaaagctaccgtgtgctcatatcatgctgcaaacacacatgcagagatcaccacaatgccatggttcagacctcaccttacattgtcataggtcagtccttaaggagttgaccagtaattcgcggaactattggcaaaatcacttccagaagttgataaacacgttaccttcatgaatatactttaaataatttctcaaacactcaactaaaaattccattagtcagcttcaagcatgtcttgcaatataccaaagctttaaaaagggacctaaaagaacaaagtggtaagtataagagaattccaagaagtttcaaagtcatttcagtacaaagtcagctccgaactttaacatccttttgctatcagtgaatgacaactgcctaaccaaaagtaggtaatgcacttaagacttgaggggagagagaaggacaggcaggaagaaattaagggaaaaaatacaaacagaatgtaattcaaaatggaataccctgaggttgccttttataactcccatttttaagatttaaaaacataaatcataaaacctatattaaaatagcttttttatatattaagattttttaaaaaaattcttcatatatagaaaattctcatttagatctacatttttagttacaaaaaaatgaaaaatgccagtggaatgctgagcatttgagatttttcaaagccttcaaaaccgacagtcctcattaagcctggagttaaatacggtttgcagctaggggatagtaacattcttcccatgctgctctcaaacctaaccaatcaattgttagtactcccctagcaggctgcatacatcacttacatccaatgtgtgctctgagtaatatttgtaaaaaagaaaatccactaaaatgtccaacacaatataataatattcaactcatctgagttattataaaataaatcagtgactaatgtccaattgttaaggatcagataagactatgaaaagactatcatatgaagcctcacacgaatgttcaatccaatccagggggactcatattagtgttgacaaactgtcttggcgctgatatctgttttttttaatgagatctattaggcagagtaaaatacttcagatatgctaaaaagtacagtatacagatgtcaaatacacttattactaactttcatttgtttgttctgcatacagaatatcaacaaagttttaatattataaagataatagtaaattattcataaataggaggtttgtataaccctgtgtcagaaataattacaatatgtgtgtgtgtgtgtatatatatatgtgtgtgtctgtgtgcatgtttagcaaatctcactgaaagaacacaatctatgctttcctgaaactaactcacttaagaaatagattatttctttataaaaagtgttatataaaattattattttctatagtggagtcaaaaaatgtgataacatatagaaacagctttttccaagaaactctaagctatttgagaataaaaattctaaactaaaaggcattaactatgtatttaatctacacatgcattagtgatacactagcaatttccttttattttcaaaaaaccaaatttttgccaatgtaaaaatcaagaaaaccaatttcaatcaacaaaggaaattattagataattgtttacctcaagaccaagaaaccttatttgtttattatttatgtttctcatacttgtcattcccagcttaatgctaatatttacttattctttggctaaacattctcataccactccattaaaaaaagaaactaaataaaaactagcaatatctatgggataaatgatttttataaaaagttaaataaaaagatcaaatattctttatacactttttataaccagagagaataggcctaggcagcccagaaatacatttctgcacacctgtaccactacttccactcccaggcttctagaaggcccaaggtacaaaggttctgagatacaaaataccatagctgtaagtttcaaatgagaaaatgaaaatcactgattaaccctcctgacttgaaatacatttacttataagatgtatttaatcgtatttataatgaatgaaacatccattttgtaaaattttaattgtacttataattaagagtcttaattcatttgaacatagataacagtatgttttaaaggaactgacattgagattggcaaggcggtaatatacaaagttataaacttggaattttaagtatttttcattttaaatccatgtaatacggccttcttcctatacaaacacatatacacacagagatttaaaatgaactggtctgttatgtttgcatgtgttggatttcaaacactagtggtaatgtttccttaacattgatatatgacctttgtaatttacattgaagaaagctgtttttttcagcctaattagaactgtttcaaattttcctgctaaatatatgatataaagtcctttcaacttttttattctagagtttctttccatgtcaactttgttccaatcaaaatatgctttgaattaaatgattttgattgaatatgtggatcacatttcacttctaagatgtaaagtccaaaaaggaaaagtttagcctgttcaaacaaagcaagagcagccactttgcggaaagctattcacatttaagaagactgacaaattgtttgtgtgcaccattaggtctagtttctgcaatagttgccagatttcctgtccccctaataagatgcattaactccttaaatgctggctctgaatttgcagtgaatctgagttactttagcaaatttcaattttatctataggtaaatttccttatttgaaataaatctaaagaaaataaaagaaaatttgatgttaactatgttgtatcaaaattttctaacaaaggtcacagaaaattaacattttttcatattggttggatataaattcagaatacaaatatgttttctatatgtgacttgccagaagtgacaaattcacatcaatcctcatttaaaaaaaatgcatcaatttcactaatttaaagattacatcttcaggtaaaacacaatggaaatatttaataaactaaaatccatgaatatgagcatcaatttcctccacattgattatatataaaacacaatgcttcagagttcagctatttaccttaatatacatatatatataatgtgaaacaagctttatcctatttacaaagaaaagtttaattttgagagcttaaaaatatgtgtgaaattgtgacattaagatcaataagtcatgaagcccaagaaagtaaaaatggaggatcaaagatttagggaaaaaactgtgggatgctaagaataaaaattgtatcagacagttttaaaaaatgaaatttagtcaacaacatactgaagttcagcctgaaaagcagatagagaaatcactaaaaggggttctatacttctaaactgcccttgaactgttgggcagaagagatattttgagccagcagtacacagttcatttctacatttatatcattactaaagaaaagtgtgagttagtatcgtatcttgatataactatcaagcactcgtgcatcttttggcaggagaatcattctgtctacgattgttattgtgtagttttaaatggactagtcaaccagctgttatatattttatacactgaaggccatgtttcctttgaaattcatagttttaatctcaactgaagtctgtattgctgtgtgccaagatcaaaaggattagacaaacttgtacaattaccttcctttacagagagatgatttttaaaaaatgtttaaaatactcctatatactgacattttatccaactattttctttagaactacagaacattaaaacatttaattaacatttcaaccttaggtcacttttcatctaaaatctaggaattcacaacatacagatatgctaaactaattatagtatcacacacatagggatattgagcttttttttttttttaaaaaaaacctttagtttattaaaaatggatggggaaaaattatacctatttcttttatgtgtttgcattttgcaagcctttgctcagaaaataattcatagagcttacagtgatatatatgcagcaagatacaaaagagaagtgaggcaatgcaaaatttaaagggagatatcacataaaaactatgccatgaaatttcaaatacttgttttaacaaatctatatatgctgagccatgtatttgctgctaagctttctagcaggcaacataaagaaagaaacacgaacaattacaggagacaaaaatgaccataatgtaaaaacaaaccagatggcctggaaaaacacattatttctattcctgagataagaaattcctcccttggcaatatgatggaatccaggtatgtaactctcagagggactgagttaatcctgagatagatttaaagtatagacaaatggggagaccacatattcttcagataatcttgcacaaacattatttctcttagaaaggctttgaatggtaggttctagattgtgcttcatgacaagtacctggaattaagctattttattttgttagttaaatgcagagctaatatgctttgataacaggtaaactgagtcccaggactaataacctcctaagaatgtgaagagtataaggagaaggacacagcctgtatgaaaggcaggctcaccattacttggaaggtagactagcctgccttaaaacaggctcaaaggtaaactttctcacatagataaatatgcatcaaaaacttccaaattccaaacatgatgctgtaatatttatagacattaaaatgtttaaaacaggtatactagatgttcaactctttaaaaaattagtaaagtatccctagaaacttaatgttgaggactttatattgctgttatattttctaagataaactagttataaacatagacataagtaattaaaatattaatttaaagtggtcaattatccacctaggtatagaaaaatgaatgtttcctcttcagcagccatcacaaaatgtattaatttactgtatgaactcctgtaggttttatattatatagtcagttacaaaaggaaggaaaacaaaataaaaaaaatttaatcccttcccatttgcttatccatatagatctgataaatactagcagtctcttgcctttgaagatggccagaccagaatctctacttattgccagatgtagtttaatcccatgaggactccagacaaaaacaaggagctgtctgcatggcaccaatgattccctggactgactgccataaacttatactggcaaatcaaaatccttggcaaagtagaacatttattatgtcattactcctaagaatatccaataaagaaaaacttgaattaaaaaaaagcaaaagttgctgaatataaagcattaagttctgccagagaatcaaattacatctgcatttactttgtgtatgcgattgcatacttgtatattatataggactaaaagtattatacattctgcaactttctattaatgttagcatctctctcatctattcattcagtaaatatttattgagtggttactattggtcttgtgctagactctggggatactgaaatgagacatccctttggaagaaggaaaggggagcaaaaggtcagctctaagactactttcatagtctaagtgagaggtagtgagagccttaatcaagaaagtagcatccggagtgaagaggggacagagttcagaaagatttaagatacaagttattacttacagcaactgattaccagtgtgaggggtgaagaaaaaggaattttgggtgatcagtttgaaccttaaccatactagaggagaaattgtttacatggtagaagattagttgagttttgaacttagtattaatattttggacttccttttatagacttgaaattaaccctttgttttggatctaaggctgagaattttagtggaagtttgtacactattaaagtattaaaatatgtttgaccaggcgcagtgggttacacctgtaatcccagcactttgggaggccgaagcgggtggatcacgaggttaggagttcaagaccagcctggccaacacagtgaaaccccgtctctactaaaaatacaaaaaattagctgggcgtggtggcgcgcatctgtaatcccagctactcaggaggctgaggcaggagaatctcttgaatccgggaggtggaggttgcagtgagccaagatcacaccactgtactccagcctgggtgacagagcaagactccgtctcaaaaaaaaaagaaaaaaagaaaatatgctcatgttcaatagtggaatgcacaagccaaaaaaattctgtgtaacaaaatcaccccaaggattttataccagttttgtccaacagatatatatccatgccagatatgcaatttaaaattttctagtagccacatttttttaatttataaaaaattttttttaaaaaatgacacagggtctcgctgtgttgcccaggccagtcttgaactcctgagctcaagcaatcctcctgccttggccttccaaattgctgggattacaggcttaagtcaccatgcccagcctatagtagccacattttaaaaagtaaaaaaaaaaaaaaagtaaaactgttttaatgacatggtaatattttatcaagaatatacaaaatatcatttcaacatgtaatcaacatagaaattattttgtattaaatctcagaaatctggtatacattttacacttacaatggacagcacatgttgatcacactagccacatttcaagtgatcaacaaccacatgtgactagtggttatcaactggacggtgaggctttattcagttccaaatactgaatctgcatccagattttgatacaagacagaatgcaggagttaacaatacttaacacttttaaaatacaccttatcttactgaaaataaagataaaccttacaaagtacgaagtaactgccagactaaaatgaccttcaatgcagttttgaagaggccattacaattctcagtgccgtgaagaatggctacaccttaggaaatgacagcagaaatgtaacatcttcaagtgtgaaacagacataatgtcctacagtgtatattcttcagccatttatagatctctgaggaaatgtggcagcatctgaaagacggcattatgactatcctctaaataataaaggtaaaagggctaattctaccaactatgctgtaatctataaactttccatccttaaaggtccttagttagagttcttaaattttggctactcagctctatcagttatgtactttaagaattaccatatagccatagaccacaacttagtataggggacataatctttgctgaaagtcagatatatgacatctgtaatgtgtatgtattcacaaaactcataaaagacacttcattttagtagcagataacgagtctctgtctactcctagagattttttaacatctacaataacattctgattcccaaaattttgggtctgactctttctgcattttcgattaaataatgattagttaatagggtcagtcttttaaaattatttttaagtagccatgaatacatatgcaatatgaggtcaacaatagagacttcttgcaagagttaaatacatttcttatttatgtttccttacctccctttcacttcttaactagtttctcctctttctgttacaggcacaccactgaaaatgtttttgcaaagattactaactgtctgaatccagtgtatgctcatcttttctcatttcacctctgcattatggtgtttgtttctctttcttcttctcgcttgacactctctctccagattctctttctacatttctgattttcctattcattttcttaatatagggtctttttcctctaacatttcagcatttattctcctcaagattcagtcccaggccctctgcctctggtataacccaggctagatgagccacacttcaattacttcaaccaacaattactacctctctggagcttcaaatacaaaatgccaactgcccatcatactacttttttttttttttttgagacggagtctcactctgtcgcccaggctggagtgcagtggcgtgatctcagctcactgcaagctccgcctcccgggttcatgcccattctcctgcctcagtttcctgagtagctgggactataggcacccgccaccacgcctggctaatcttttgtattttttagtagagacggggtttcaccatgttagccaggatggtctcgatctcctgacctcatgatctgcccgcctcggcctcccaaagtgctgggattacaggcatgagccaccgcgcctcgcccatcacactactttttttggtgtgcttcacataactcaaaattaatatatcaaaaaccaaatgaatagtatttcctctgacacttgctccttttcttgtctttctggtgagggactaggtccttcatctagtcagccaattcagaaatgtggcagtcatcttgacttctcctttcccctctccctacaaaattttatcagacaataagcctcctaaatatcttcccaagtcattctttcttttcctttcactgggactacctttggtttcatgcttcatgatttctttgttcagttattctatcggtatccaaactgtttctttatctctaaaatttcccttttcaatccctcctccatatgaactgctatctaaaacctagccaagtcactgctctccttaaaacttttctcctttccctaaagcagtggatctccaactttaacacacaccaaaattagctggagaacttgttaaaacaggctccaatccacagtctctgtttcagtagatcaggggcagagtccaagaatttgcccttataacaagatctcaggtgatactgatgctgctggtccaggaactccttttggccaccacctccccaaagaaaaaagtccatactatttacgaggcattaaagatttatcgtacaatctgcctccagccatatatttccatacacaccacccacagttctctcaaacacatacttcagtctaccatctgaattaagtttagctcatgtggctgcatgcagtggctcatgcctgtattcccagcacactgggaggctgaggtaggtggatcacttgaacccagcagcttgagatcagcctggcagcctggcagcctgggcaacatgatgaatccccatctctactgaaaatacaaaaaaataaaaaataaaaaatagcaaggcatggtagagtgcttgtagtcccagctacttgggaggctcatgtgggaggatcacttgagcctgagcagttgaggctgcagtgaggtgtgattgtgccactgtatgccggcctgggtgacagagagagaccttgtctcaaaaaacaaagcaaaacaaaacaaaaaacagtttagctcatgtacagtactataaccttgatatctttgttcacagcgcttcttatatctgtaatgtccattccatcatcttactccctgcctggcaaacccctattcattctcaaagactaaggttacatatgggttccttggctaagccttcctcaaccttccccagaaacagaacaaggcatttcctcttttggtcccagaatatatatttattctctctctttctctctttgtgtctctctctacacataatgttaaatgctttcatggtaatcttgctactccttcatggtatatatacaagtatatttattatattacatgttatcacaagttatatatttgtttacttttttatttattatctatttcccttacaaaacaataaattccaaaagggcaggtactatataccatctttctcactgctgtataaccagtatgtagtaggtactcacaaaatatttgtagaatgaatgactatatcgcttaatctatttctctaattagttactgtcatgtctgtctgcttctcataatggcagccccaaagggcaggtgtcacagtcttccaattttgtgatcacagatctaattatccagtaggcccctaatacatgtctgttgaatgaatgaatggcatttaagaaattcttctgatttaccgcaattcaatgtctatgctgagggactagatcttaaagcactgtttaagaagcgtgaaattgaccatagccactttacttggttgatacagtgctggtttggcagagttatagaaaatttgaaaaatttctgtgattactagccactgcaaaatgagctgtctgcagtttgttaaccatacaatcaaatttgaggtagaatgattacatgggaaggaaaaaaaagtgaagtggatattaaagtatcatctttcaaggttttattttctcttcaatagtgtccagaagacagatgcaaatgatatccctaatacacttgacaaaagctcaagaaagtcagtatgttatgcaaagaaaatgcatctagaggtcaacttgggggaaatgcactgtccaactaaacaaccaccaccacactataacaataccagcagcatttaacatttagtgagtatttatgctgtgcccagctttatgctaaatgttttacatggactattttatttaatccttacaataatcctataagcaccacatttttaaaaactgttttacaaatgaagctaagaatgcttaagcaaattgtctgatgtcacagctagtaaatgtcagagttgtgacctgaacccagatttctctgactcctaaagccatattaaccacaacacatccttttgaaccaaagctgcaatatgaaaactctaaaaatatgaaaccactacataacatggattacttttcattggtttcacatatatcatttagaaatactagtaacaagtattgctgagtatatactaaatctggtgtgccatgttgatctggaggctttatttacaggttttactgttctttcaactggttttttgctttgacacatgcatttttaaaaccaatactttcaacttgtattacagcttatttttctcttttattaactggaatgtaagctcctagaaggtatagattatacctgtattcttggaactgagcatatagtagatgcccaataaatatttattgagctggataagaaatttatattctaggcctctttttcattaatgtaaccatatattcactataatattttatatcataataaaatatcataaaaatgtatatcataaatatatatcataatatatatacacacacagagagaaagtgtgtgtgtgtgtgagagagagagaaagagagagacagggtgtcactttgttactctggctggagtgcagtggtgtgaacacagctcactgcagcctcgacctcctgagctcaagtgatcatctggcttcagcctcccaagtagctggactacaagcatgccaccacacccggcgaatttttttatgttttgtagagacagagtttcaccatgttgcccaggctggtctcgaactcctggactcaagcaatctgcctgccttggcctcccaaagagatgggattacaggagtgagcaactgcacccggcctcattatgatattttaaaaataaacagcctttagagcaagacagagaatgataccaatatattagttgctaagtccaaagactcttaataaataaccaatccattaaacaaaaaaactattttaggaatagttaataataggagttcattctgcaaatttctaaacgtccatgacattagcaacttatgaaaatgtgattttaggctgggcacggtggctcacgcctgtaatctcaacattttgggaggtcaagatggacagatcacctgaggtcaagagttcgagaccagcctgaccaacatggagaaaccccatctctactaaaaatacaaaattagctgggcatggtggtgcatgactgtaatcccagctactcaggaggctgaggcaagagaatctcttgaaccagggagacagaggttgtggtgagctgagatcccaccattgcactccagcctgggtaacaagagtgaaactctgtctcaaaaaaaaaaaaaaaaaaaaagtgatttcatgtattttaatttctatattttgacacatgaactatttgatttccttaaatcaaactactatgcagaaataacagagaaaatttctgttatttcctacttaaacattttcatgtaactacccgattggttctacgtttctgttaatatttggaaaataccttaaatacttccacgtaataacactgctcaaactattcaaaatattgattagatttttttattttaaaaaatgtatagcacaaacattatttgtttttgtgattttaatatctcttaaatgtaccatttgacaaatgcttttaaattaaaatactataactgataagaaaaaacagtctcaaagaataaggctgttttgagattttttttaagcctttcagacaacccctatgatagctggtaagacatattagaatactataaaatatgagttagaatcactatctttattagattaggagaactgaataaaggacataactgtattcactctgaggctactattttcctcctttgttcttcaaaaatataactctttttgtagaatgtctaccactgtagttaaattcaactcataggatgcagttataggtcagaatctagcaaaatatattagaagcaatctaagcatttaaatttttcttaaatatgaggtgaaaagacaaacagcatggcaagagttaattgaaacattcctgtttgagagactgcatggaggagtgggggctggtggacagtgagaggagggagctaggccgagagatgcagagttaatcagggagcaaatccaaagccaggcatggataggcctcactaatgagcctcaagtaccctgcagtggttttcaaacttaactggcttcaaacgatgccaccccatgacagaatgcagctagccataagaggagggtgattagaataaatgactggagtaattaactctgatgtgaaaccacctgattggaaaagagaagccaagagctatttagctgatggtcctccagtagaaaaaggaagctttccctttctcttgtgtgggtgttcagttagaactcaactctttcaagtaggtatttggtagcactaatgaaaagcagctttcattcaagggcctctcaagggccttcccattcattttgaaaggggaagaaaataaaagcttcaaagtagaactaatttactttactcccctacctcttagtgaattttgcattagtgaagtctgcattagtatttatgctaacaaatttacctccaaataacgtcatcaaatactaaaaattttatttatagaataactagatattaaggctaattaaaattttttaaattttcctttctttaaaagtgttttagaaaactaaacttataatttataattaattgttgattagttacagcacttcctttactctagaatgagggagaagtaaaacataaatggggtacatctgtttttgaagagaaaccagagaataaggtggaggtaaggaaagaaagaacacatatttttgcaaaaagacagttttcttacagtgcaaattgagccaaagaatccaccacactctctggcctgctttattttataaaaagaggaattacaaagacttggggcattactgcctgctgttttacaagtaatcatcaattcattgggccaatgttgttctgtacctgctgagttaatgttcctcggcacacccctcccccaaaaacaggttcacaagctgcccagtaacaactacagcgtaagtagcacatgtaacttagcaaatgtttatgccgaaactcggatttatttgacagctttacacctttgggcatgatataattaaatgttttgacagctaaacaaaaactgtataaatttaaaagctattaggagctcagcatctagaatcaaaatgaagtaatttgcttataccctaagctacttttagtaatgcattccaataaaaagcatgaagaaagggataaatgtctatccgaatgttttagctaattcgttcatattcttctatgaagaatattctccttatactgataataaatggcatcttaaaaaggcaacataaacgcatttaagattgtcaatataatccctaaactctatctctggatattttctgtaactttagaaatggtaatattaaaaagacatagactaagaaatagtatattactgtatttttaaaaggccaccatgtgctataaaaaaggattgaaagcaacacagggacagtgaggtatccttcaaactcagccattaataactcaagggggttaatcctcattctctcaaggtgccggttccagattttcacaatatgctatgctgctgtagtcctccgagatttcagtgctcacttcataatacccccaattcacagtttaccttcggagaaaactactgttcattatctgagctccagaaaatgttcccatcagtggtactactttaacacaagatttaaaaactcagatacttccttaaaaaggaaaaaaaaatactataaagcaaaattgtccattaaactacaattttttagaaaatgaaaggttgttttatacccaccatatggcatcacattatcactctggacagcacatacagagtactggctaacagtctaacaaaagttaaatttaaacagcatctaagttagaacattactgaagcattttcaggctatgtatatacaaaaacatttaaaatttacttttcattatgtaacaatctaaggaatactgtatcttcactaaaggtaacaacgatcagttgtttatttaaaaaaacaaatcactaaaatgtttgaaaaccagtccacttttcatgtggatgtttatatttcacttaatcatccttcttggaaagacagctctaaaggaagaaaatactgagaaccaaatcctgtttaacttacacaaggtgatgtcaagtaatttaaaaaacatattctaaaaagagcttcttctgtacacatctaaagacattactgcattatctaattgttctcttcctctcactcatgttaacaggatagatgtctttttgtgtaccatatttggtttcactggcacatagcctgaaaacagattaaactgtttggagtgttcaaatatctgatggtgtatggactgtgggaataagagactggagactcagaagctgatagttcccaaacagctattttccttctttcttttttaaaaataaatgaaccttgagtcagattaattaaacactggttataagactcaatattcctagtagataaatagatgtttgaagacttagtcaatttcaggcccaaaagtaagtattactaggtgtaaaatttgtttaaaagatgtcattaaaatattacatattaaggtggtcctcttaatataatcttgatgtcttttaactatctcattctttctcttctccatggacatcatgttttgcaaaatgttatcaaataatcaaatgttataaaataatctcacaaagatgcatatatctgccagaccttctgattaggagataaccagtggtgctaacctgatataatttagctgaaagcacaagaaggttgaatttaacccaggttgcctttttataggtaaatgtactatgttcagaatgcttagaaattgctgtggtggctctaatggttcaacaacctttggctgagacccactgaacacatacaaacatatgatgcctaaaaaaatatactttttttttttagaccaaacacctttgtttcaggtactgctaagaaatataagagctgcaaaataattataacaaaatgcttacttatgcagaattttaactttagattcattgaaagaactatcaaactttttgacagattttgctaagtattgtacgtatataaaaaagaaaatataaatgaaatatttgtaaaatgtttgagagtctacctcttctgaaatgcttcctgattcaaaggtgttgatttctgtgtttctccatatagtactgtcctccatgcctttataagagcattagtgaggcagcattttttaaagagtcctccattattacatttgaacttttcttccaagtatcatactacaaattatgatgctgacatgttcttgatctttttgacagccttgtacacgtgccttagggctcccagtgctttcttcatgactgctcaatttctagcctcttctagtttaactatgatacttctatctcaacgcctccactgtgataactctatcttaaaacttaccaaaatacattaagaaataatgttttgtggagtggaagacagtttggcagtttcttacaaaactaaacattctcttaccatatgatctagcagttgcactctttggtacttacccaaatgagaggaaaatttatgctcacacaaaatccttaacataaatgcttacagaagttttattcacaattgccaaaagttggaaacaaccaagatatattttagtaggtgaatggataaacaaactatggtccatccatacaatggaatattattccaaaataaaaagaaatgagctatcaagtcacacaaagacatagaggaatcttaaatgcatgctactaaatgaaagaagccaatctgaaaaggttacatactatatgattccaactatatgatacattggaaaaggcaaaactatggggactataaaaagatcagtggttgccaggagtggaggaggaagggggaatgaataggtggagcataaggaatttttaggacagtaaaactattctgtatggtactatacatttgtcaaaacctacaggaagtctaacataaaagtgaaccctaatataaaccaaagactttagttaataataatgtattgatattggctcatcagttataacacagtaagtgtaccacactaatgcaagatgttaataatatggtgtactgagatgaggaatagtaagaggtatatatgagaactctctaaaggttctgctcaaattttctgtaagactaaaactgctccaaaaaataaaactgataattttttaaaacatgatgtttatatttttctcctcttctttgtcttccaaagaatatctcatgcctaagaaagttgctggcacatattatgggtttcaattgctactttctaaagcgaaaggagtatggaacccaaaagaaggatctcaaacccttcattcccaccaaatgtgccacggcctacagagaaagaagcattaattaacacatttaattaattaaactcacacttttcatatcacgtatatgaacatgttctagtatcaatattaatatataatctatctccttttcatagtaggttgaaaagcatgagctgcaagctactaaatttttttttttttttttttttttttttggagacagagtctcactctgtcacccagcctgcagtgcagtggcgtgatcccggctcactccaacccctgtctcctgggttcaagcgattctcctgactcagcctcctgagtagctgggattacagtcgcccgccaccacacctggctaatttttgtatttttagtaaagatggggtttcaccatgttggccaggctggtctcaaactcctgacctcaggtgatctgcctgcctcggtctccaaagtgtcagattacaggcacaagccaccgcgcctggccgcaagctactatttatctaatatttatatctcttattatgttcagggtactctggctgtgtcctgtgggataaagacaaatgaggcattctatacttgccctggaggaactccagtctaatggagacacaggaaaacaagtatgtccaaaggtacatggaaagcagagagctgagaacataaaacaagcttaagcaatattatataacttattttataaatatataatattaaataatgctattttctatatttgttaggtaaaaatgtgactcacatgaattaacactcaagataccataaagcttaaagttttaaatgctgtctatattcctatcctaaaaatatttcctcaaattatccttaaacaaattatgaactgcctttatgaagcatatttcattttcttcaattatttcagcctttggttcatagtcctattccttgtcatcattcttgatagcttcagcatttcatctaatggttcttctctggaagccttccttttctactcattttagccacttttaagcattaatgtacctttgatttaataagccatgtgattcaagtctgcatgaaccattatctcttattctatcagttaatttttctgtcagatgctcgttatgctaacttcttgtgactccttttagttcttaaattacaaagataatacaataaaaacaaccagtaagtgtttgcttactatttatttgagtactgtgataatttctataaataatatcaattaattctcaattttatgtctccaaagtaggtgcaccaaaccactacaccgtattttatttctgtataaaatattattgaaaatgttggctgggcatggtgacgcatgcctgtaatcccagcaatttgagaggctgaggtgggaggatcacttaagcccaggagttcaagaccagcctgagcaacatggcgaaacaccctctctacaaaaattagctgtatgtagtggcacacgcttgtggttccagctagtagggaggctgtgagcccagaccatgccactgcactccagcctgggtgacagagcaagatcccatctccaaaaaaaaaaaaaaaaaggaaaggaaaagaaaaaaaatccaaaagatctggagtcatagcctgggtaaaatggttttgaaatcttgggcaatacttaacttcttaaagcttcaatttattcctcatttaaatgtaaaaacaatatgttccttataaaatatccttattattaaattatatgcctggtacgcagtaagttcttactagatattagttctcctcctgtgatggccagcctccaagatggcccttgatgattttcatctcctatactaagtacagctgacctgtgtaagcaataagatagtgcagaggtgacagtgggagttcgaagactagtcataaaagatattgtggcttccctcctcctctcttttgaatcatttgatctgagaaatgctccatatggtgaggatactcaagcaatcctatggagagtgtcatgtggaactgaggcctcctgccaacatgtcaacaatgcgagacattttggaagcagatattccaccctcggtcatacattcagatgactgcagcctcagcaaacagcttgactacaatctcgtgtgtgtgtgtgtgtgtgtgtgtgtgtgtgtgtgtgtgtgtgtgtgtgagagagagagagagagagagagagagagactatgacccagagccacctagctaagccactctcaaatttcttactcaaagagactatgagaaaaaaaaaagaaatgtttattgttgttctagctgttgtatttttgagtaatttattacatagcaacaaacaaccaatacaactcctggtccatatttttctcagacctgctttacctgtttgaacccacactgaaccacatggtggttattttcaactaggtttttaagatgtaacctagactctcatcaacttgactgctctccatacctactttgttaatccctaatcttggtgaatcccatgatctaattttctggcttctacatatgggctgccataatttgttagagaaaaatcaaaacatatactaataattttactataaatccaagctatcttcagctgaccctcaaaatactcactatttttgtgtttctagttcactaacatcatatttccttcagtagctgccctcaattacacagctgccacactttccttctcagaagagtatctggctggcctttgacttcaaaatgaggacatcattaaatttttcttgatttttttcttctccattgcataatgtttatatttcaaccttacctctcctcttttccctgtgtttggagtagaaagtgttatccactttctatattaattcagtgccctcataccatctaaaaatatgctatgtactggttttcagtttctccccttctaagatattccttttctgagactattatctgctccagattctgctacctaaaaagaatttattctttaactccactaacatcccagaatcacctcttctttcatggacaccatacttctcaaaagccacgttcacccactctgtaatcttcactccttcactcaattccttgaaatctagattttaccacaaacactccatgaaaacttccaatactctcccttttatgtacggatgaaacgtttctccctctatgagagtgaactattgtggcagagactgctgttttttatctgctaaccactccttattttctttaataataaaaatttcacttagccagagacacatttccttgtctcccttataacctgataaggccatgtgctcaagttatggctaatgagatataaacagaagtaatgtgttccacttccagttgctcatctcaaaaggaatgggcatagttcctttccttcttcttactggctatgaagtagacccaccttgaacccagagatgggagtcacatgttatagctggaagattcattctcagcttcagactcctgctctctgtactattacatgagagaaaaacgagaagatataaatgatactgcaggttgggcatacctaatccaaaaattcaaaatacgaaatgctccaaagtctgaaatttttttgatcaccaacatgatgctaaaaggaaatgcttattgaagaatttcagatttcagatttttgaattagggatgctcaaccgtaagtatagtgcaaatattccaaaatgtaaaggaaatccaaaacctgaaatacttctggtcccaagcatttcaggtaagggatactcaactggtacatataacatatcaaaagtgtataattcttaagtatgtgaatgagaaatagtaagactccaaaatacagttgcttaaacatccgaaagaatagcttagcctgaaccataactaatatactcagtgtacggtcagggtcctagcaggaaacagaagacataatcagatgaaaatctgaagataatttaataaaggttctattcacaaaaagcatcaagggaaccaacaaactattttgagaaacctgcaggcttgtaacaacaagagggcatataacccataagcctgtaagagtaagggggggaattagtattactgaagctcgttgagtgctaaagctatagaagggaggctgtctggctgtagctgtagctttaactattgctgtagagggcctacagccctgaagcaggcaggaagcgggagcaagaaaaaatgtgaccccgttctcctcctgcagtcctgtctcctgtttttcatagtgatcagccctacaaggcataagggggacagaagggagttgtgggtaatgacctggggggtaatgctggaggataatcagaacacctattaataaattaaaagtgtattattacatcaggattggctacttttgaccacgctgaagcatatttttaaccatccaattcctcttgaaacagtctctctacttactttttttttgttttgagatggagtctcactatgtcacctaggctggaatgcagtggcatgatgtcggctcactgcaaactccgcctcccgagttcaagtggattctcctgcctcagcctcccgagtagctgggattacaggtgcgcaccaccacacctgtattttttttttttttgaatttttagtagagacgggatttcaccatgttggcctcaatctcctgacctcgtgatccgctttggcctcacaaagtgctgggattacaggtgtgagccaccaagcccagcctctacttactacttaacactaatgcactcttctatcactgctcctgataccattttataggttcctctttctcttcttgttttctgaaagaaaactatttcccagggctctgtttttggatttttgggctctatgtggtattgcagggtgaagtcataaaccctctatcttcgaccatcactcactatagataagcaccaaatctccatctctaacactgatctctcccctggagctagatcaaaggttgcatatttaagtatctatggaatccagataggtaaaaataattaattaggcaaacaatataacacattagagagagagaagggctgcagaaatctagaaagatatgcctacctatatctacaggggtggctattgctgagttccagttgattttactatgaagtaatgcaacccccacactgtgtctaacttttaaagaaaggctagaaatacagatttggaagaaggaaaggtgtccttattttactttttttttatggcaactccttttattaaaatattaggtagtttatctcagaaataaaattgaaatccctataactaaaaacactcagcagtgatgaataaaacaaaaatgtttttaggtcggcacaaaattgtggttttcgcctaaataaaataaaaccttttgattttgaaataagtttagacttccagaagaaatacaaaaatagtaaaagagttcaagtatatacccttcactcagcttcccctaatgttagcaacttatataatcaaagaaatattagcaaaaccagaaaatatgtactaaaccatggttgtaatgtgtaaccagcttttctccaatatcctttttctatcggaggacccaacccagaatcccacactgcatttagttgttgtgtctatcaattacaaaggaaaaaaaataacaaataagtttttaaatgaacactgtgttagaaagaaaacagcaaaagaaatccccaggagctataaacaaacaaacaattgtactacagagtggtaaagataaccccgggtgtttttgttttgttttgttttttcttttcttagtcaaagtcagctaggagtttgtttttaatgcccatatggaaaaagtagatgagaccttggctcctcttttaggttggtggaagtgaaatttccctatatataaacctgggaccctcaaagaaaccatgcccacagggaaaaggtcggggtgggagtgaggggaatctacctaccagtcaggacttaagaaaaagaggctgggtgtggtgactcatgcctgtaatcctactactttggaggccaaggtcggggataacctgagtccaggagttcaagaccagcctgagcaacatggcaagatcccatctccataaaaataatggaaaaaaaaaaaaaaaagaagctcttagtcttgacttgggcttaggataggaaaacttcccctaggaattcatatccacaggtctgtcccttatatagatttaggatttaaaagtataagcaagtagtctaaaatctacacagaaactggacctaggctttcaaacatggaagaggcaaaagcaaaaacactctggagaagcaactgtattcgtttatgcaatgctttgcacatgaaaacctggatctgtgattaagcatttaaggtaacactcataaaactatatcatttgcagtaaacatgtctaccaagtaaattaaaggacccttatactatgcagcagctaaagcaaagtaggatttgattaaaagtccttagaaatggaggactgttttaattctagaagtgggggaggagaaactcataccctttaactgactactacaagtctttctaagaactccagctttccataagacatgtacccacttaggagatcataggtcaggttttataatatactttataattaatataaaaaattaaccatgattataaatcaatgcctcatttataggagcctggagtctatcatacttgttttaaatgttttttataccaatttatttatttatttgttttgttttgtttttcttgccaacatggtgaaatcccatctctactaaaaatacaaaaaattagccaggcatggtggtaggcacctgtaatcccagctacttgggaggctgaggacctgggaaggggaggttgcagtgagcggagatcatgccactgcactccagcctgggggacagagtgagactctgtctcaaaaaaaaaaaaaaaatgccttgtccttgttggtacccatacccataccaggtaaacctatatttggtcacttgataatcacctgactttgcatgccttcttaaatgtcccatatcttgtcattctgaatagcattcaaaattatgttcatcagacgtaaatagatattttactaattagcatgatcccttacttcttatgtataagtgattgacagataatagctgactacctgccaatttggtttttgtactccattgagtataatacccctcctcaaggtaggaaatgttaagaattttttttctcatttactgctgtctgctgaactagacagctatctctaaaaggtacacaataataactgctgcttttcataaactgtttatagtcattcacagcctctatttcttctgtacgcaagtaaatcatgtttccagatgaaaatgaaaaatacttttattaatggcttttattatttttaaagtgctataatttcaaagatgttaattgtgtaaggatgtaaataaatgtaaactctccaggtcaattttcttaaaaggaagtccagatactaaaaacaacttcaggatgtaaaatgctgggaaacagcacgagcaactcatatgcatcagagacggaatcacattgtaagtaaaggtgttaggctgctctgtggacaggtaaagaagagccaaaacagctctggtaaacagaactcatagctaccatccaaaggtaagttaaacatacaggtaatgtagagaaagcctgccataaccacatgatgaaagcaagagcacaaacaaatgtcttcaaatcgaatgacaataatgttatgactatgactagtatgtaccttagcaatcactcagggaacagaaaaaaaatgatagattcagaatataaattcactaaaatgatttcttagctattttatactattatttatgtaataataatttgttatatattcttactattgtattaatttacccattaataaaagacactaacaataagccactacattaaaatagcagatcaggccaggcatggtggctcatgccgcctgtaataccagcactttgggaggccaaggcaggtggatcacctgaggtcaggagatcgagaccagcctggccaacatggtgaaaccctgcctctactaaaaatacaaaaattagctaggtgtggtggcgggcacctgtaatctcagctacttgggaggctgaggccagagaatcgtttgaacccgggaggcagaggttgtagtgagccgagatcacgccatcgcactccagcctgggcaacaagagggaaactctagctcaaaaaaaaaaaaaaaaaaaaaaagcagatcagaattcatcattaaattcctatatacaaaaattccataattagaaatatcaccagcagatacaaatttaaatatcaagtttgtattagaaaaaaaagaatgctggttggttaaaatggatagaagacagcaataatgagtcaggttataggttcaatcccatagagcccagctgggttcacattgagaaaagtacatttcatggtcaaagacaggtccctgatctcagcaaagggtcacacatctatgctattagttgaaaagggaattatactggagatggttcaaaaaacaaaaaactatcatcattacaggaaataactcatagcatacatcctgatgacaaatgaatagtgctattttctttgtgaataacatcttctgctgcactattactaactctaggaagatatgctggacttcttggctttgttttaacactatccacatatcatgaaatattatattgccgaggcagtatttatgaagccaaatagaaagcaaaccatgaactccatacataggaaaacaacaacaaagaattaatggctgggtgcaatggctcatgcctgtaatcccagcactttgggacaacgaggtgagaggatcacctgaggtcaggagttcaagaccagcctgaccaacatggagaaaccccatttctactactaaaaaaaaaaaaaaaaaaaaaaaaaattagccaggtatggtggcacacacttgtaatcccacctactcgggaggctgaggcaggagaatcacttgaacccaggaggcagaggttgcagtgagccgagatcacgccattgcactccagcctgggcaacaagagtgaaactctgtctcaaaaaaacaaaacaaaacaaaataaaaacaaaaaacaattaatgatcacaactctactcctcaatggcgcagggtcaacaccagcattagaacaacagggatcactcaactgtattctgaataatatttacaaagcacctgtgaactaattcttagcagttaagaatttttctttccccactatcattttcctcttgaaataaagcaaatttaaaatatgccaactaaggcaagagatttgaaccccacctacatcaggatcacctagggagttattccagggcttattccagaaaccaccagaaccaattttaataagtatggtgtagggccctgggatctgcattttaaacaaacactggaacactaaaagtttgagatgagaattactgactaaaaaaaaaaaaattgcagtttatgtagaatgcacacattagcaatataaaaggaaaagaagatgtctacttattattttctcttgtttatttttctaaattaagtatattttgttttaggccaggtgcagtggctcacacctgtaatcccagcactttaggaggctgaggagggtggattacctgagatcaggagttcaagaccagcctgaccaacatggtgaaaccccgtctctactaaaaatacaaaaaaaaaaattagccaggtgaggtggcgggtgcctgtaatctcaactacttgggaggctgaggcaggagaatcacttgaactggggaggcgggggttgcagtgagccaagattgcaccattgcattccagcctgggcaacaagagcgaaactccatctcaaaaaaaaaaaaaaaaaaaaaaaaaagtatattttgtttttaacttagaactatttaatattccttaggaaatagttcaacaagccgaatttaagtggtctctccataaaggcacttacatgatttacacttcaaaactactgaattttttaaaaccacttaaattccttcatacaatttttgaattaaaatgacaagtgtggcttctttttcaacatttaaatataactcacataccacagaattcatcctttaaagtgtacaattctgtggttttcagtattatcacaaagctgtgcaaacatcaccattaaattcagagccctttcatcacaccaaaaagaaactccgtacctatatggcactcactcccatttccctcaccctcacaccctgacaaccactaatctactctgtatttctatggatttgtctattctggatattttgtataagtggaatcatacaatatgtggcttttatgtctggattatttaacttagcatcatgttttcatggttcatgctgtagcatgtctcactatttcacttctgtttatggctgaataatcttcagcatatggatacaccatattgtgttaatccattattaattatttggtaggcatttgggttgtttctactttttggctactatgactaatgctgctataaacattaatgaatatgtttttgtatggatatgtttccaattatcttggatatacatataaccaagagtggaattgctgggtcacacggtaactcaatgtaaagaatgtgcaccattttacattcccaagagtaatgcctgagggttacagtttttacatatcttaaccaatacttgttattgtctgtctttttgctagtggttgtgaagtggtatctcacgtgaggtggtgtgatttgcatttctccatgactactaatgttaacatattttcacgtgccttttggccattcagatatcttcttgggaggaatgtctattcaaatcctttgcccagtttttcattagactatttatcttcttattcttgagttgtaagagtcccttatataatctgcatagtagactcttaccaaatatatgatttgcaaatattttctcccattctatggattgtcttttcactttccaagtccagtttatttatttttgtttttgaggctttggtactgtatataggaagccattgcctaatcagtgtgattcactacttttattttttacaaaatgaatattttagtaaaaattggctctagcctatcattagcaggagagtagccttgcagtcttgttttgtgtcaatagagatttgctagaaaactgaaactgagtaagaaaccattctggggctgggcacggtggctcatgcctgtaatcttagcactttgggaggttaaggtgggtggatcacttgaggctgtgagttcaagaccagcctagccaacacggtgaaaccccatcctactaaaaatacaaaaattagctgggcatggtggcacatgcctgtagtcgcagctactcaggaggccgaggcaagagaatcgcttgagcctgggaggcagaggctgcagtgagctgagactgtgccactgcactccagcctgggtgacagagtgagactctgtttcaaaaaaaaaaaaaaagaagaccaggctctgaaaagttagtttgcaaatattcacaggctttttgtgctttttcaaggcaaactaaaccaatagtttctaaggtagttatttaactaaatttaaattaacatagatcttcaaaagccaaaagtagtgaagaacttaaactggattgtaaaaaaacatagaaataaaaatgaaaaacatggtctaaactactgacaaaatattttttcaaatttctaacactcataaggacaaacaaccttctgaggacaataacaaatatagaaataaattgcaaaatttttgtgggctgctaaagtggtggtaaacaagtactgaaatatgccaagattatttgtttataacatttactacttcagctttcatcaggtttatgaatatttatttgttttaaaatatatccccaaaaagatacttaatagcccatttcagaactagcacatcttatggatgattaacattagcaaggaagagtactgcctacagaaatctgatagtagtgctcaaagtagtactaagtacactgttctttaaaaatatgcttattaacgtcaccaaaggaaaggttgcttaaaatataattatcagtttttagtcaatcttttcttttcttttttgagacagtctcgctttgtcacccaggctggagtgcagtggcgcaatcatggctcactgcagcctcaacttcccagggtcaagtgatcctcccacttcagcctcccaagtagctgggactacaggtgtgtagaaccaccatgtctggctaattttttattttaatttctgtagagatgaggtctcactatgttgcccaggctggtcttgaacttctggactcaagtgatcctcctccttggcctcccaaagtgctggggttacaggggtaaaccactgcacccccaattttgtatagataacttaaaaacaaacacactttttttgagaacataaagtgttttagatagtattggaagtctgccacgcaggtatcatatcgctcttgtgtgacaggtgtatttcagggaaatgtatatgaataagatgtatataaaagaccaagagcatcactgttgtgtccccagtgcttgtagtactgaacaagcttaacaaaatgcaagtagcaactgctaacttcctgagggcagaaatttaaaaaaagccttacgttagaacaagacactctcaaaaagaatgtctaaatgctaaaattgctaatacccatccatctgcctccaggtggtgaaaaaggggagtgtgtatagcattacagtctggcaggggtaatatatgtagctttaaaagcatattcaaattattataatattctattgtttattggctccttaatacaaacattaaggaacagtttttttatttttattttttatttatttatttatttattttgagacagagttttgttcttgttgcccaggctggagtgcaatgtgcgatctcagctcaccgcaacctccatctcccgggttcaagcgattctcctgcctcagtcttccgagtagctgggattacaggcatgcaccaccatgcccggcaaattttgtatttttagtagagatggggttcctccgtgttggttggactggtcttgaactcccgacctcaggtgatccgcccacctcagcttcccaaagtgctgggattacaggcctgagtcactgagcccggcccagtgtgtattttttacatctatataaaaggttgtgaaactgataaataaagccttcttttctaaagagatttaaattcaggacatttaagaatgtgaaaagcagatcctcttctttcctgatcctcctttcttatgctctgcaaaggagtaagagtggctgactcctagttaaggttatgaaacagcatctaacttcttatgggctaatgcttcctttaaacttagacccagcattaaacctcacaaactaaataaaaataccttcagggaattacgatgagaagggcattttgtatctttaaaatacagacctaattgtggaggtagagtaaaacaatatatattttggttaaataaggctagagaaaaagaattcacaatttgttggatttataaaatacaaactttaatttcttttttttttttcagaggaaagaattaagattagggaaatgagaggaggaaggagataagggctttaaatgattctgatctataattatcagtatgaatttttcatgtttttcttttgcagacatttggaattgtcctgtagattttgttggcagttaatgatcgaggcctgcagagcactgttactgttcttgatcccccaattcataggtataatctttatgtcctaaactattggtcataaatattagttagctaagaatgcctaaaagttgtttacaaaccattacttgaaaaatgaacagccaacatttatagcatattcagagaaagttagtttgaaaaataactcaaactgtgtattcgaatcattgtatgtaaaaaaataaataaataaaaataaaagtagcttttcttttccttgtaaaacattagctagaaaaagattttacttttttcccacatcacagatcatcttgaatgagcaggcctgcataaaaacgatcttcacaactctttatgtaaaagcacaaaaaaaacaaaaacacaaacctatacacttttaatacaaaaaatctgcattatagccataaaggggcgaatagaccagtcataaaaaataaactcgttttttagttgatccaatcttgagcaaatgtttaattttaaaatttactattgttttattttctattacaagtatctgcctaattctggggcatctgctatactaaaagcagaaaaaaatcatttgggagattaaagagagtaagagaaaaataaaaggagagtcaaggaaatggatgggtaggaaaaagaaaaaagaaagatgaacagacagaggaagaagggaagagggggcaaattggcttagtcaagctctcttgggacagtgtgctgagttaccagaccagaaatgaggggttgaaagctactactgataactggtgcaggctgaaagtgctacttaagtgcctggtgtctgtggaaaaaagagggaggagaggtttaagactaaggatgccaagtacatttccagccagcagagtaaaaaggaagcattaacagtagcctcaggggaagctaagcatgctatcccatgagccagagggcaaatgtggcaatagcagtaagtagcagctggataaagggataaagaaataaagaaaccacaggaaaattggcagctttagacccataaggctgactcggcctcgtctagatacttagaggaacaaacagcctggaaaaaacactgccatctttctactgccgatgggttactaatcaacaactgaggtgcaatcaactaaaatttacttggcaaaaattatattaagcatggatttaactttgtggaacagaagctctgctcagaagatacatgtaagatattctcagtatttggcatcataataatcaaaatcagcattctccataactctccaaatgatactccgaaatgtttaaaatgaaaaaaaaaattaaatacctttttctaatgcagtatttcattaatgttttctaaatattatttcatacctcatagtttaacaaatttaaaaaggatacacataaatatgctctatagtatatattagtgaccctttgagtattaagcccagcctccattagctattcttcctgatgttttccttcctcccaccccccaccctccaagaggccccagtgtgtgttgttcccctccccctgtccatgtgttctcatcattcagcttccacttctaggtgagagcacgtgctatttggttttctcttcctgcattagtttgctgaggataatggcctccagctccacccatgtccctgcaaaagacatgatctcattcttttttatggctgcatactattccatggagtatatgtaccacattttctttatccagtctatcagtgatgggcatttaggttgattccatgcctttgctattgtgaacagtgctgcaatgaacatccatgcagacgtatatttataatagtataacatattcctttgggtatatacccagtaatgggattgctgggtcaaatggtgtgtctgcctctaggtctttgaggaataaccatactgtcttcaacaatggttgaactaatttatactcctaccaacagtgtaagagcattcctttttctacacaacctcgccagcatctgttgctttttgactttttaataatagccattctgactggtgtgagatggtatctcattgtgggtttgatttgcatttctctaatgatcagtgatgttgagctttttttcacaagctttttggccacatgtatgtcttcttttgagaagtgtcttttcaagtcctttgcccactttttaattttttttttgtaaatttgtttaagttccttgtagatgctaaatattagacctttgtcagatggatagattgcaaaaattttcccccattccataggttgtctgttcactctgtggatagtttcttttgctgtcaaattattttcattcatattcttccattaaaaaaaggttcaaagttatgtcataaggcaatctatattacctttatatggttttagaatggaaggtaaataccacaatgagagttcttgttttaaataagtatgtgctgtaatattttagtataatatccgaaaataagatttaccaagcacaacatttttcaaatgactaggcttgatatatttgataaactgcaatttgtaattgattaaataaaccctgttggcctaagagttgctcaattctctcttttcttcatcagggttattaaggtattataagattgatgttatgaaaaaagatcctactcctaaaagaatttcaaacatttaaggaaatcaaactgaaaagtaagaaatgccaattaagttgtgcaatgtatataacaaattctataagaattcaaggggtgaggagggggtggagtcagggaaaaaagttcctaagggatgtaaaatttaagatggctcctaaaccatgcataacatttgagcaaaaattatttggaaggaaaagatataaaaagagtaagttaagaagcagatacttcaataaagcaactgtaattactaaagttacctttggaaaattaagatttgacagctattacaggtagagtatagaagggatagaaggtaaagagagtgatgatacatagaaagtcatgatactaaagtagaataaaagactcggggtgttttagtctgctctggctgccataataaaatacctcagattgtgtggcttaaacatgagaaatctagttctgaaggctgaattaatttagaatttctgaaagctgaaaagtccaagatcaaggttcccataagatttggtttatgatgagcactctcctcctactgtgccctcacatgatagagagagagtgatctctggtaacccttcctctttcataaagacaccagttctactggaacagggctccgcccttacgacctcatttaaccttaatcacttccttaaagaatctatctccaatacaatcacaggggtgtaattagggctccaacataattttcgggggacacaattcaggccatagcattctgcctctaacctcctaaaattcatgcctttatcacacgcaaaatgcattaattccatcccaaatgcctccaaagttttaacccattccaaggtcaactctaaagtctacagttcaaagtctcatctaaatatcatctaactcagacatgggtgaaacttgaggtacgaatcatctttaggcaaaattccttcccagttgtgaacctctgaagtcagacagattatttgtttccaaaatacagtggtggggcagatataggatagacattctcattctaaatagaagaagtaggaaattgtgatataattttttaaaagcctgttgggagcattaagtgagattacatacaataaagtgcttaaactagttcatgaatatcagcagagtagaagtataaactccaagaaggcagggactttatcatcaaccactgtatctcaagagttgcacagtcaatagggtagtcactagccaaatgaagctatttaaatttaaatttaagttaattaaaactaaaaattcagttcctcagtaatattactcacacttcaagtgctcaatagccacatgtggctagtgggtacaataatggaccatgcaggtttccatcaccacagaaatattagtagacaagtctgttctagagcctagaaaagtatgtgacactataattattgaatgaagaaatataaaaactattagcattcatggttcaagaagaataacaagaaaacatcaagaagaatgagtatcttcaattttggatctttgtaaaagatccaaaagaatcacaacacaagattatcttattaacttttataaaggcagtaaatttagggctaggaaaatgccaattaagaaatatttctgtagccaggtgtggtgacacgtgcctgtagtcccagctcaggaggctgaggtgggaggattgcttgagcccaggaggttggggatgcagtgagccatggttgtaccactgcactccagcctgaacaacagagtgagactcagtctctaaataaataaataaataaataaataaatactccataggagattaggttaatattgttcagagttttgctttgttatgacctgaatcaagagaggaatcaagagaggaatcaggaggctgaggtgggcagattgcttgaggccaggagttcgaggccagcctggccaacacatggcgaaaccccatctctactaaaaatacaaaaattagccaggcgtggtggcacatgcttgtaatcccaactttttgggaggctgaggctgcagtgagccaggatcacgccactgcactccagcctgggtgacagagcaagactctgtctcaaaaaaaaaaaaaaaaaaaaagaaaggaatcaaaactccagagactaaccatgaacatgtctaatagtctcactcttaggcaccagcagtcttactaaatttgttagtggcaggatcaataatgaatggattcaccaacaaattcctatggtacataatgtcagtgttgtcggcaacaaatgtgagacaatccattgtgaatacagagatctggacttccatttttgtctgggtatttttttttttttttttttttttgccagtggatgagaaggaacggagtatctgcaactaacatcaatatttattcagaaaagtgcttcttatctttttaagcacttggaaacacaccaagttctgttccattacatggcattctaatgggtaattcttcatgatgtaatactttagcttacatcattagtgtaagatcaatttatttggttatcacaccgattaaataaaggaagtttccttctccagcagttgaaatgtttctgcaactcttatataaaaaagagttacaggtctttggcctaagctgtctatcttcttgaaaagtacagaaccagagaatacacttttccagcctaagccatccattttcttgataaatccaaaccacagaatgtgctttccctggacttaacactttggctatcttttctgagaatggaaaatttttcttactaaaacatctgcctcactccccacatcacattctctgccatctgacctgcctttgctatgctctgataactgccagaagtctacagcaatctcattttaagagtgaccctaccactaactgtgaataaagttttctcacctggtttttgccagtcttactctagaacctttccttcccttgacacatatttcttattccataggtagtgggatataaaataggcaaaaatttcttcctcaaggaatttttacccaaaatttcccaaaatttacccaaaaattcctcaaggaaggaattcttcctcaaattcattctcttagtttatcctctctttccattgctgagtaatcatttcttctaccccctaatacctttattcttcttgagtgataccaggagaggaaagcaaaggatgacacagaaaattctgataaaagaaggtgacagcaataaggctaaataaactgttcagctagaacctctcaagctgaaatcagaaattttctcctgatgtattgtataatatcagtgtcctcatttgttattacagcattagctactaattgtctcccattgtctatttacctccttcttccttttagcaatagacccatcctcccttgcagttttaggaagcccagcttgataccgcacttcccaaactcccatatggctaggagtcaccaggtgatgacattttagaaagcagaatgtgagcaaaaatgatgtgcccaacttcctagtcacattcttttaaaaagcaactgtgtgtcctctacttactgttgcctctttccaaagggctaaaatgtggatatacggggtgactgcaaaagaacagcaaaccctgaatgatgatgaaaccagacagaaggaacccgggtcctttgatgacatcatggattcaatttgctctaattccttggattgcctaccagttcagacttttacttcaggaagaaactttccatgtccatttaaccactactttttggtctgtatgaaagatgtaaaccttaaaactggcttttatataaaaagatttattttgggagaaacagagtatgtgggcatagtctaaaaaaggcaatatgatcagatggaagccctaaaagatcaattacactcaaacatgagaagcatttcttagggtgagacagaaagatgactggagaacatatttgattcaacaaactgttactagattcctacttaggccagacactatgtcatatacgtgacaggaactaggtaagtaaattgtgtgtgtgtgtgtagttcccaacttcactgaattttctgtacagtgagagattaaattctagggaattagctaagatataattggtcaataattactgttcaagtgataccatgtgccaggtaatgtgctaggtgctggaaaagatggtctctcttctaccttctaaatatttttcttcctcttgagtgccacttctttggtttaggctctcagaatttatttcagctcacacccttctaactggtttcctttccttcagtttcttctccctccaacccactgtcatctgagtaacataaaaatcctaaaataagaatctgattgatactctgttactctttaaaaaaaaaaaaaaaaaaaaaaaaaactttacaaaatttttcttactgaaacatctgcctttctattgccaataggttaaatttcaaaatgtcctttctagtcttattcttcatcactttattattcaccccagctacacggaactgttcatcatttacccaacataccttcatttgctctcttcttcctttctcagttcttcatctttgagtcagtttggactgcgataacaaatatcataaactgggtaacaaacaacaggaattttatttcctcacagttcttagagtctgagataaaggtaccaacatggccagtttctagtaagagcccttttactggattgtagacagtgccttctcactagttcctctcacataggggatttgggagtccagggggaaagagagagcagagtgagtagggtgtctgcatatttgctgtttcttcttataagagcactaattccatcatgacggctccaataccctcacaatgtcatctaaacctaattatctttatttcttaaaggccccatctccaaatatcctcacattgttggtagggcttcaacatataaattttgggagattgctaggtagtttattctctttgtgagcgaatggagttcactcatgatttggctctctgcttgtctactgttggtgtataggaatgcttgtgatttttgcacatcaattttatatcctgagaatttgctgaagttgcttatcagcttaaggagttttggggctgagaatatggggttttctaaatatacaattatgtcatctgcaaacagagacaattgggatttgaacaatgagaacacatggacacagggggaggggaacatcacataccagggcctatcgaggggtggggggcaagaggagggagagcattaggacaaatacctaatgcatgcagggcttaaaacctagatgacgggttaaaaggtgcagcgaaccaccatggcacatgtatacctatgtaacaaacctgcatgttccgtacatgtatcccagaacttaaagttaaaaaaaaaaggggggagaatatgattccatccatagcagatggcaaactaatccttcaatacccagctcaactgtctcttaagtatcctcattctctgaatgaaatttagttgctctgctatctatgctctgattaacgacattctggattaattatttccattattagatggtaaatacctacagggtagagattatatatattcatctttgtattttctcagaattaagtaggatgtttggcaaacattagccccaatacatatttgctgaatgaaacactggactttcagaagcaatgaaagatatgtgctaaaatctttttttttttttaatgcttttctctacttgcaggtcaggcattataataaactctttctcccccccacctctacaattctagactctgcattcataatttctttcattctttccctccttctcctcacctcttccctccctttccctccctccctccctccttttattagagacagggtctccctctgttgccatgctatagtgcagtggtatgatcctagcacactgtaacctcaaactcctgggctcaagtgatcctcccacctcagcctccctagtagctgggactaaaggtgtgcatcactacacttggctaattgtttaaactttttgtagagatggggtcttgggatgtttcccaggcaggtcttgaactcctggcctgaagtcatcctcccaccttggcctcccaaagtgttgggattatgggcatgagccactgcccttggtccatagtttgtttctttatagcatcattgatctcaagttgtctataaccactaatttctatggagttgaaatgcagattctatcaaccaatgctagattattaatgttgactttataattgcagacacttttacataaagagtaggtcaacatgttttcacaagagtaataagtaacttcagatgcccttgtaagaaatgcagcaataggactcacctattacttttctctactgaatgcatttccacatcaacagtgttaccaatcattattttatgttaccacagcagagaagatttaatcttcttttacataacaatttctttgccttagaggccttgtgatcattcaatattattcctattctaaatctgtcatgtttaaaacctactgcctgtattaaatatctattatctatttacagccaagagaggttaagtaacacagctgtggtcaaaagttagctaatactgaagctctgggattaatctccaaatattctgagtatgaatgcatattcattcagacatgaccatgcatatgtcataaaattttataaaattacagaggcagttgatatgaaaagtgtaaaatatgtgatcaaattaattagatatgttaattatggtacttaagttagagttgtaggtctatcaataaatattcactgaaagtttactaagtttaagtcactatttacaagtaacggaggagggggcacaggaggataaagctaataggtagaaagtataataaatggcagagtaaagggttaaaagagaagtacaaagtacaactgtgatgtcatagaaagaaagaaaacctggcaggcatggctattgtctttacatatcaggactaaagtgagatttaatttgctttgtttaagccttagagctagaatgaggaccaatgggtagaatttacatggcacaggcttcacttggtataagagttatttgaaaatagaatgttgaaaacagaatatttttgtgataatatactataagcttaatctacatgtagtagaggtgtcatggtgagatggtggggagcaggtggtctgtagggaacaatcccacccaagaccagtgagtacctgaataaacactattatatgcttgtagtcatggcttaaatgcaggagcataacacaattgtactgcccatttgcaagatatatttatcagcagtgtatcaaatgtataaaaaagtgatagggagactagaaggacgttattaccatagttcatataagagataagaaaggctactgtggtaaaaatgagccagcagagttaggaaaagatgttctaattacttcaatcaattatatgctaatattatctattactaaagaagataaaaatgggattaagtgtacataatagaattatcatctatcctattatttaccttaatatatttaaattccatattaatatatttactgtaacatgtctaaaactgaatttatcttcctcaaagaacttatcttttcctctttctgtaatgcctatttcaattgttagtatgacaattcatgcagtaactttagttaaaaatctcaatattatcttcaacttcttccccttatgttctttatgactctgatatgtctctagaatctagaatgtcttctctgtcctctctgtcattgttttaactaaggtcatcatctcctgcttaatttcctttaactgttatggcctcctaattgattttcctgtctccattctttcctagcttgagtccgatactcacactgccatcttcctaatgaataaattaaatataattatatcattcccatgtctttttagcagttcctggctgtctgtaagagaaagtaccaactcctcagcaaggtataaatgcctcttcataaatgtgacctcaacttaacctcccaagcctcatccctggctattctttcccaagaaacctatgcaatggccatacaaaaaattccattatcttaatcttttcctatactataagcttattcatttcatatggcacttgtcaaatatcagtgtctgggaaaggtttgagtgaacatttttaatcaattgctatttagtaaataaaccaacaatctttcagtacaatctacagtattctactggtaattgattctctagaattgaaaaaaaaatttccctcagcatctttcccccgtagactattatgatgattaattttgtgtcaacttgagtgggctgcgggatgcccagatagctggtaagacattatttctgagaatgtctgtgagggtgtttccagaaaaggttagcatctgaatcagcacactaaacaaagaagatccactctcactaacatgggcaggtatcatccaatccaatgagtaccagaacagaataaaaaagcagaaggatgaattccctccacccactccttgagttgagacacccatcttctcttgcccttaggcattagagctcctggtctgtgagtcttcagactcagggacttacaccagtgccctactcctgggaatttaggcctttggcatcagactgggagttacaccattggttcccctggttcttaagacttcacacttgggctgaattgtaccaccagcctctgggtctctagcttgaatatggcatactgtggtgcttctcagcccccataatcacacatgccaattcccataataaatctcatctcacacacacacacacacacacacacacacgtactcccagaaataatgtttatcacttatcctggcatccctcaacccactcaagctggcatataaaattaaccataatagtagtctacagggaaaagctattgagggaaaattcttttcaatcactctagagaatcaactagtagtagaatacgaatgtattggtttatttactaattagagattgatgaaaaatgtttgctcacaagcctttcccaggtactgacacttgacaagtgccatatgaaatgaataaacttatagtctagaaaaaataggaaatgattaggacaatgaattttctatatggctgtggcataggtttcttttattatacaaacactcacacacataaacatatatagatgttattggctctgattctctgggaaatcttaatacaactacaaaactttatttgccacttgttcccactttcaaaacacaatttactatttatttccattattaaaaataataactaatcattaaaaacatttgaaaagcaacggaaagagaaaagcaaaaaaacactgacgctttaagacactggagtaggtgtatgtccttgtaatgtttttattacattgagatatcatacacataaacacatcttatatactacatttttatatcctaaatttttcttttctccgaattctaaaataaaataaattttcatattttttctgatgaaaagtgaaaaatgaaagtaattttcctctcattaagtgcatattttcatacaatgtacgatacaaaaaggtattcatttttttcttttttgaagacagggtcttgctctgttgcctggtctggagtgcagtgacacaatcagggtttgctgcagcctcagcctcccaggctcaagcatccttctgcctcaggctcccaagtagctgggactacaggcacatgacaccatgcccagctaatatttttactttttgtagagatggggtcttactatgttgtccaagctagcttcaaactcccaggctcaagcaatcctcctcccttggcctcccaaagcactgggattatagatatgtgccaccatgccaggcctaagaatgtattcttaaaataggtatggtctcatttgtacaactaaaacttattaaaacatatgcagtagtataattttatcataggaagtataatgtagagtataacaacacaggtttcttgcactggaatcccagttcaatatttatgattgctgtgacaagttacctaaactcacaagttacctaaactctctatgcctcaagtttctaatctacaggttgagagtaataatagcacttacctcataaacttattgtgagacctagatgagttaatccataaatggcttacaacaatgtctggtgcatattattaagtgttcaacgcacgacagctcttattatccttctaaaaatctaaagtttaatgaacaaaatcccattaaacaaagcgaaatataaattttgtctattgaaaatatgttgcacagtgagcattacaaaaataattacatatatattttagtatcttctctagcacagaaaaaaagtagaaagaagaaaataagggatcatgagatcctggcaagagtttttctccacagacattctgttggtggaatagaaatatgtgagatggtgaatggaacagatctaaataagcatgggactaacaaagtacaatgtatgaaagattttacttagaaaaaacaattacaaattgactatacaatcaataagactaaccgaagggaaatgcagtaaaacactttcaaagaaaaatactgtggagcccagaagaaaataagccaattgacagaggtagatttcacgagctcataaaaatgaaaaagtaaatgctgctggacaaaaagtggtccttacttttgctctcaatgtttctagtatgctatgtagaacaattattttgcttttactgaaaaataactattgcatttggtataaaacgattcataggaaaaattattttttacttctgaataattaatgtatttcttaagtaatagaggaaactattaattaagaggcattcatgaaggtggatatcttacacctaaacattttagacttgttttccaattttctttctttctttttttttttgagacaaggtcttgctctgtcacccaggctggagtgtagtagtgccatcacagctcactgcagcctctacttactgggctcaagtgatcatcccacatcagcctcccatgtagatggaactaccggcatgtgctaccacacctagataagtttttttgttttttgtagagacagagtcttgctgtgttgttcaggctggtctcaaactcctgggctcaagcaatcctctgctttagcctcccagagtgccgggatttacaggtgtgagccaccatgcccagcccttttcaatattgtttttgaaaattccatcctatactgccaaatataaatatatcccaagaaattaaaatacagaaaattaaattgcaaagaaaatatggttgcagaattcttgcaatttaattttagtaaattctttatcttttttattaacataccttaaaattgctatgcacatattttctgtctcagttatgtactcaactagaaattacctttacttaactacctgtattttattgaaatactgtgcccatcctgcatggactattttgcgtcacttattttatgaatatcactattggatatgctcttttgcaccaatagactcttattcaggtatgacacacagagacacaaaatgctaaattctcctttcctgtgaccatggcagaaactactaatcaatattcttgggcaaagttggttctcaagatgctcaagctctgctgttgtcataaagcattttggttctcttctgatactttttgaagactcatccatttttcattctttcagcaaacatgaccatgataccccatatagaccagatattgtgctacagttgcgaaaacaaagaataagagaggtcctcaagcggctcaacatctcatggtgaaaatgagatgctgagccaccactaacatgctagctgttaagtatgtccacttaaaagagaacacaggagaaacatctcaggcggactctgttggcgtggttggtggtgagggaatgttgaagagtggatagaggtataattaaaggctttctggatggcgtggtggcttatatgagtagtcccagcactttgggtgggattacagcacttgaggtcaagagctggagatgtgcctggccaatatggtgaaaccccgtctctactaaaaatacaaaaattagcagctgagtgtggtagtgtggcgcctgtaatgccagctacacgggaggctgaggcatgagaatcacttgaactcaggaggtggaagtttcagtgggcggagatcgcaccactgcactccagccagggtgatgaagtgagactctgtcaatcaaacaatcaatcaatcaatcaatcaaggcttcccaagggggaggaatctggcatttttgtaggcaaaggaaacagcttataagatgtgagagaacacagccattttagagaagtgtacattgttcagtgttactggactatagttttcaagagatgaagttggggaagtaagcaggtaaattgtgaagatcattccaagtcatgttgtaaagctgggaaagctataagtaaccactgaagaattttaagcagtatttgtgagagcctccaatttagggagtatccaatttataaatatcttcatatagtttaaaaagaaatagttattttatgtggtttcctatggcaccaactagaatgtttctgggatgatccagaaacatgtacaagtgatctgctgctgagatgcagattatatttcttcaaaaaaacctggatcaaaaattttgtcgttttacttttaaaacgaatttgagtcagaatccattatatattattctctggtgtagagcataatggaataactataatacagctcaataaaaatgaaaacaagaggatatcataaaaagacggtttcaaagaacattttgaggccaagtgcagtggctcatgcctgtaatcccagcactttgggaggacaaggagggaggatggcttgaagccaggagtttgagaccagcctgagcaaacattaggagacccccatcttcacaaaaaataaaattagctagatgtggtggcatgtgcctatagttctagctactcgagaagctcacttgactccaggagtttgagactgtagtaggctatgatcagccactgcactccagcctggtgacaatgagatgctgtcttaaaattaaaaaaataataaaaaaagaagttttctttcaaaaagacagaacaagtagttgagtgagtgttatgggttgagctgtgtcccctccaacacaactccatatgttggagtcttaaactccagtacctcaaaatgagattggagataggttatttacagaggtaaacaggttaaaatgaagtcatttggatgttccctaatccaatatgactggtgtctttatagaaaggggaaaatgtggacacagagacagatatgcacacagggagaacaccttgtgaagaccgaggttacactgctgcaattgaaggacctatcagaagctcggagagaggcctggaacagatccttctctatcgccttcagcgggagaatggccctgctgactccatgatctcagacttaaagcctccagtactgtcagacaataaacgtatgttgtttaagccatgcagtttgtgggacagtaattattcacttaacattgtcaacaggttcttggaaactgtgactttaagtaaaatgacacataaggaaagcaatttttttccgataacatcataactaaatgacattatctgagaacctattgtaattatttcacttaaagtcccagtttccaagaacttatccatgatgttaagtgaggacttactatactttgtaatggcagccctaggaaactaatacaagtagggttacaggagaagtaacttctaagaatttacatggcaactaaaagcagtaacttaccctagactggatcccatattgcagcgtaaaaattatataaatattacatgttatatatcactaacaaaagtgatatatatggagagtaaattagacgaaagtattacatcaacataagtttataaaatggataactgtgctgtagttacataagaaaatatccctattcttaggaggtacacactgaaatatttagaggtaaaagaccatgaagtatgtaacttaccttaaggaattcagtaaaaatattgtgtgtatatataattatgtgggtgtgtgagtatatatacatatactacagagagggtgaaaaaagaggagagagaggaggaagggagggagagagaaaactcacataaaaaagagggagggaaaaaggttaacaatagtgaacctgagaaaagtgtataagaattctgtgggcacggcggctcacgcctgtaatcccagcactttcagaggccgagacgggcaaatcataaggtcaggagatcgagatcatcctgactaacacggtgaaatgccatctctactaaaaaaaaaaaaaaaaaaattctgtgtgctatttttttctttgcaagtttttataagtttggaattatttggaaataaaatacaaaaaaagaacttattttagacgagatcaggcactttcagggtggtacagcagtagaccaaaaaaaaaaaagaacttattttaagaacaatgcctaagcatattgctacaaacattttatttttagtatggcataagtatatgaacaaaaaaagtgaaacgataaagtgaatgaataactgattaagaaagaaagaagcggggaagaaaagaaacaaaaactcaaaaattgatttaagctatagaaattctaagtgccacagaaaattttgagatataaatttctcaaaataaaaaccaggtactatagtcacggcatttaatacaataaaaataatacaaactaaatttgcctttgcttaaaaataagaatcagaatatctactttttctttagaaagtagcttaacatttatttagaataactgttagtggagagaaaaaatggcctatttttgtttatttatataatactcacacaactattcattgtttcctagcattgcaatactttgatatttatcctaaagtttctctatgttctaatgataattctaaaatatagaattatctatctctctctatatatataaatataaattctaaaatatagcattatcattaaaaatatagaaaggaatcaaccggaccacaaaaaactaagccgttctggataagcatgtggcaatcctcttcttcctttttctttttttttggaggtgggtgggaaggtcacagtggttaacataatcaaggaaatttgctagtatatacagaagtctttgctaagaaattttcgtttgagatacaccagttaccggcaaatcaaacagacataaataccacagtaagcagtcatttatcgggtaaccctgtgcagagttgcatgaaagcatccagaggcagaacaaaatccacagcagagccgctgcttttcagatagactgccactgcaggtgccatggcccagtgccagaaacacaggcaggggaggggttacaggcagctcctgcacagcaccactgggcagaagttgcctgtaatcagagcactactgaaagcaatggtggtggcaaggtgaacttggtgagcaagcattcctctgtgaattcaatttcttcttgtgaatttcatattgcgagcccattagcctcacttctcttctctagccattatcattagcccctcgcagaaacgatgactaccagctgtaactggcagcacactaccatgataatttacacaaagattaaaaatgaaaaattaaatactgggatttctagccatcttttaactttttttattataaaaagtatctctctctctttcttcttcttcttccccttctcctttcccttctccttccccttcttttttttaacttcaaacctatagtaactttggacaagcactaagttaccataaatgaggttttgtttatttctttttcctgaagtcagtgcaacaaggtatttcaaaaccttaaagaaagaaattatgaaattaagaaatagatgacaaaatatacacctggctgggcacggtggctcacacctgtaatcccagtactttgggaggctgaggagggcagatcatttgaggtcaggagtttaaggagtttgagaccagcctgaccaacatggtgaaacccggtctctactaaaaatacaaaaaattagccaggtgtggtggtgagtgcctgtagtcccagctacttgggaggctaaggtaggagaattgcttgaacctggaaggcagaggttgcagtgagctgagattgtgccactgtactccagcctgggcgacagagcgagattctgtctcaaaaaaaaacaccacccaaaccagaagtattttgaataaagtgtcaaatacttacaaggtgtaattactattgatatcatgagcagccactgtgccaaattcatgcaccatagaagattctgaactccaaagggcctggcatgggtctttgcaatttagttatggacatgactgaatctcacatgaagaaatgtttaataatcaataaagagaaataattgaaaaactgctctaaaatgaattagatcagccatctgcacaataccatctcaagtaataattgggaaagaatatataggggtgtttctgaaatgtttcaaagaagatgagagttctgagaagagtatttgtaagtttttagattattttgctttttgagagcatagtgataagaagggtaacgatgcacgctttagggtatcatttggctaaaaaaggagtagggtaggctcatactgcaatgataagaagaacatgtggcaggcactgtggtaagaaaagcatgaggagtaactcaagctagaagcctaactattacaggttcctgtgtcaggaagagggagaaatctggcatttccccccacactttcagctatatcactgaggctgaagtctatagggaagagtaactactattagacaatccttttcaattatatagatgagatacccacggggaagaattttccaaaatttaaaaatcattaatatattttaatgaaatactaacaatgtggtagaaaatcatagaagttacttaccccagaataaacacagaatttgaatatttttctaccatggatgtagcatatattagaaatagtatcattttattttatttggcttgtatctagcacaataacatgtcactaaacaaaatgcggtttactctcatttgtccagagttcagaatttaggtgttcagagaatctagaacacagtcaaactcaaagcaactgaaggccaagaggaaaacaagcaaaaagctcatgaactttaacggtgggaggcattgggtcattcctcaagcttttaacccagccatatatgcattaaataacataatcaatcacaacaagatggaaaccctaacagagaagtgacatctgacatagaagagaactttgaatgctgacagaaaagctaaaagaaagcaaaggaatgtgggtcattttaagtgaggaacaaaaagctctatgcatctcagaaacttcaaggcatcatggaaaatgtctggaatattcaattgttagtaatacagaaaaggctatttaagatttaatttcagaaagaattctccatttaagaggcaaagaaatgtgtaatccatttcataaagagatttctcttcaagggaaatggtgaaaaccactggtatttgaaagtgtaaaccccaattctataaaacttttactgtatgatgttttaattccattcctagatgatgctgagtacctgatgcactcttctgatgccattttgaaatgtttctattaaggtaaagtagtgaatacaattaatagatattttttctcctcttaacttctttaggagataaaagatcatataacacaacatttataacactgcatagtaggcttatatataaatgtaatatatatatataaataatagcacaaattaggggtaaggaatggagctgagttggagcaaagctgctatattttactggaattaagttggtaataacctgaagtaaattgtcataatttaaaatgcagactgggtgcagtcgctcatgcctatgagcccagcactttgagaagccaagataagaggattgcttgaggtcaggagttcaagaccagcttgggcaacatagtgagacctcatctctatgaaaaataaaaaacttagctgggtgtagtggcacacgtttgtactcccagctactcaggaggctgtggtgagaagatcgtttgagcccaggaggttgaggctgcagtgagccgtgattgtaccactacactctagcctgggtgacagagtgagattctgtctcaaaaaataaaatgtatattgtagtctctataaatacgactaagaaaagaactaaaacaaatacatagtaaaaaaaatttaatgaaaatagtagaccagaaatattatttaatacaacaaagatgataaaggaggaacagaaaaacaaaaagacccaagactaaagaaaataattaataaaatggtagacatgaatccaactattatagaactctctactagatgagatttctttacatgtgctgatctatttctggattatgctattggatgctatctggattgtgctattattatgctatcaataataacattaaatgtgaataaacacttcaaatggcagagattgtcagtctagataagtaacatgatccaactatatgctatctacaaaagacattttgaaagtgtccaaaatccaaaaaaatggattgaaaataaaataatggaaaaaggtataccatgcaaacagttaccataagagaactgacgtggctttaacagtatcaggcaaaacagactcaaaaattactaaaaacaaacagagacaatttatgactaaaaagttggttaatttatcaggaagacataacaattataaacatatatgcactgtgataggctgaaaaatgtacccctcacccccaggaagatatcaggtcctactccctggaatctgtaaaatgctacattacatgggaaaaggttctttgcaatgtcattaaattgaggaattttttttttggagacggaatctcactctgtagcccaggctggagtgcagtggcataattgcagctcactgcaacctccacctcccaggttcaagcgatcctcctgcctcagcctcccgagtagctggaactacaggcacacacctccatgcctggctaattttttgtatttttagtagagatggggttttgccatgttcgccaggctggtcttgacctcctgacctcaggtgatccgccctgccttagcctcccaaagtgctgggattacaggcatgagccatggtgcttggcctcagttgaggattttgagatgggaagattatcctgattatgagggaggaccctaaatgcaatcacatgtatctttagaaaatggagacagggacagatttggctatagacagaaaagaaggcaatgtgaagacacaggcagacatcctctggacgaagtgtgatactgatttcagatttctggactctagaactgtgaaagaataaatttctgctgtttaagccaccaagtgtttgcagtaatttgctatagcagctataggaaactaacatatacatttaataacagagcccaaatatacatgaagcaaaaactgatagaattgaaaacagcatttggagacttcaatatcccactagcaaaacaaaaacaaacaaaaacaaaaacaaaaaaaacaactagacagaaagtcagcaaagatacagaatagttaaacacaaaaaactaagtcaatcaactcacatccacagaacactcaacaatagcagaatatccattcttctaaagataacatgaagaattctcctatatagacccaatgctaggttgaaaacaagtctcaatacattttaagcaactgaaatcatacacagtatgctctccaatcacaatgaaattaaaaatagaaaatacaggagaaaatttggaaaatacacatttggaaaatacagaaggggattttggaaaatatttggaaaccaagcaatgcacttctaaacaatccataagccaagaaagaaaccacaagaatattaagagaattgcataagctgaatgaaaacaaggaaacaaaatatcaaaatttatgagatacagcaaaaaccacacataacgagaaaattgtaattggaaaacctgatattggaagagaagaactcaaataaaaaaactaggtttccaatttaataatctagttagagtaaactaaacccaaagcaagcaaaaggaaagaaagaatgaatattagagcgaaaactcaacgaaagagaacacagagacaccatagaggaaaccagtgaaacaaaaagttggctctttgaaaagacaacaaaattgacaaacccttttagcaagactgagccagaaaaaaagataacaccaattaccaaaaatcagtataaatgaggtaatatcattactaaccttagagaaattaaaatgataataagtcatactatgaacaactttataaaaataaattagttaaatggacaaattccaagaaagaaataaattactgacatagattcaagaaaaaatttaaaaaaaatcttgatagacctataaaaactaaaaaaactgatttggtaatttaaaatcttctcacaaagaaaaggccatgcctaaatagcgtcagtggtgaattccaccaaacatttaaagaagaaataatatgtagcattcacaaagtccttcaaaaatatagaggaagaaggaacactgccatgtctcattctatgagactagtattaccctgataataaagtcagatgaggatatcacaaaaaaactgcaaactaatattcctcataaatatagattcaaaaatcctcaaaagtagtaattcctcaagaaaatactaacaaaacaaaaatccaggacatatcaaaagaacttaaaacatataagtgtaatatatttgtgaatgcaaggctggtttaacaaccaaaaatcaatttatataatatatcatatttcacttttttgtttcttgcttgaaaatctttccctattccaatatcacatagaaattctcctgtattatcttgttaaagtttatagttttacctttatatataaagctttaatatactttcattttgtttgtggcataaaataaggttccaattaaaatttttttccccatatatctgctataggttgaattgtggccactccccccaaatttttatgttaaagtctcaacctaacagcacctcagaaggtggccttatatgaaaattgggtcattacagaagtctttatttaggataggccatactggagtagggtgagtccttaatctaatatgaatggtgtccttattaaaaggaaaaatttggacagacagacatgcatagagggaggatgatgtgaagagacacaaggagaagacagccacatataagccaatcagagggctagaacaggtccttcccgtacagcatttaggagaaatcaaccctgctaaactttgatttcagacctctggactccaaacctgtgagacaataaatttctgttgtttctacccagataatcatactttgttacagaagccctaggaaactaataaaataactatttatctcagaatcctaaattgaaaagtccttcctttccccacagttctgcaatactagctctataatggatgaggtttctttacatatcctggcctatttctgggttctctgttcacttttcctgtactacttctccttccctaattactatagctttataataatttttgatatctagtaaagcaagtccctctgaaatctgctcttgttccccaaaaggattttggccataatggtcctttgctctttaaaatcagtttatcatcttccaacaaaacaaagtaaacctactgaatggtttttatatttttacattgactttataaataaatgtggggagaattaacaatctatcaatatggcaaatcttttttcctcttatttaggtgtcctcgttttttaactaaaaatttcacagtaaattacatatcacggctaaaagcaaaccaaacaatagtaattttagactcttcatacctatctccctacattcccagggaatttaaatccaaccactgcactgggagtaaagaggatgaagacatgagagggagataccctcagctaacaataattatttccaactgcagccaccacggctgtttacattcttggccacatcattatcaatatgggaaatgaaaaggaaacaataacaacaaaaaaaacaatttgaaaaaagcttctggcatttcaattccaaaaatttttttttttaaatgttgtctggtcagtggtcttaagaatgtcatttccccactcttgttcagtggggggcatgacagtctgtctctatgctgtcatcacttgagaagtgtaaattttccattcagagaaaaaaattatacaagattgacctaattcattcagaggtgtaagatctataaaggtttatgttgaatagatttaaattttagcaatgatagaaacaagtttagattttatttctttatcaaccttgttttttcctgtcaggcaatactatgaaaggacagcatctcttttaacttgtccacatattctctgatgataatggaaagcagatagtatattcattttatttttctttaccttgttaagtgagtactatttgtgtcaccattatgaaatagtagaggagacaaaagctatagaacatacacaaaagtaaatgtgattttaactggtaaccttaggacaattcaacaagagaacgcttcctttgctatattaatgccacctccaggccttgagaagctttctgtttcaacaaggtatcaaagagaaggtaatctccaaatagggatattgtctcttattcatcgaatctaatagtgctggtccataagcaagcacccaataaatacatgttaaatgaatgaactattataatttgaatcaattatgtatattatgtatcttttggctaaaacaaaatgctctatttttaaaggtcaacttttagtgattctccccagagtatggttttctttgtctcttattcaacatgaaacttgaaggttataagaggcagtataatatgtaggtccaaacattgacattatatcataagagacagatgatgggcattccgaactcataaatttttctattatttgaaagtatgaaagcctttttctcatttatatttctgatgctgtatctgaaataaatttttttcctagttcaggtaatagtagataacagggaccaatctcagggatataattaagactgctttggttttaccctgattccaactgttcagaacaaaatataatttacttctctgaaaaactaatgaaatttaggtgagttttccttctaaaatatgtaggatattatcttctgttcataagcccatccacttagccagttttccaatcctacatttagatcttcattacttacagaaaactgaggataagagtcgttgggtgagacagtagttacagtcctctaacacaaacagggaatgtagcattactggttcactaccaaaatcatgctcctaaaaataccctatcctcttgaattaacaaccaaatacttaaaaaagacatgctgggtatcttaaaatgagtatgtcagttaattaattctctgatcccctgctaccaaccgagtattgtataatctgttattattcactgtcctatagatcatctgttcttggtgctggtttgttccaggaagagggacagctgcaacactatatccctgttcaacctgaggaccatctgactttaattgtaacacacagcttgatgtggctctggctatgagaagccgaagtatcgtctgtaataatctggaaaagcagaaacctgccaacagagggctgaaaacagggattgtgctgtctggctgcctgacgggctgcaggaaatatgattaatgagtaaggtataatgatatcaggaacccgattagcaccacaaaaaggtcacagatcaaagtagtatgcatttcatgagctgcaatcattgcataaaatctgtggaattgaagtggtaaaccaaaaagaggagggggatgaaactcttatgtgacaatatgctaaccaatacataagatacaatactaacaatttagtcacttgtagaaagttaaaaagaaattacaaaatgaatcaatatagactatattgtaaggaaactttgttcatcagaggtgtaaaataaatattttgaatgaatgaatgaggtattaaattctttcataaaggcacatatatgtaaaatcaagtatctttcctaattatgaattaaaatgaccagatatatactcaactctaaactatgtttgcatttgaattgcagtgattttatatacagttctgtttaggaatgtaagctaattcagagtctaaacaatgaagacatctataaaactcaagcagtaggaatcactgggaaaaatattaagtaaactcaataataatgttataacaaatgcacagttaatactgcaaaatattatttggtatataactttacaatcatgcccaagtttagagcgtgggtagccaaaatccaaatctacttgtaaagcaattacgtaaaccacaatcttcttttccttagtgcccttgtaaacctgtcccaaatagacctggctcttctgaggtgaaggcagtgagggtagagatgggaggtactgtcaagagagcggcttgccttaacttatgtaattaaattttttaattgtcaaaatgttggtgaaaaacttaatatataacttattcaaatgtttctgccttttagagctcctttaaagtgaagtaaacatactaacaaacttctttatattattaataatactaactatggtaatgattaacagaaaaccgattcccttgagacttaaaatttcaagtcatatttgagaaaaagtgtgtcaataaaaaaatgatcagaacatgattttttcttaaaagtatattcaccaataatgaggatattttgtatcttttatatattgtataaatatttaatatctaatatttagttaaaacattttttaaatcgtgattcaaaagacaccattaaaaaataaaaaaaggctagttaaaaaatattttcaaaatatatgttggataaatgacttttatggagaatacacaaagatctcttacaattcactaataaaaagacaacccaatttaaaaacaggcaaaatatttgaatggatacttcaccaaagaaaatatatatatatatgagtagcaaataagtcggtgaaaagatggttaacattttcatcattaggataatgcaaattaaaataacaatgacctacctactagaatggctaaaataaataagactgacaataccaagtcttgttaaggatagggaaaaactgaaacttcatacattgtaggaatacaaaatggtaaacatttttattatatgacccaggaattcccagaaatctacccaagagaaataaaaacagatgtccacaccaagacttatacgcaaatatttataatagcccaaactagaaaaaaaagtccattaactagtaaagagattttaaaatgtgatatatctataaaatggaatactatacagcaatacaaagaaattaactactgatatatgcacaacatggatgaatctcaaaaaacatcatgctaactgaaagaagacaggcataaaaagactacatattgtatgattccattaatataaaatttctagaaaagcaaaacagagacagaatcagtgattgcctggagccggcagtggaagcagaggctgactataaagaggcccaaggaaactttttgtactcgtgagtgttctaaagctggaatgtagtggcagttacataactgtatacacttactaaactccttgaattgcatactttaagaagttgaattttattatatatagattgtacctcaatgaatttgttttaaaagaaaaatcactgaaagaaaaaagttgtagtatgaatgtaacttctattcacttttgtgtatccctggggaaaaaaaaccacacacgaccatagacacctgccgcatttaaaggtttgacatttccttcagtatctttcagagcaagtttagtcttcatctctcaatcacagaaactttgtgagaatctttaaaaattcttggggtaaaagtaaaatgcaacatgttccataagactgtgatagaataatattatttactattttctgagtgcctactataagccagataatattctaggcatttacatacataattacaattgtttactcataatttcaaaattacaaatgaaaaaaccaaagctcagaaaggttaaactgctaaggtcccacaatcagcaatgtgattgataaaggattggaaaatctggtcagattccaaagcttacatattctttccactcccctgcattgtttccagtatatatagaatgcaaaatttcaataataatgagactgtaataggatctggaagataggattaattgttggtatgaaaagaaaggaatgccacattaaaaaaatgcaataattttccttttttacatgtgaagtaaaaacaatgcaactgagatttcacttttaatgtagagtgtggtaaacattctacttttattttttaaatttattttattttttattttttcgagacagagtttcactgtgtcacccaggctggagtacaatggcatgatatcagctcactgcaacctctgcctcccaggttcaagcgattctcctgcctcagcctcccaagtagctgggattacaggcgcctgccaccacatccggctaatttttgtatttttaatagcagtggggtttcaccatgttgggcaggctggtctcgaactcctgacctcaggtaatccacccaccttggcctcccaaagtgctgggattacaggtgcgagccaccgcacccggccaagattctacttttaaatactaagaataaagctccctgattccaaacttctgtgaaacttaaaaggcaaaaaggaaaagtcatattagtgtctcgaaaataatactgaacccagataatgaaggacactaaagaatccactaaagaggatactaaagagttgtttgtaagcacaaattcaatgtgcttttaagttttaacattttcatattctcaatattacacgaagatttccttcaaatgatagatacaggacataatttgaaaatcttgtttctattatgaaaatgtgcaatggccttctaacctggaacacaaaattatgttcctttcctggaaagagaagctcatatttggaaaaacttacaatcccaatttcacttctaactttcgcttaaaattttgaatcatcatgtatatatgaatgtaacttaacttctgcataaaagaaactattactttatatatcaattcaataacatttcataaagtatatacaaggattcttgagctattatgtcactttcagttagtcctatcacctacagctttgtccagaagagcaagggttaatgattatacaccaacacatgaaagatgctttgagcaaaagctcatgacagacagagtagatgattattatcttaccaatctgtttatgtgaacaaattcttctgaggttttggcccaaggaggaagttcgacatcagacactactgtcccatcatccatcactccaagattataattattgaagttgacaaacatctcagggagataataaaattcagggatcaactcctatataaaaataaaagacaatgtgatattataaactgtaggatactgactagatattcaaaaaaaggacctgatcattttctattgttcagaagaacaaaataaacacagggaatttttttttctttgcatatcatagccctgtcacagtttctcataagatagacagatcctatctaacccaacttaaataagatcttactggtataaataactttcataggctttccttcatgacatgtctcataacctcaaaactcttaaatacaaatattttagtaataactgaggtttgacaagatataaacataaattaccatgctataacaataatgacaacctaactagattttttatgaggtatattgaatttttgccagaaaaacccaaaatctttctaagcattaaaatgccaatgtcttggtctcttcatcaaccaggaagataatttattacagtttagccatggtttctcagtaccttttcctcacatttcaaaacggtcaagtttaaagataccaactctgatagaagatcaaaatttaaaattagtctagaaaatgacttgcatgagaaactgagtaaattcaatatgtaactttaataatgacatttaataagcagaaaaatgcagctgcttagccttttgtgtgtaataaaccccatatataactatttcagaggctctgtagatcagacttgaaatccagtcttgacatgggtcagtggttcagtggtctttcagatatcccctcagggccagcaatggcaggcccggctttccaaacagttgagtaaaatagggaggtcatcagattttggacaaggtcagtatgaacttgccagagcagagaaaaaaaatccagcaggaattaagctattatcacctccatgatccatgtgaaatgttgcctgactttgaattgtacatcctttgtttacaatcacattaattaactaagcagggtagaaacgagcttgttcttccaaatggctgacaaccacctgaccattagacttaaaaagcattttaactgaacaattaaaaaaaaaaaaagaccttatttaaagcttagctataaataaaattagattataatcacacaaaaattttaagattctcatcttcaaaaacaatgtatataattctaattgacaaaagaggaaaacacaggtgtgtgttattttatgaagcaaaaagccatatccaatttgtctgagctaacacttattgcatggtatgagtcatactctcataccataaataaataaactcttaataaaccttattacatttaatctcacaaccactttacaaggtaaagtatcaatcatttctacttaaaaaatgaactaaggctcaaaaaagtgctttgtccaacgttaccagttggacaaaatatggaagttggaccaggacttgtttaactgtaaagcctgtgtcctcagtcatcaaataagcctgggttctacctacacagtatatgcagtgctaaacattttaagtataagtttttaacttatatacaaagtgatttttaaaaaaggaaaagaaactctaaacttttagcattttcatgatgagaaaacaactggctatcctgaatacatatatctttcatatatatatatttatctctctctatacagcaattgttatataaataattgaaaaagaatttttgtaatgtgatttatcccaataaatcactatataattttctagtattaatttgcccaagtgtgtattcaattaatttccagctttgacaaattttaccaaaatatgttattttcacttcataatacttgtgctactgaagatgaatgttactattcccaggccttgtttcacaataaagagggaggaacatgctttccttgttcattgacaatcaaaagcagcatttgcttaattaaatactaattattctcatttcagtaatacccgctgcccacttccacccccaattcacactctatcatgattagaagatagtgtccttcttttgctggttatacctaccatgctcttgttttataattctcctagattcaaagcaataattataatggatgaattttaagtgctagttttcccctgagttttaaaatttgagagatgcatcatttccattgtaaattagagatgcataataaaatatacctaaatgcatagtaaaaatatacctaaaaagtactcttaccaacaccaatttgaggaagcagaatggaacaaatgacatttcatagcaattgttacaaaaatgaagttttcaatccttctaatatatagtgtcaaaatattatgattttgtatatttgtctgtatcttctacatctgttatttcattcaggttactcaacaaattgacaaaaaatttatttgctcaaaacaaatattctccacaagtttttttggttttttgttttttttttttttggttaagagacagggtcccactctgtcacccaggttggagtacagtagtggcacaatcatagttcaccgtaacctcaaactttaatcgatctttccaccttagcctcccaagtggctaggactataggaatacactaccatgcctggctaattttttaattttttgcagtgacagggtctggctatgttgcccaggctagtctcaaactcttggcttcaagcaatcctccccaaaatatattttattcctggcccaatttatttttaaatacacatttattatgaattattatgttactttaatattgacaccttaacctaaatataaattcaattagttaaactagaaattaaatggagcaaaaccacccataaaacaaacaagaatttttaaataagtgatatgaagaaagcaatttcaaacttttaagtctttcagctacataatatctatcatgctgggaagaaggtaataaccatcagtttccatttaattactatggattttgtgatttcctaaggaaacattttatgtaaattttgtacaatgggcattgtaaacatatttcaaaattaaaaatttaaacagtaaaaattaaaaattagctttcaacatttcacttgaaatttatcaagatatgtatttgtgttttactctattttttcacctctcactcccttcacctttaattttaagagagcagacaggcatttcctttctcaagaacatttgcagggtccagagcagaggcctcttgaaggcatctttcttttctgtcttgtgtgaatctctaagcaaacagagagtatatgaggtatctaggtgaaggaggagtcaaatgttagtatttttaaagagagagaagccaaacaggcataaattttttccaagagtagggaagcaagttctcaaaatctacagtcagcattttttttttccccagcctgggggaaaggagaagggattaagaggttaggcaggaacccagaggatggggaatggtgagcgggtcactatatgcccatacagtgcctctatgtgaaatagaagaaaggtaacactgctaggctaatgcagtcctaagagaattcagtttggtaaatggagtaagtacaggctggattttagcttccgttctttctctcaatcaagtgccctttcatgaagaacaatctgcctactgtacatagtggccccatgcatggtgcacatagggaagctagtcccttggcaccatggtttttggcatcagcaaatattttctaacagtaacttggtataatcatcagagctgcctgccttcgaaagaccatatgtatcttagacaataaagatatgactaatgaagaaaacgatggactaaagatgtgaaggctagttttctaggtatcacacaagcctggactctcattcaagccttgagaaaagaaggtccctgccctaccaatctaataactatgaaggaatttttcaacagcctaatatgaagaagggctaagttcaaattaggatatttcttgtacacttgagttggtggttataattttatacctatgtcaataatggtaaaaagttagcaatatattcactgataatatcttttttttttttttttttttttgagatgaagtcttactatgtcacccaggctggagtgcagtggcgcgatcttggctcactgcaacctctgcctcctgagttcaagcgattctcatgcctcagcttccttagtagctgagattataggcgcctgtaaccataccaggttaatttttgtatttttagtagagacggggtttcagcatgttggccaggctagtctcaaactcctgacctcaggtgatctgcctgcctcggcctcccaaagtgctgggattacaggaatgagccaccaagcccagccatgataatatatgtctagcccaggcaccgtggctaaggcctgtaatcccagcactttgggaggccgaggcagaaggatggcttgtttccaggagttcaagaccagcctgagcaacatggcaagacccgtctctacaaaaaaattaaaaaatttagccaggtatggtggcatgcacctgtgcctgtagtcccagctattcgagagattgatgtgggaagactgtgagcccaggaggctgcagtgagctgtgttcacactactgcactccagcctgggtgacagagtgagaccctgtctcaaaaaaaatacatatatattatacatatatggtatatatataaagtatatatataatacacattatagtataaagtatatataatgcacattatagtataaagtatatataatacacattatagtataaagtatatataatacacattatagtatatataaagtatatataatacacattatagtatatataaagtatatataatacatatataatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatatacattataatatatataaagtatatataatatacattataatatatataaagtatatataatatacattataatatatataaagtatatataatatacattataatatatataaagtatatataatatacattataatatatataaagtatatataatatacattataatatatataaagtatatataatatacattatattatatataaagtatatataatacatagataatatataaaacatatataatatataaagtatatattatacacatatataatataaatatatacatatatcatacatattttatatatataatataaatatatacttatacatatattatatatataaagtataacatataaatatatgtcattttatgtatatatttatatatacatatatacacatacacaaaatgcaggaagaattcagtatggacagaaatacaaatagaatgtaaatgttatttcttattaaaataataaaactcataagaacacctcttaattatttgatttaaaccttaggtagaaatgaagggtgatgtagcacatcattatcacaaaaaagaaaccacatttatttagttcttattctttttttgtttgtttaacagagagcttcagtttcacgtcactgtcctagcttcatctacctgttgccaacaacttgaaggagtttctccatagcccttgattcctgaattgttcaacatatcaacagcaatagtcacaaatacattgacttaaggagtaaacaagcagcttttctctacagaccactgagcaccccaggaaggtgcagctctctgctccaccccagcgtcttggtgtctgtgtccagcaggaaggacctggcaggaggctgaatccaagcactgctttcaggccactctattctcatccctggatcctccagggaaataagggggaaaaaaaatgacttttcctgctttcaaaatggagggccttaaaatcaaccaaagttccagaacaaaaacaaaacacaggagctggctgggtgcactggctcacacctgtggtcccaacattttgggaggccaaggtgggaggactgattgagtgcaggagttcaagaccagcttggccaacatggcaagaccccatctctacaaaaaaagtaaacaaaaatcagtcgggcatcatggcatatgtctgtagtcccagctactctggagggtgaggtgaggactgcttgagcctgggagggcaaggctgcagtgagccgagttcatgccactggcaccctagcctaggaaacagagttagaccttgtctcaaaacaaaaacccaaaaaaccccccatcatctgcaaagccatgttgggagcacaactgtttcccataggctttctttttccttgccccattgacttccagaaggttttccccttacccatcattgtgacttttctcatctttcacaatggtgcaattcaataggaagaattaacaactagaaaaggaagaacaacaacaacaaaaaatctaaccctatgaaaactctgccttcaacataactccagggagatgaacattataatactggcactcctgacccacactatcctctgcaccccgtccctgaccacatcctcctctctggacacttagacatcaggttccccaagggacaaggttccatgaagagcaccctgagttccttagaagaactggcactgctccggctcctctaacaactgagactggcactgtgggcaccaccaggtgagcctctggaacccacctgagggcccaaagggcttcttcatgacctggtggccagctgggcactgttctttctggtagacctgcatgtgctgcggtttgccctggaacttgccctgcagccaggctgtactgaactccaccacgtgatccaccagggcctcctaacatggaggcactcaggactgaaccaagagaaaggggatggatgccagctctgtacaagacttcattcttaatgacgttccctagccctgagaagtatttctggtccaatggtgtataagtgacaggctgagcctggcctagagcttccaaggcttgtcctcaatggaacttctcagacaggatgtcacaggtgggtgtgacctctggggaagagctccaaggcatctgacaattataaagtgccaggaagctaccaccaccaaagtacaggaccaacctcggggcagggtccctccggtcccccttcttgttggctttcttggctctggagaagtcgttcacccaaacgctgccaagcaaacaagagctgacacgcagccgcctcccagcatctcctgtaggggtgtctcccttcaaacattcctaatcatcctctccctgggggacgagctctgcggactgtgaggaggcgtcaagggtcttctgcccacttgctcccgggcctgctttgagtccacagtcccttccttctgcgcttctttttgtggaggctctggcggtgagctgttgccagcgggccccatttcttcatctggatcaaatctaaggaataatttctttccatggacctgggtgtcctggagccacagagactggaggctggtgggctatacttcttactgttgctccctgtctttaccacctgcttgcccacaaaaggagagaccgaatggtgaaatgtcctcaccaacagcccttctggcatcccagctccgggtgggcagccccttggcccgacccagcaccactgcacgccccgcacagcagctccagcaccaggcagagatttctcagcgccacggcacacgtgggctccgtccccttaggggacgcccctgtaggttagttcttactctttagagagaactgttttagggtctgggatacataaaatgagtcccccccaccgcccgagaatacagatctaaatcagtaatagagaaagaatatatttttaggagaaaatacgttgtgaaaacaactagcactccagaagttcaaataagaaaattatgactaaaagttggggtggccagagaaagctttagggaaaagattgtaatacattgtatttcgctaacacagaactcatcaatctgtattataactgcttgtttgtttctatctccctctaaatggaaggatccatgaaattgaggactttacatgtgaatttaaagtatgacaagcatttctaagaaactaatagtgaggagagagattattaagattttacatatagtatgaagaacaacatcaaattagcacaattaaataagagagcgagcatatatacagcaaatcctcacctactgtcatcgatagggtcttgaaaattgcaactttatgtaaaatggcatataacaaaaccaattttaccacaggctaattgatataaatgagttaagttcccacggcatattttggttgccacaaaaacatcaccaaacttctaaaaagagacccaaaacacttctactattaaatattgaaataaatgtgagctatatgtacatctaagaaagattaacaaaaataagataattatttacccatttattccacttcagggttgcaggtggcctaacacctactgcgccaactcagggcacaagtgaggaaaccatggtgccttggacaggacaccaggtgccatcccatagcagggagcacgtgcgcgcgtgcacacacgcacacacacacacacacacagagtcagatgggtaccaggtagacacaccagttcaccttatgtgcacatctttgggatgtgggaagaaaccagagtacctggaaaaagcccacacagacatgggaagaacatgcaaacaccacacagaaagtggccccggccatgaattgatgttttttttctcaccagcgatataacaaaacattgaatgaaatgacgttatttgaggacatgctgtacttaaactatattgcagtctcatcacaagaaaatctgcatgaataagtcggtgatgagagtgcaatactctcttaatacgaaataaacatgctgaactcaactgatatataccaatatgtaacaaaataaataagcataatacagccaaaatcttactgtggatgacaatggcatttaagttatacagtagaattccattttaatactaaaagcatctttctaagaaccatatcttgatacaataccaaatattacagttcaaaattatctcttttgacagatgaaatgtagtaacagagtcaaagattatgcctttctaatacttttaatgcacatttacaaagtgaagtatgttttatattcatcagaacagaacagtcagctctggataaaaaacacatgttcagcaattctttaaaacatcagtggaaaatgataagtaaacaacactgacagaagacagatacatttacaattcacgttttcttctggcttgctcaaaataattttaatctctatcacttaattaggtagatgggtcttagaggcaggtaacatggccaacatttagtgtatcatctcctaagataaaaatttgaaaggttcaaccagaggttacaccacagttcaggataagctcattgctttgatcacaaatcccaaggctttcatggcataatgacaaggattggttgtgaccacacatatgctttagttttctttattaaggtataatttccactgatatgaacaacctttgcagccaggctgtatgattctccttttaatagtcaccaattctatgcactgaactaaacccaccacttcaatatattggggcaaacataccaactactaatctatcaaccaaaaagaaacaagataatcaaaatagaaataaaaatgaagaagctcctttttagttaaaattaaatatttatttcatttttcctaaatatgaaatattgacaactcaaatagaagcatgataaattagaagttaactaatttaaggtgcactgcttagggacactgatggtaaaaaaatgtgaaagcaaaattttagcttttcaccactgaaaaaatgatttaaaaaattgaaaataagctttcttaattaacaaaaaagagctgattaacaatatattataaaaatataatgtgcatgttttgatacattttaattttcaagatttattttgttagcccataataaaacttttaaaaaattcactagagatcaagaacattgaattgcatttataatagttattttaaatcaactgcatatctgaaagctttcaagttgatatttaaatttagtttgtcctaatttggtagataaaatgctgttttttcctacagtaaaagaaaaacaatcattttcaaaattggaaaagaaaaaataatctataatccttccagaccaaccccataaatattatgtggtttttagatattataaaactgttatttcaaatgcattacaataaagaaaaatcatggattacaaatcaatagataaatgataatctatttcaatctgatatagtagaaaaaataattgggtttaagtcttgtctactcaacttactgtcacatgtactcaaattaatttaatttctgtgacccttactcacctcaattgccatttcaaaatcacagggtttgctgtgaggctcatatgggataatgcggaattctatatatacataagatattattatcattagtaggattcatgataaaaatcccaaattacagactcaacttgcctaaatcctaaagccaataggtcattcactgaattatgcccatttataaaagcatttaacataactctaagaatacttaacaaaacttactttcaaaaatatatatgcccacaaaaatatttgagacttaatacttcctgccaaataactatgacattcaaaacaaatatattattttttttattagcaatgacagtagggtttaacatgcttcatattatgataaatatccccaataatttatggttctttcttgctttcaacacatttttcacttccatgtttgaaatggacatctccattgggccttttgctgttctagacccttatctccaaataaattataatttggaaagaaataatgggcaataataatgcaaacaaaaagtgagctgtaactgccgtaagagaagatgcaaataaaatttctggaataagtggtagacatatatttagtatgggagaagaaccacttatctcagtatctaagaacgcattaatgaacagtctacattttctagttgaacaaaaaatatgataagatcaccagtcaaaaaacaaatcacacttgacatatgcatgcatttttataattctggaagacatgaatattttccaaatgccttaataggtttttaattttcctgtatagtatgtaaatagcatgagaagaaaaatattcagggtttcaagtaatttttatcaatgagcaaaatgtagttcattgtagacacgagtacaaacttcaatacttaattagcacaaagtttcatcatttaacctactgatacttgaagaaaagggctaaagagatgtggctaaattaacaaatcgcaagttatctataagttacgtataaaaagcaaggataaacagacatatttgagaaagcttgagctcactgatgaaaaagaagagaggctggcaaaaaacagaaggaaggagggaagataggaaggagaaaggaatgagcacttaagttgaaaatgtgcaaatgcatgaataaggataagattttaattttactttctttcagcattttttaaaactctaaattattaaaatggtgtctgagaaccggatgcagattttttttactaagaaaataaaattactaaatcatcgaagtttaagttttttaaaaaataaatacattaagaaatacattgccatcaattatgttctattaactgtagctaagcattttcttataaacgggcctaatgttgatgatatcagcatccatggaatgtattaacatggtagaagatgtgctgctagggaaagaagaaacctaatttatcttcagattgcagacctctgggatttctgaggtagtaaagggaagtcaaaggtctcatgttttacaaatctcacaagccacaaaactattctatgatcacctctactgtatattattatttaacatgcatatgtaatttaaaactttttaagggttaaatattaaattatatatgagttcatataatattactgcatagtcatttatttttaaaataatatttagtatctcttaggacttaattgcattctatttacttaactgtaaatatagaatatactttactgaccctactaacttcataacttaatacactcaccactaatgatgcacattaaattataaaataggtttttaagtgaaaaatccaagatatgaccagtgatggtatgtccatgttcgcaaagctatcacagtaataaaatgtagaaaattgaatcattaacaacttgtggtcagcatctgacatccagctaccagttctcttgtggacataaaatctcatcctaaaaaatgagatgttagtagtcccacttcatatcaggcatatatccatttgagtttggctgtgcccttctggctagaataagcatacactctccattttctcctcaaactacctcgctatttttcccaggctctttcactaactcttagaaaagctttatgcctcctgtcccttacagtcaaccaaatgctcatttgtttgcatatctttaatagctgtgacacagatcaggcagattgcaaagtcaatcatatctattatctggctattacttgctgaactggcttatataattaactcaagcatttttagactgttaccaaaggccttcatattagactcaactgcctttcagaatctctgtttctatgttttctacacacccgaaacataagaccaattaacagatcaataagcaatgtgccaaacgtcttttctgagctttgttcatgtcacttcccttgctcagaaccctcttcctcatttcatcacattattaattcaatacatatttaatttagtgcctaccatgctccaaacacctttgtagattgtagggataaaccaatgaggaaaacagtcaaaaatttaggatctcatggagctaatggtcaagtgggatatgacataataaacaaatcaataagcatgagataagtatgtcagatggtgagtgacataaagaaatatgaagtcagggagtaagtaaaagtgcatgaggtgatgggggcaattttaaatagggaggagagagaaggccttactgaaaaggtgacatttgagcaaaaacctgaaaggcatgaagaatgagttcttaaagataactaaaacaaatgcctcaggtgaaaggaaaaggaaaatcaaaggtgctgaggtcagaagtacttgaaggacaccaagcagaccctgtttagctagaacagagtgaacggggtggcaaacagaagagctcaagatgtaataggattttggaaaggagttaggtagtgtagggtcttacgttgcaaagatttcagcttatactcaaataggaaaccatttacgatagggggaagactgtaagaatagctttgaagaaatgaagatcaggaatttagttttgaacatgttaaatttaagatacagtttatatattcaaatggagatgtcgaggagggagtcagatatcaggagaaatgcacaggctagagacataaatgtgggaggtctgttagactctcctgcatcccttaagatacagcttaaaaatcacttattctgtaaagtcatttgcaatcccatctcccccagtcagaattaatttaattttgtttatatcttactatataagatatagcacttatcactatctaatttgtactaaaaattattttatatatgcctgtctttttcatctggagagatatgctaactaaagaactatgtctattttattcttttaattctaaatgctctctactatatattaaatatagcaaataaccaataaatgctagcctaactaaacgtgttttgggggattttaattgacttctcatagttttcttcttaaaggcagggagctaaatatctatgacctaacaaaacttgttctttcttctgtgctatatatatatgcccaagtcaaatttaatctttcactctctctctctcatcttacaagacaaatcaatcaccaaatcttaacagttaccttctaaatatatcttaaatgtatccacatttctctagccccactggcattactgaatataagccttcactgctccttgcctaattaacaacttactgactgcttccactctgggccatagacaagggcaatacatatgtcaacaccaatcacagcggtctcttaaaagcacaaaatctattcatgtcacttctttgcttcaaactctcccaagtctccccactgcacccaggataaagttcatcctctttcacaaagcagaaggcccctcatgattggtcctgaatctcctctttcctcttccttctcttcatttcagacgctgtatccatgagcccaaggggcatgagcctactgtactaaattgctgggacttgttttactgtaggtatctcctctagtgcaaaagcccactgaaggcaagaattgtgtcatatttggtgctatatcacaaccagagtctgacactggataaacacaattaaaatacaaaattttaaaagtaaatgatatctcagggttcctccaaactttttaatctaatttacttttgtacaggttataatttaataatatattattatattaaattcggggtttctaaaaaagtatggttctccaacaatctccgtttcagatccatttactactgtccccattccaaagtaatgaactgggatgacatttatgattccttctatgttctagtaccaagtagtaatcatttctacaggagagaaagaaaataatttaaactgcagcaagtcagattgtacttcaccattagattgaatttatcaacactaaaggaatctgaaatgagtaggcaacctcaagagaaggggaaaaaatcaatgacaataaattgcctagaaaagcttagatatttgcctaatatttagatgtagctgtctagtcaaattcatttaaacttcatgagtctaatttgttacataaaatttggtcataataattcaaggttcaggctgaagaaagtaaactattctgaaccccagtttctaaatttaagtgaattttaaagatttaaaacacagaatctactggggattttaaaatattatttatcacagtgataattctccaacccaattttaatactttgtatttcagtcttcaagattacagattgttgctactaattgtctgtttatttttagatgaagtacacatcagaaacatcattgttcaaaaagggtgaaggcattctttccataagcccaaactatcccttgatgtgattccaaaacaatgctctgaatctgcactgccccaagacagcagccactagccacaaatggctattgaacacaaaatgtgtggctagtctcaacacagatgtgccatgtaaatagagacatgttgagtataaaataccactggaagacttagtatcaaaaaatgtaaaatatctaataattttatattgattacatattgaaataatattttggatatatacggttaagataaattattaaaattaatttttttttacttttaaaaatacgactatgaaatcatttaattacataagtggcttatatttgtggtttgtattatatttccattggagagtcgctctaagtctacttagaaaactgatcaacactactgatctgcttcttcagggagaataaaaaccatcattgagaggtcagatctgaaatggaatcaccaatgatgcagagaaatacaaattatccacaaaactttaaaaacagtaaattatgctataaataaaagattgctttagtgtaaaaaaaggtctcttctttaaaataaaaagaattaacattttaaccttcatttcataggaataacctcaattttgggtaatattattctttgagtattgggaaaatttaagaaatagggattttaagatattcaagtaacagctccccctcagcaaaaaaacaattaagttaccagaaatgtgaccctattcttatttttttctttctgaaaaaatttaaatcttcttcataccttacatttcgtttttggaaaatctcacaaaaacattttacagaatgtatactatattaatcaggcaaggtatgctttaggatctactcaataaaatgattcctaccaccccaccatcatatttcaccatctcctctctactgtttaacatttctttagtatttctaggaactccagcaagacaatacaaataaagttgacaattataactaataatgactccacctgaaatatgtgatagctgaatgaaatatttacatatatttacatatattacagtaatttaagtgtgttcttttttttttttttttttttttttgagacacagtctccctgtcacccaggctggagtgcagtggcgctatctcggctcactgcaagctccgcctcctgggttcacgccattctcctgcctcagcctcccgagtagctgggactacaggtgcctgccacattttttgtatttttagtagagacggagtttcaccgtgttagtcaggatggtctcgatctcctgacctcgtgatccgcccgcctcggcttctcaaagtgttaagtgtgttcttatatatttatctctattataataatttaaatatactttctaaggtgccaaaatataacattttaaaaataaacaggatcaaaacaacaacaacagaggcatgattaaattcctcctgttttagaaagaccaaccaacaggaggttctttaaatagcctgtataaccatatattatacaattgtcaaagtatttgaaagtcactaagttttagggcccaaattagctggttatcaatataaaaatgggggtaatttatcaatgccctacttactatcctacagatattagggcatggtgatggagatggagaaggagaatatacacattggtggaaaaatatcagtaggcttcacaaagtaagttctgaaaaaaattttgtgcttccaaacataatgaaacatattccaaacataagagggagctggatttgactccttattatttgtgatgaaacaagaataataagaaaaataaggaagaagaaaggtaaagaagaccatgtgatttcttttgatgttatagttgtttagatttcttttttattttttttacaggtagggtattttaaagaatttttagagaaaatgaaaccagacacaaaccaattaaagaatcttgaaagaaaaaggctgaggttcaggaaaaaaagaaaacaaaatcactagcatctatcatatgtacctcctgcccatcaaagcaatgaacaggaatgtctagtacagatagaggcagaaagctgaagatacctactattgctattataaagcagcaaaacataatattcaaattcatgacttcatttttgtttatatttctagtagcaaacttaggtatgaggttaaaatttggtcatgagatgcttaacaaatgaaggaatttggaaagaaaaaaaaacccacacataagtcttcaatttcataacaaaatgtcaggcttatcaatattttcatttctcttattatttctcaaaagagttacataagtaattaaacagctttgagattagaggtaaaatttaacaaaattattatatctgttaactattcttacttacttttatctaaacatccaattcaaaattatttactggtgatttttaaagagtatgatatataattttcaagagtatatcagagtatattatttgtgagatcaaaaaccctgatagatgtcccaataaaagattatttttgtatacaatagaatcttctttaataaagtatctttcacataagcaatgtactctacagtaagatgtgaatacattttgtagactttaaagtatcatacctaaaagcaagatgcaattgtcattatactgaaaaaatttttaagtactctacagtaacatacacattagcagtataacttttctccttttggactccaatatttctcatctggcacttattttctcccatatggtataattatttatatatgtcatatttctctatggaactataaggaacttcaaaaccatagggatatctcattatacttaatagatctaacacagtacaccttgcagaaagagacaccatttaaaaaaaaatagactgtatttctgtaggtagaagcaaaattctagtaaggactattactagctactgtgcagtttttgatcctttgatctttcatgcatatagatagaataactcttgtttttgctttattaataatggaatgctttactaagcaaaatcaggtatgcttttagaaccagcagcaggcaaaacacaattatttcaagaacgggtacataggatatctaaatatctatgtctgagatttttctcatggtatttttcagactatagtaattttgttcactgagtttggaattccagccaggcacaatggctcacacctgtaatcccagcactttgggtggctgaggaaggaagatcgcgtaagacagttcaagaccagcctgggcaacatagggagaccccatctttacaaaaaataaaaaattagcctagcgtggtggtacatgcctgtggtcccagctactcaggaggctgaggcaggaggatcacttgagcctggaaggtcgaggttgaggctacagtgaattgtgattgtgccactgcacctctagcctgagtgacaaagcgagaccttgtttcaagaaaaaaaaaaaagagttcggaatcccattacgcatggtgccttacatgctttacattcacactacctaccatattttcccttcaacaaaaagattctaaagagaaagggaaaataaaaaaaacactctacaacaaaagacagagagagaggaaggagagattctgatagaggagagacagtcatgtagaacttacagggagaggccgggcgcggtggctcacacctgtaatatcaacactttgggaggctgaggcaggcagatcacttgaggtcaggagttccagaccagtctggccaacatggtgaaaccccatctctactaaaaaaaaatacaaaaaaactagccaggcgttgtggcagatgcctgtaatcccagctacttgggaggctgaggcagaagaatcgcttgaaccctagaggtggaggtggcagtgagccaagatcacgccattgcactccagcctgaaggacagagcaagactctgtctccaaaacaaaaacaaaaacaaaaacaaaaacaaaacaataacaacaaaaactcccagggaaagacaagagatagagacagagagagacatgctgtaattcttggccatttaattaaggacttatcttctgagatttatcttttgtaaatagggctgtatggcagtagagaaaattttcaacattcactcaacaagtaatgcactggcaataacaactataaaacaaaacatttctgtaccttaatatcagaggtatcacgctgactgtttcgccaagctctggaaattgatgaaaaagttcgatctgcatgatcaaatttgcctccttgcaaatttaggaaataagttgtaaagggttcctaaaaaatagcaattaaaaaaatccatatgttccctcaggcataaaaatgtggtttttataaattcttagaactaaatactttaatgactaataggcattcactagtaatataaactaggtatataatgagaattatatctaaattattacattaatgttctcaagttatttttccctcaaaagaaatatttctaaatatttcaaaaatttggtatttgcaacattttcttcaggtagccttcctttccaagaataatgtattaatatcatacagacataaattagatgtattttcttcatagtacagggaatagtccagtatgtagttttcctattgttatggctcaatatttaatttatgattaagaaaagaaaaatgtttggatgatttaaaagcctcctcttagttaaagaacacttaaacacatattagtggataattgcttgaaattagctaagcactataaattacttctaggatttatgtctgcctgtatccttctaacaagctttaattaatgatgtgctgctaatgcttttccgaagaaattgctttctagtagatgaatcacctttcaatttcacagaaacatttcttgtttaaccaatatattatcaatacacgacagccttagttttaccaacaaacttaccttattccatttgggacaaccttccaaaatatataagtacatgtctgtgttagtaacaacttacttagttcttattttaatagactacattttaaaagaatttatgctacaatttggaatctggtaagacagcaagcatctgaaggggcaaatttaagaaaaaaattcatacaattccagatgaaacatttttaaggcaatacaagccaaatgagatagagatatttataattagaacttcaataatttaaactgactcttttagtattcaaaaaaatatgcttatgagttctaatttttgcatatccttcacaacactgaatttatttagccatggtgtattattcaaattgaacttactattcttagcagccatgcaagaacaaaacttgcagttgagtaatgagtaccatagtgaaactttggaacttgatcatcttcccatgattcataacgctcagcgaagaatgctgctctttttgggttcagagctcctattggctgccaatagggagggaaaaaacaaagaatacatcaatgtaatcatccttcatgtcttcctctcttctgatgatatcctactggtaagtataaaagtgaattttaaaaatatatactacttaagctgcaacacagtatcatattgggagtaaaaagcaatattttttccaacaagttaaacacaacatataagtaagtgaatggatgaacccatcatttctccataagtctagttttcatggaacataggtgtttaatcatcccataacaagcatcagataaagacaattacatgaagtgaaatatcagctgtacaacactttggaaagcacctataaaaccacatttagttaattagaagcaacaaccagaaacagaatcttaaagctgaaggactgacttataatgggttcttagaagaggatgaaacaaaactgggagataggtgagatggagcacaaaggaagaaagaaattgtgggaaaacagggttaagaaactagaaatttctactagtgtgagtgaaaacaaaggataaaaatatgcctatatgtctatataggatatatagatatatacatatatatgtatatactttaaccagaggattaaaaatatgccggcatgaactctctctctctctctatatatatatattataaaattaaaaatatcacattaaaaataatgctatatatatatcgcattaaaaaaagaatagtagacagattatgaacttatactggaaaataatactttacagcagaggtcccagagcaatatagcaacatggtgaaaaccctgagctcactggaatgataataatactcattcaaaaggttgttttggaagataaaaatgagtaggtacgttaaagtccaacaaactatgcctgacaacgttcaatgaatgctaactatggtttttaagataattgtttagaatttgggttaaagagtttgaatgaaataattgcctttagcaaattgcttagcataagataaagcttaataaatgttagttggtacctgtatctttattattgctactgctgttgtcatttaggtaatacacgaactccattaaatagcaggcaaaattctgtgtgatcaagcctatgcatgtacatatccttacaaagacgtagagaatatgcttgagagtctcaaaggagtctaaggctcaaaaaatgttaagatcaactgctttaagtaacaattcattctcaaaaaacattctgatctctagaaaatctctattccgtattcaaaatgttaagtacccactcactgaaaaagacatgatatataagattacttcttttcataagatacagaggccaggtgcagtggttcacacctataatcccagtgctctgggaggtcgaggtgggagattgtttgagtccaggagttcaagaccagcctgtgcaacatagtgagaccctgtttctacaaaaaaatttaaaaatcggctgcgcatagtggcatgtccctgtaatcccagctactcgggaggctgaggtaggaggattacatgagcccaagcaccttaaagcctacagtgagctatgattgtgccactgtactccagccttggtgatggagagagtccctgtcctgtctctaaataaattaataaataaaaaattctttatttaaaaaaagatacacaacagtcttttgccttatatcatttatgaacacctattagttaatcactccttatttataacagaaagaaaatatctgattatttgtggagaaaatgttaaaataaataaatcaaaaatattggtttaaaagggatgcactgagaaatattttattgaaaatgaagcaatgttcagaccagtttttaaactgcttttcatgttacatgttaagcaacatcttaaatttatcattttggttatccttattaaattgttaattattttttcaaaactatctttggcatcatcactcaatagcttggttttaatgaatattattgtatgttaaggcattttttcctttacaagcaaaattttaaaaatctttaattaccattttaagtcagtttcacagtaaactaatttaaaatgctatcttttaaagcattagtttctgtacaaaagaatcatatctgacttactaaatatgtgccagttaagaatggagctgactccaaggattctttctttgttacagaaccaatttgaaatgcctttaaatgtattttagttgttgtccctaaagaatgagccatggaaaagaaaagagagaagaaataaaatcactagaagacaaattatatgaattaaaaatagaatcaatgctccttttgtatggtctgaagcataataagtattcactttatctgctcctatttttattactctccaaatgagtaacccccaaaatcaatagttatagaatcacgtttcttgaatataatgctaaaaccaattaggattgatttcactagcatctgaaaaaaaatggcatcttgcagagatccatattggtagaacccacagtattgattttggctgttattgttacagttggtttctgaagcctgctatacgacagctatcaagacataccacgtttatttgcaagcatataaaaaagaagtccccaaataaaagaaagttaaaaaaaaaagaccagtggagctgtgcaatgacaatgatacactatcagcttactcagagaagttacagtgggaatacacacattgaattatacattacgcgaaagcactgatttattgtggtaataacatccacctcattaaaagattctgctttgctgcagttggaaggctacatattgtttactgctataaattaatggcagtgcaaagaagactgtggaaccatcctaacaatagatctgtaatgacagtgctgtatatcacagcttcctcagcagcttcataataaaatggagacaatgtattgagctaatacattctaccatgctggcccacatttttctgacaactgctttaaaagatgatctgaattcaactatgttataatgctgcaaaacatttaactaagcaagagtcagtcatataccaaagtgcatcaaagcatttttaaaacattgtctaaatcagcatttcaggatgtttattcatctctgcaaaagaactaaaagtaaatgctgacggatcctcttacttatatagtatattaagagtcaaaattctaagtcagtttgggaagatgctagcaccatcatcctacatagagcttactgtacaatgtaacaagcttgacaaagtatttttcttaaaaagcaagattttaaaggaaagtgactcaaaatactggccattaaaaatggtcataatttcttttaaaaaatcagtaaaagtaagtattgattagaaagtataaaagtggtataattccaggtaaacacaaatagctctagaatacagaaaaataattttaaacactacaaaaagctaacaaataaatagaattatagaaggttttcttaactctacaaactaagaaaaaatctcaatcacaatacaatgaaaaataggtttaagtaaaatagaatagaataatttaaaatgtagagtattaggtctaacaacaaaatattatgttaaaaatataaataaaggacaggcacagtggctctgcctgtaatcccagcattttggcaggctgaagcaggagaataacttgagcccaggagtttgagaccagcctggacaacatgatgagatcctgtctctataaaaatcagaaatcagatgggcatggtggtgtatgcctatagtcccaactacttgggaggatcgcttgagtccaggaggttgaggatgcagtgagctgtaatcgcgccactgtactcagcctgggtgacagagtgagaccctgtctcaaacaaaacaaaaagcagaaataaaaacttagattaaagtaggaaaagacaaattaaagaaaaccaaaactcttggaaatggtatgaatagccaaaaatcactgtatttaggatattttaataatttcacaaatagcaaagctgacatctgtggtagaataataagtattctgcttatgagataataatgatatctttcaaaacaggatatgcaaaataaaacttgtaaaattggttttgtaagaagactgcaattaaaaaaacattttttgttacgttctttgagaagtaattttgctagttaacaaaatccctgcatataaagtgatcagttcagtgcctggtacataataataatgataataattattatttttttcaggttatttgatgaagaatatttaataaaaaaaggcactaagtaagcctgatgaaattaatgggatctattaggaaagaccgtgattaaacatcacaatcctctaaagacaaagcaggataagaacatatagtactgtggatgatctgtaagaagcctaagagtaaacagtagtccccatcaatgaattttactactttaagaacataatcaaaacaaaattacttttcaaaaatccaggggcctccaaattttactacgaaaagcataagaaatatcaagcaacttataatcacctcctactatattatttataaagaaacagtttgaattaacagactcctttaaaagcacataacagactttggtctaatattagtaaaagctgtaaaaaggtatctgttttttctttctttattaaaattttaggaactcttacctgaagttatctaattaagaataccacctccagcttacattttgtaatttattaaacattattatacattctcataataaataggtaatctagatattcctattttaataataaagaaatgaattgagtaacctagctcgaaatcaacataaatttagaagactcaaacctagtactcaaaagtccttctctgggccatgttatgtatttatatttaaaactattgtattacaagttggttttcctaatttcaaaaatgtgctgtaatctcaatttttcaaatatttctttacttaacaggttgatttaaaggccaatataagtaagcacttagaagagttcctggcacacacacaaaaaaatacttaacaagtgtagctgctattaatgtgcttatataccataactataattccttctttccttctgaaatttatatatgaatgattacaattaatatcaacctttcagaagtgaaattccaaactactggactatacttatagttattgaaggtaagaaagttctgggaaattggcaagaaatctcagattttttacaaagcagagatttgcttgtgttagctaacttctcttttaaaacccaaaagtctcaagggagtttttcacacctttctgtaaaggctttctttggaaaatcattaaactccaacgtttggagatgagaagcagaaaagattggggttaaagaaaaggaaaaaaaggtaactctaaaccaaaacactaataaatagggtgcttgaaaatgcttaagcatagtattttatcaagatacattctgtgggtatacagaggagtgaagaaaagttgtcaaaactgaaaagaagctcaggaaagggaggcaaaagagcaggactgctttacaaccctgcttaggatcctgatgactggctgaaagccatctgccaatgtaatcttcatttgatatgactgggaaatcagaaacatcctttaatttcgtgatgacagataaagcctgccttacagtactgaagaaggtgcatgcaattagaggttatatgttatttcattcttccctaaaagtagggtaggccacaggaaacaaaagaaaaccactgcaaagtaagaggaaaaaactagtaaggaatagaatacaagatggctgaactcaatgttcttctatgctataaaaatgtcaggttaaaggacagaatatcatcaagcatctgatatatgttaacatattaagtaaaaaatttcaaattcagagaataaaagaggatagatacactattaggaaatgttacatcataaaagatggtcattcttgattagggaataatgatttggtctgagaagactccagggaaaaactatgatatatatgtcaaaggtgccattttatctgatgacaatgctactatttgctgaatataagcaaaggttctacgagtcttacataaatcatctcattatctttacaacaactcttaatacaaagaccaattagcatccccaatttgcaggtgaaaaaaacagttcgggagaaagtaaatgactatcagtggttggttaccagccagtggcagcagcaagattaaaagccacctcctgactttttaatgatcgccattctaactgctgtgctgcagaggatgtagagaaataggaatacttttacactgtttgtgggactgtaaactagttcaaccattgtggaaggcagggtggtgattcctcagggatctacaactagaaataccatttgacccagccatcccattactgggtatatacccaaaggaatataaatcatgctgctataaagacacatgcacacatacatttactgcggcactactcacaacagcaaagacttggaaccaacccaaatgtccaacaataatagactggattaaaaaatgtggcatatatacaccatggaatactatgcagccataaaaaaggatgagttcatgtcctttgtaggaacatggatgaagctggaaaccatcattctcagcaaactattgcaaggacaaaaaaccaaacaccgcatgttctcactcataggtgggaaccgaacaatgagaacacttggacacaggaaggggaacatcacacaccggcacctgttgtggggtgggagcaggggggagggatagcattagaagatatacttaatgtaaatgatgagttaatgggtgcagcacaccaacatggcacatgtatacatatgtaataaacctgcatgttgtgcacatgtatcctagaacttaaagtataattaaaaaaatatatatatatatatatatttttttttttttttttttttaaagccacctccaaccaaactgactagcaaatcccagagtgatttgggttgtgtggactggtacgctgcctctgcaaggccattagaatcctttcatgggagctttagattaaatgctcttttgaaaaaatactattaaagtttttatccctacttacataatgtctgtggatatcaccttagaagaaggcatcaaaaccgaatttttttaaaaagcgtattttatcttggggacatcaaaaacatgcttggcaaatacagtttttttaaaaaatgtgaacaaaaaaggtaaatgttgtcaccaaagtttattgccttatcttccttttaacttttctgtttttttcttttctatcttttccatgaacccaaatgagagcccttaattttctgtgttgctgaggctttttatagaagccaatgaatttgattcccagtgtctccatcacctgccttcctcccccaccactctagtgaagaaaataaataaataaatagtgtctgtcatttcagcaacattgccactgttagggggtgcagcaactattttctttcaactgtagcgctctttcatctaaatgacaagtataacaggcagcctgatcagcattttcactcaaccttggcttttagggtatttcgttatatgctatataaggccgaaatggtttggcacttatcctcacatgctctagattttatttaatactgtcaagaaaaaaatttcatcagcacaccaccgtggcttttagagttaacaaataagcacttttgttgtcaagtaccagaacactttttaatcccttgaaaacacatcttcttacaagtggcattaaatatatactcactacaccatttcgatttaacaaacacatcttggggaaaagaaagtattccattttacttattgtgcctatgtagaatctaaatcatttcaaatgcttgcactgatagatttactagtgatgtcttcatagttctatgttattcagctacacagtaagtattaagtaatttttctacaggtgtttatctcattttgagaaaatcacataaactgttaaaaataatctattaatccaatgccactgctgagctaaatgcctataacgaccccatagacagtccaaaaaatccaaggataattactaaaaatgttttaagttattatgaaaatgataaagaatgctgatataacaagatctatcaatttgcagatatattcatctgcccacttaaaaaaccagttaaggccattaaaatcaaataaatctatatgcttttaagataggtcattagtggcatacatgtcaacattctgctagcttctataaaccagaaacaaaacaaaattgggaactacttaagaaacattcagcttttgaaattcattttctatttgctttgaaagtcatctgaatataataaaactggttttaatttcggaaaacctctctctctctctctctctctctctctctctctatatatatatatatatatatatatatatatatacatatatacacacacacatatatatatgttgttttgctcaacgctgagttgggaaactgtgtgcttattgtttagcttaagcctgggctaatggcactaaatatttcaatgatttgcatgtgaagcacaacaaaatatatgattataaaaagcaaggaggattccaaatccataaagattagtaaaaatagttattttattctgttttagactaataaattgctttttggaaaaaatattaaatcgttttaaaaatgtgtttatttatttagagacaggctcttactctgttaccctggctcacatgcagtgatacagccatagctcactgcagcctcgaactcctgggctcaaacgattcttctgcctcagcctcctgagcagctaggactacaggtgcatgctaccacactgacataattttttagttttttgtagacccaggctggccttgaactcctggcctcaaacaatactccctcctcagccttcctaagtgctgggattacagccatgagccaccacccttggctggaaaaatactaaatcttaatacaaaaattagacataaagtagcataagttaaagatatcaatatataaggcatggatggaactagaggcattatgttaagggaaataagccaagcacagaaagataaatatcacatgttctcactcatattttggagctaaaaaaaaaagtggatctcataaagattaagagttagactggtggttatctgaggccaggaagggtaaggggaaaatcgatgaagggagattgattttaaaaattatgttaaagaacacagagagagccaggcatctgagttgtaaggcattttaaaactatagtgtacttcaaatatcaaacaaggagataaaatattgtttggcaaatgtaaatgagcctatgtggtagctttcagaagaaacagggcaactggaatcaatttaacaagataatctctaatgattccataagtgcaacagaagacactctaataattctcatgacttaagaatagccatgggtcatacataagagctggtaaatgttgataacgcttttggagtagattattagcaatgtgaggactgacaggcagttacattgcagttgtattcctagaaaaagcccaatcctggcaaggaaggtcaatgatattcaacctctaaaacaatccccaaaatgaagcccttataccaaaaagcagactctgctaaaatagtccagtccctgtatattcctccccagtgctccctcaaggaaagcaaaatccactagtcgaataaaacgggagcagccagattgctgaccaaaaactttgctccattgctggcgaaatgagtcaaaaaataaaggcggatgagattcacaactgctatctaaaatttaccttatttctctgtgcaagagggtatgttgggatagtcatcaacatagagaacttacattttaccctttttaaaatgaaaattttattgtacttttccctctacaactatatatctgatctatatggtgggggagggggttaaatttagtcatttaattgtagtacagtgataatcaatacttatgagggactagaaataagccagtaaagctcggatttagaaaccactgcacctgcaatagctggacagggttttgggctgcctctacaatttaagacaaaaagaaataaaacatagcataaaacataataaaaatcctttgttcagtttataagttactaccttccctttatcaactggaaaaaaaataacctcatgtaacacaaatcatatgaaataattttatgtgtcaacttgactgggccacagggtgcagagattaagcattatttcttggtatgtctgtgaagatgtttccaggtgagattagcctttaaactggtggacacagtatatagatttctttctccaatgtgggtgggcatcatccaatctgctgaggatctgaatagaagaaaatgcagagaaaggaggaatttgccctttttttcctgtctcactgctgaagctgagacagctcatctcatcttttcctgttgtcagtctgggatttacaccatcagctcccctggttctcaggcctttagacctgcaatgaattacaccaccagctttccagggtctccagcctgcagatggcagactgtgggacttctcagcctccctaatcacatcagccgatttctcataataaatctctttttggatacagatacatagataactcctattggttctgtttctctggagaacctcaagataccacatcaagaggaaatgaaattaattcataaggtaaatatagagtatttcttcatattttgagatcaatattgagattacaatcacttataaaatagaatacaaagttttataaactacctcattctggtaatagatggcaaaactatggttccaccatccacactccttttcccaaatgaggcaccttttttaaaactttcaaatttgacattacttaagaagctcattttaaaaagtgatttaacaacacgtggaggtcaaagaatgcactagacaattcacaggaagaaaagcctaagaagtccattaaccatgtatccaaaatgggtaatttcatatttaaaaagctagctaagttgaccatttcctactaaaaggaaccagaggtccttaaacaaatcgctgattctaattctggggcaggaaatatacaaaatagcctaggacaccttgttgtgccacaaggcaaaggatttgtcaaatattaatgggattgtatctaagggacataagacccttcttaaagagacctcactagacaaagtcgtggcaatttcggtaccacaaagaataatgcagttctaccttcatataaaaatgtagaaagtatcagggaatgttgctgtcattgtaacaacaataaaaagactaaaagttgataaccatttttgtactaatcagagagctgaggtaaaagacaaccaaatgaagtaaattccaaaaagttacaggcctcttcaacgagagatggtacaaactgctataattttggcaaagcatgggaggaagaggtagtcaacataaaagtaggtaagaagaaggccgggcgtggcggctcacacctgtaatcccagcacttcgggaggccgaggcaggtggatcactggaggttaggagttagagatcagcctggccaacatgatgaaaccccatctctaataaaaatacaaaaattagccaggcatggtggcaggcacctgtaataccagctacttgggaggctgaggcaggagaattgcttgaacccagaaggcagaggttgcagtgagccaagatcatgcccttgcactccagtctgagcaataagagtgaaacagtgtttcaaaaaaaaaaaaaaaaaaaagggggggggggtgggcaggaaagaagaatctgctaaaatttataaagaatttctaaataccagtattgggtgaatagatcaatgtagaaacacacgggagtttgcatgcacttgtaagctcttttccacgggcctctcccattgctcatgagagagaatacgactgaggcaaggtagaagaccagggggtagctctctaagtaacacaggcacacaggatatgatttacagttactgggaatggcaacaaaacagaaatcaaaatccttaagctgatgggagaggaacaccaaactctcattccaggtcctaagcaaatatcaacttgcacatggggaaagagtacgagcaaaactaatctaccgcaggaaaagggatagaaaatcctgtgtaccacccctaggacccaggcaaagatccactgcttctggggtagggtaaaagcaaaagccctttcaagaagacatgtcctgcactgatgcaaagaagaggtctgctactactgggagaaggataggaaattctttcctgtggatgccatgaggggtagaggcaagaacactgagaaagtccgtacctgaggaccatttcaatgggatctacttaagaatgaggatgaatcaggagaactgaggagctaccctatccaccccacaacaagcctggcactgagttaccaacaacagcaatctacttctggaaaaaaaaaaaaaaaaccagaaaagtacataaaaaaatgcctctgtggcacaggcatagagggtcggctagagagtagagcaagaacagtgagaaaaaacatccaccacccaggccaaattcttacagaagaatttgaagtttatactgtatttaaggtaataatagcaataacaaacctaactaagcttatctattgactagattgactgaactccccacactaactacctgacataagaagaagcatatacttctttgggcataaaatcttattcatatcccagcctatactgttctcctatctcagataaaatagaatcataaaaataatctaaaagaagcacataaagggagacaaagtacaaagaactgatgtgtagaataaaaaacagcaagaaggtagatttaagccaaccatataaaaaattacattaaatgtaaatgacctcaacaccccaattaaaatgcacagattgtcagactgggcatgaaagcaaggctctattatatgttgtccataaaaaaaaagttaaatataaagccatagacaggcttcttaaaataatagaaaaaatgctgcaagtaataatcaaaataatgccctcctgggatattaacatcagaaaaagtagatttcagaacatgaaatattactaagtataaagagggacattgcataatgaaaaatgaattcttttatcaaaaaaataacaatttgaagagtgtatgcactgtattagtttcctagggctcctataactaaatatcacaaactaggtggcttaaaacaatataaacttattgcctcagagttcttgaggctagaaatctgaaatcaagttgttggcaggttcatgctctctttgaagcctctagaggaggatctttccttgcctcttccaggttctggtaggctcagctgttccttggcttgcagcaacacaactctaatatctccttccatcgtcatatagtgttctctccctgtatgtctgtctttatatgacgttttcatacaagaacaccagtcatattggatttgggcccaccctaatgaccttatcttaaattgattacatcttcaaaaaccctatttatgaataaggtcacattcataggtacctggaggttaggactttaacatatctttttggaaacaaaattcaacccataacatgtacccaaaaataaacttgaaaacacgtaaaataaaaactaacagaactttggtgaggtggggtggcttacacctataatcctagcactttgggaggccaaggcagacaaatcacttgaggccaggagtttgagaccagcctggccaacacggcaaaacctgtctctactgaaaatacaattagctgggcagggtggcacatgcctgtaatcctagctactcaagaggcgaggcatgagaattgcttgaacccaggaggcagaggttgcaatgagccaagatggcaccattgcattccagcctgagtgacagggcaagactctgtctcaaaaacaaaacaaaacaaaacagaacaaacaaatagaaaaactaacagaactgaaagaaaatatagacaaatctaacttatagttggagacttcaacactcttctttcaggattcaacaggacaagtagaaatcagtacggatacagaagacatgagcaacgacatcttcaaccaattttacttaattgatatttatagaacaatacttaacaacagaatatgcactcttttcaaatgcacatggaacattaatcaaggtagactatattctgagccatcgaacaaattctcagtaactgaaaagaactgaaatcatacagcgtatgttcctcaaccacaatggaattaaactagaaataaacacaagaaagacatctgacaaatccccaaatacatggtaactaaacaacatatttctaaataatccatgggtcaaaaagcaatttacaagagaaattagaaaacatttaaatgggatgaaaataaaaacaatatataaaaatgtgttggacccagctaaatcagtgctttgagaaaaatttgtagtgctaaatgcttatattaaaaagaaaaaagttcttaaatcaatagtttaaagtttgcaccttaagttactaaaaaggaagataaattaaatctaaatcaaatagaaaaaatatagtatggaaagcaaagatcataggaattgaaaacagaaaaagcaatagaaaaataaataaaatctctaaccagactggtccagagggagaaaaagaagtaaatgccagtatcaagaatgaatgaagggacaacttagatgaaataaacaaattttgtgaaagatgcaaactaccaaaactcattaacaaaaagataacccgaatagcactttatctgttaaggaaactgaattcaaagttttacaaaaaaaccttcccagaaacaaaactcttggcctaaatggcttcactcatgagttccaccaaacatttaagggtgaaataataattgtatatcatcttttccaggaaatagaagaggaaaaaacaacttcaaaactcattttgtcacgtaagcattaccgtgatgccacaactaaacaatattacaggccaatatcctttgggaacatatatgcaaaaagtcttaagaaaatatttgcaaatgggatccagccatttattaaaaggataatacatcacaatctggtttatcacagaaaggaaacactatacaatcagccagtgtaattcactatactaaccaactaaaaaagaaaacgcaattatcttcagaaaaagcatttgataaaagtcaatacccaattatgatgaagactctcaacaaacttcttatagaagggaacttctttgggaggccgaggcaggcggatcacaaggtcaggagatggagaccatcctggccagcatggtgaaaccccatctctactaaaaatacaaaaattagccgcgtgcggtggtgtgcacctatagtgtcagctactcgggaggctgaggcaggagaatcgcttgaacccgggaggcagaggttgcagtgagccaagatctcaccactgcactccagcctgtgcaacagagcacgactccatctcaaaggaaaaaaaaaaaaaagaagggaacttaacctaatagaagcacctacagaaaagcctatagctaacatcacacttaagggcgaaagactgaatacttttcccctaacacaaaagacaaggcactctcagtacttgttaaccttgtatagtgcagtaagtcttcatttcacaatgccatttatgtataaagtcccaaaaagtctacaaaaaggctgctagtaataataattgagtttagcaaggatgcagaatacaaggtcaatttacaaaattcagctgtatttctatatactggcaacaaacaactggaattaaacgttttataacaagattaaaaacatgaatttttaaaggataaattaacaagatatgtgtaagaattgtatgctaaaagctatggaacatttgagagaaactaaaaaaggactaaataagcggaaaagacactatactaaggaattggaacattcaatattcttagtactttatttttacccaaaatgatctacagattgaatgcaatcctaataaaaaatctagaaggctttttaaaaattagaaattaacaggaagcaaaaagcctagaacagccaaacaatttttaaaaagaaaaataaagctggaggattcacatgactttattacatgatttactataaaaccacagtactcaagactgtgatactgatataaggatatactgattaattgtgaagaacagagtctagaaatagacctacacatatatggccgattgatttccaacaaagattccaggagacctccagagaaaaagtctttctaacaaatggtgttagaagaattggacttctacacacaaaaaaatgaaccttaactcttaccatgaacttacaatacattctagacaaaaaataagtagcattagcagccacaatacagaagaatagtaataattctgtttgatccaagttgtttttagaaaacccattaacaccattgggtcaaaataagtagatagtcaattacataatctaaatcagcagctttcaacttttcctgtaagacagtctctaatatatatacacgtacactatctattcacagatctcttgcaacaaacccacagtcccctcaagtgaccagagctcacaggttgggaacaactggcacatcttcatcttcctttctaccaacaagacaccagcaagtgttatacatttaacactgactaatcttaaacctcttttcttccttttcctgtacgaaaaattcaaccctaaatgtaagaattcataatagtccttcatatttcacttgaatatttcatgtgaatgtttcgatcaaaacgatttaaaagttttttttttctttctttgagacagagtctcactgttaccgaggctggagggcagagcacgatctccactcactgcaacctccaactccctggttcaagatattctactgcctcagcctcccaagtagctgggattacaggcacgcaccaccacatctgactaatttttgtatttttagtagagacagggttttaccatgttggccaggatggtcttgatctcctgacctcatgatctgaccgccttggcctcccaaagtgctgggattacaggcgtgagccaccacaaccaacctcaaaaatttgtattttaatttgtgtaaggtaagctacatggtcaatttgttatattagtgaaactgctgaacaagtcagaaactgggacagaattctaaaaagatgccctaaagaaggcaatatctcaagtttataaagacaattaaacaataggattgtatgatgatttgaacagttattaatgttactaacgacttttaattaccttgtctgtatttcagacaggtaacactcagattttaaaataatttactgagataggtcacactagatctataactttcccaatttactggcctaatcaaaacttttatttttcttttttaaatttttaaaaatttcaatagctttagggggtacaagtagcttttggttaagtggatgagttatatagtagtgaagtctgggcttttagtatacttgtcacccaaagagtgtaccataggtgatctttcatccctcgccttccccctcagccttctcccttctaagtctccaatgtccgttatgccactctgtatgcctttgcatacccatagcttagttcccgcttacaagtaataacatgtggtatttggttttccattcctgagttacttcacttaggataatgacctccagttccatccaaaaacttttatttcttattattaatttttttggtgttcagtgttttttatttttttttattgcttactccagttttattttattttttattttttttattatagtttaagttttagggtacatgtgcacattgtgcaggttagttacatatgtatacatgtgccatgctggtgcgctgcacccactaactcgtcatctagcattaggtatatctcccaatgctatcccctcccccacccccaccccaccacagtccccagagtgtgatattccccttcctgtgtccatgtgatctcattgttcaattcccacctatgagtgagaatatgtggtgtttggttttttgttcttgcgatagaaataccatttgacccagccatcccattactgggtatatacccaaatgactataaatcatgctgctataaagacacatgcacacatatgtttattgcggcattattcacaatagcaaagacttggaaccaacccaaatgtccaacaatgataggctggattaagaaaatgtggcacatatacaccatggaatactatgcagccataaaaaatgatgagttcatgtcctttgtagggacatggatgaaattggaaatcatcattctcaatgttttttaatttttaatttttataggtacatagtttgtgtatatacttatgggatacccaagatgttttgatacaggcaagcaatgcataataataccatgtaaaatcaagtgtctaccccttcaagcatttatcccttgtgttacaatcaaattatatttttaattatttttaaatgtacaattatattagtgttgactatagtcaccctgttgtgctatcaaatattaggtcttattctatcttgataatttttttttgtactcattaatcatccctacctatactccattccctcaccacccttcccagcctctgggaaccatccatccttctactctctatctccattagttcaatggttttgatttttagatcctcacaagtaagtgagaacatgtgatgtttgtctgtctgtgcctggtttatttcacttagcataatgacctctagttctatccatgttgttgcaaataacagtatctcattcttttttatggctgaatagtactccattgtgtataagcaccatattttctttattcattcatctgttgatggatacttaggttgcttccaaatcttggttattgtgaacggtgctgccaacaaacttgggagtgcagatacctctttgatacactgatttcctttctttagggtatacacctagaagtggaattgttggatcatatggcagctcatttttagttttctgagaagcttcaaaattgttctccacagtggttgcactaatttatgttcctaccaacagtgtacaagagttctcttttcttcacatgctcaccagcatttggtattgcttgccttttggacataagccattttaattggagtgagatgatagctcattgaagctttgatttgcatttctctgatgatcaatgatgttgagtgccttttcatatgcctgcatgccatttgtatgccttcttttgagaaatgtctattcaaatcttgtgcccatttaaaaaattggattatgagatgtttttcctatagacctgcttgagctccttacatattctggttattaatcccttatcatatgagtggtttgctaatattttctcccattctgtggcttgtctcttcagttttttattgtttcctttgctgcgcagaagcctttttaacttgatgtggtcccatttgcccgtttttgctttggttgcctgtgcttatggggcactactcaagaaatctttgtgtagaccaatgtcttggagagtttccccaatgttttcttgtttcacagtttgagttcttagattcaagtctttaattcattttgatttgatttttgtatatggttagagataaggttctagtttcattcttctgcatatgaatatccagttttcccagcactatttattgaagagactgtcttctccccagtgtacgttcttggcacctttgtcaaaaatgagtccactgtaggtatgtggatttgtaaaatcttttctttttaaagtaaataagttaatgcagttcaacgggatgtgtatcccagtaaaactactgattttcttttcctctaaattaaaaaaactatttgtctattctaatttttatattgctcccacaataatatgattttgtttgcagaatttactcctttccacttccaaaaacttgcttcaaatgataaattttggattcacactttttaaaaaattccttttctgaaagtaagacaatctaaaaattaagctactgaaaaatgttgtcttattagtcttgtataaatgttttaaatataacatgcatgcaattataaaggtctttaaaagtacgaacaatttaactcacttttgtttctggaagagtcctcagaatagtgtagacaaaagatgcccagcaaatacttaacaattatttgaacaaacacattgaatagaacttggagaatagaattggacaggaatttgaacataagaataaaatatatttattacattatccactgtaaaaaagcatagtacatattcacatacaaagtaacttttaaaatcataggcaagataagaatcagaagttgatacatgcaagtatattttaaaagctacaaatgcatacatgttttttaaatgtccttctactaaattcactttctataattaaaaaaaaatagccaaatcaggaggatagttactactactaattaaacttaaaaaaaatttcctaggtgttttgaaaatagttcctatgtaaattcacagtagatattccctactctaaacctacctcagtttgtacacccagcaccaaacaaatacaaagcattatgggataaaattaataatgctatgcaaataaaacaattcatttataaataataataaatagtcactccacatcacagtaacttagcatgattagagaataaatacttaactttgagaaggattactgactggcagtgtgttgctggtatatgtcaggattattcatcaccctgacagtaatattaaccacaatccatttcagttgcttcagtttatcattttctgactaatgttaaaaaacaatgtctttggaggctgcttgaattaagtgtagaattaacgtctgttagagtcattcaaaaacttctattagaagataacttctacagaaaaccaaatctgctatacagagtactaatgcttaaaagatgtaagtttcgaaacacagccatacaaaataaatggactaattctgttttaaaagcaaaacttcaacaaatcctgtaaatgccttataacatccatatacatatatattccttaaatatatatgcttccactttcctgaacttagtattaaattctacataaagagttgcacagacacattttaaactaacatgccacattgaacacgtaataattcaatttaaaaaggtcagtgtacccatgaaaaattttcttcagggttatataaattaaatagctacacagtttgctacctaggatcctcaaaattaagtaatctgctaaaggtctctctacttataaatggtaacaggaatatacaactctatctaaatccaaagattccctgctctggtctaattttatctttccaggctgttttctccacatcatgttgatattccttttagaagatatctgcatttataactcttctattaatttttatactgctctttcttgttttatgattattcactttccatagcataattttcttgttctattaatgcaatagtttccctttatctgaaaatatttattctagtttttttttttttaaaaaaacacttctgtttcataaattgcctctgtttcttctggttttgttttgattttctatttgctttggtctttgtcatctttcacattagaggttgtctttaaatgtttgctaatacttggctgcacctccatttttaagaatgagacactgaagagctgactgagcatatagaccataagtagtgatgtgaactggtagacttcactgaagggaaatcaagtgggctcgaagtagaatccctaaatgttttatttttttaggtgttttcttttgagccagtgaatatgtccaaagagtaatacaatcttctgtcttatggggtggggatggtataagcttagctgccgcagttctaatagcatgacagcagaaggggtctaggggctttcacgacttggtacttaaagctttcagttataatcctcctgttttccatcctttaccttaaaccctccttctggtgtgcttggtgttctcatatcagaaacgtgtctggtaaaatttctccaaaaaagtcaatctcttgctttttgacaatacagagggaagagtagttggattttggaatgaagcagatataaagcaagtattgaatttaaaatgttctttcagattatacctaaagtctaccagttgactgacagacagatttgagatcaaatcctgagcttaccacttggaaaatgtgtgacctcccagaattctttaacctcactaaatcttagtttccttatctgtaaaataaagacaataacacattccttacagggttattgaaggaattaaatgaaacagcatatgtaaaatgcctgtcatagtggaaagcacctattagggcttccctcacaatcctacaaatacgttgggaactctccccatatcatttttatgcttattagactgcaaactttccaaggccagacaatgtaatttatatcataatctctaaaatcaatgtggcatacaacagcatccatgtttgatgccaagattaaactattttaacatattatgtcagccaataaaacatatccaaaacataatcaagtatggggtaatttttagtttctttctctgcatttatattttatttaaacaatttaagatctattatttactgttgtagtatcataagatgtgtttcttttggtaagcttgaattcctttagcttcactgaagcccaataaatagaaaaatgaagtaaaagccataacacctaacaagtttaaacaatattccccccacccccaagagtgttcttttccctctgtgacatctagatggtatattgattcccagtgtatctgttacagagcagactaaaaggactggcattcatcagaaacagcacttaaaacttaaagagataaagaagtgctgtctgatcaacaacagttaaatgtcggtagtcaattccaggtcaagatgcatgctgtatattaaatgtgtgtgttaaacagaaatatctcacacataaaaatatacatccaaatggtaggagatacatgaaggagagaaaaaaaaatcacttacttttcctgaaagagagagcgagaaacagaaacatatactaagcacaaacaggagcaactcagcaatgaataacaaattcactatggttctgtcactcagttctcttcggttttgtcagaatctactctttagaactatttggatccaaactagggcaatgtaaactgctaggttaacagagtgtgaatagtctagcattgtaacataggtttaaaaacaaaacgaaacaaaacaaacatgatttcttagagcttagacaaaaatttaaaattcagttttagtcaattttcctctgattcctatgttgcaagataggaatcaggagatcatggtgcaggttcattttcttctactctttattttcctgtttctgcactatggaccaaaataacagctcattttgtggttacaatctaaagatgaaaaacagatttttctttaccttgttcctcaaactctctattttccttcattttaaaaatgtgagttgtaattattaaaaagtaagtatttgctttatcttggccattcctgtttctcccaaatcttcagcttattcttttactaggatagtaatgacttcattttattctttcacatcttcagaaactagcagtccatggcatattacagtactcaattaacaaccaataaatgaatgaacaaatgaataagcagtaacactggggatcctctagttttaaccgaacattcagctttttttgtaaaataggtttaatcaaaaaaggctggagcataacctgggataaagacaacaagagtagggcaatttgaaaagaaaaaaagctttcctttttcaagcaatagcatgctgcttgtaggtactaggtacttcagcatgagaagtgaaaggcaacttcataaataacattaaaacagaaccagcaactggtgccaaaagtggaaggcactattggcatattacagagtttctcaaactttctgggccaaagctcacgttaagaaatatgttactttaaaaaacacacatgtacatacactcaaacaaattgagcagaagatttatacaatatgcacagtgatggtttcttttttatgttatgctacggtatcccattcattttttaaaaacgcaattgtgagctacaggttgaaaacttagtgttcaaattctgattctacctacgtgcaacttgacctcatggtgcattagtttctgcctctgtaaaaaacaataatgttacctacttaaagggattttgtgaaggttaaaggaattaccacacacaaaacacttagacaaatgcctggcatatagtaaatgctcaataaatattagttaacaataataataaagtggatgatcctgtcttgtgaatttcatagccaagataattgggttttcattggcaagtggaatagttatcaattgcatttcaatccaagaacatgctggtttttttaaaaggtacccagattactatacaaatacatattatatattctaaaataactacactggtcaactagaagaaacatgattgcctcagattgtcttggtttccctctctcagaaaatctgttttacacaatcactttccaaagtaaagaaaaaataataaatcacaggtacaaaggaaatcatcctaatctacaaaggaagccctggtactgaaaaactcagccatcataatttacttttatggtatgacattttgtaaatatattcctgcgctgattataaattcttataaagaaatgtcaaaaagaaaatgttgaatcttatctcttccaaggaggttgtcaaaatataaaatcaatgtatgtttataaaatatggattaatgtcactccaaattctatgcatggttagatctgtcttctcatcagtcagaatttcagactactgatgaaataactgggaaagtagagggaaaagaaatcaacctcaaaattgattcctatttttttcagctttgaaagaataaattaaaccattttatgctaaatgaggacttttgcaatacaagaaaagatttaattttcaccagtctttcagaataaaatagatttgatcttctcaatgtacttatgatactaatttggaatgattataaagagatatattgtacatggaataaaagcttatacatttaaaaagacattttttacactgctccattcagactttttttttcttaaaagaagatcagaaaaataatacagaagaaaggatgctgattacattaattcagcttcagaaagagaattcccagtgcaacatggaagagattaccaaataaaattgtagctttgtatcaaaggtactaaaagtcctctgaaaaacagctttggcaaaattaaatagatataaatatgcataaataattcaatacattttaaagccagtcaggcaatattatccacttaagaacggagataagatctgtttgtattctacattaagctatgcatacaatgttttctaagatttcacaagtttatttaaacaaacagtaatgtttacaaaatgtatactatgggacaaattttaatacaattctattataatcattatttgtacagatagagctcatttatatatgagatgtattcttgaaaatgtgtgtataaacaaatatttgaaaactgaatcacactgtaaacattttggcaagccttaatactaaaaggaatgaggtacttttactaagtaaacaatcaccgctattttatatgtgcaaagtacaattttcaaatatctgatgtgcttgattatttcactaaatgcagttgattccaaactcacttatttcatcaatatttaatgaaagcaattagtactagtagaattccattctcatgaacctgaatgacttttgtagcattcacactaccattggtttataggaaaggagatattagttgtaaggcggtagaatgttagagctcctcacttctccccagacctactaattacactactgttcattattcaactgtgtgcccttcagttcttgttgaaagcactttttataactattccttcctcagccaaaagggcaaatatttcacaaaatttctaaaaatataaaaatgaatgccattacaattgaagtcacaaaattacacaaatgacatttcttatgtctttgtttagtggatgtggacatatttggatagaggttaatgaaagcaacagttttgttttgttttgcagcccccccttttttacttttaatgtagcaaaataaaaaagcaaaattactattgatcatctactggggcataaggtaaccttatttctcatatcctgaagaaaaggcattagttaaaataatattttacccacccaacaaaagtatttcacaagttccttaggtacagctgtaatatacaaataaaatttgattttaataaaggattctgtttagctggccactaatctacaatagcatttttctgatataatttcaatgaacattcataataaaaatcatacagcctacataataaaaatgtcctggaggcttccttctggtcatttaacatttttagtagaataggtaacaaagatgaggggcagagaatggaggcagttggtaaaaaagggtggtgttaggatgaggtaaaagggttatgagaacttttggtcaggtacaaagatggaggaagagaaaaacatatcctcaaaaaaaaaaaaataacctcccacttgtcaccattaggtactgtttcatcaagactgaatcatgagtccagcccgagtccagcccacaatccatcttagtactcatcacatcttaaagagatttctaaaaactcatctaaagcacaaaaaacatctgaataagctatgtgctgaaatagagtccaaactgtggattcagccctgaaacagaaggcaaggcaatacttctaggaccctagaacacgtattcatatatatgtcattcattttgtgaagcaaattttatattctaacaaaatcaaccccccaaaaatgatatttttacttttgcaaacacaaaattcaaaccatagagagagagtagggtataatagcctgaggattaaagagctgcccagtttttattattgacctactgcatggctcattacacaagtcaaactaatacagtcctcatttattagactacagagctctacagattccataatactatggggtcttagaacaaatatgataccgaggtgtaaggccttccttttcttttcaattttttttaaaccaaccatttatcattcctcatggtcaatgggtcaattgggaaattctgctgatctgggcctggctttgttgctcttagttggactccttcatacgtttgtggtcagctggcaggtcagctgaggactagcttgttaaggatgacctaagctgtcacagctcaagtgtcctccatgtgtcagtcacaacccatcagcaggttaacttgggaatgtttagggcatattctcaaagtgatcacagagaagcaagagcagaaacacacaagcactttttcaaattgtttctagtttgctaactttttttttcttgctggtttctcttttattaatggtggcaaaatatacataacataaacgtacagttcggtagtattaaatacattcacattgttgaacaatcatcaccactatccatcttgagaacttttttcaacttgcaatcctgaaactctatacctattacatgaaacactaactcctcattctctccctcaccccaggccctggcaaccagtattctactttttgtctctataaatttcacaactctaagtacctcatatgaatggaatcatacagtatttgcctttttgggactggcttatttcacctagcataacatcctcaagggttattcatgttgtagcatatgtcagagcttccttcctttttaaggctgaataatattacattgtatgtatataccatattttgtttacccatttatctgtcgatggacatttgggttgtttctatctcttagctgttgtgtgtcacgctgctacaaatatgaacatgggtgtaaaattatctgttcttatccctactttcaattctttttaattttttgagaaactaccatactgtttgacatataagctgcactatcatactttcgcaccagcatgcacaagggttccaattttccacatccgtgccaacacttgtgattttctgggtttgttttcattaacaatcttcctaatggttgtgaagtggtatcttattgtgattttgatttacatttccctaataattagtgatgttcattttcatctcattggccacttgtatatcctctttggagaaatgtctatcaggttctttacccatttttgaatgttgttgagttttaggagtctctacaaattcttgatattaatcccttattagacatgtgatccatgaataaggctttcctctgaaaattaaaactcccttttagagttcagtaagtagatatagaaactggtacaatttcttagctctaagcactatatcaggcacaagagatacagaaattaacaaaacaaaatctttgtattcaatgattttgcttaatagggaacacagagaagaaaatgttaaaattataataaattatgaaatgtattataacaagtatatggaaagtaccctgggagttcaaatttctagataaagaaaagagccaacagcaaaagcacaagaggtgaacatgaggcatcacaggatcagatgatacagcaaagatggggacagagacagaagacgtggtaataaaacagacaatggctagatcctaaacactattgtttgtcatgaggaaaatgttaaccttcgttttgacatcctcggtaactattgtgattgtctgaactgtgtgaagatcctatcctgtggatagagagtaggaattactcctgaacatcttcctggaatgagtaaataagagaacacactcttagagtccctgagctctaagtaaaggacactggatatgttgagtgaacttgtacttctcatgctgggatctgcagacactgggcaatgatcttctgactgagactgtgaatcactgagagccttgcatttctgctatgattgggtattcagtggagctttacataaacacttacctgtggcctaagatggatttagaagagttaagggaaatgactatgtatacccttgaaaaaagttagtactaacagcaagaaatctggtgttttgagaatgtaagagtgacatacaggaataaaggaccaacactgggtcagggtacagacagggaagaagcaacaaaaagtctccaggtcaaagatgtagaagacataaacatttgttagctgttcctagaaattactaaggaaagaagctttaggaaaaagactggatattccactcacctaaaaaatgagggtagagactttgtactcagacattaaaggaaatacaattctgaatataaattggaggaatcagtttgaactcataatgtatttcatcctaatttttttcctagcaccctctaaaaaagggatagaaataatgacaaattcagtagcaataagcagaatagacaaaactgtgatctccagatattaattcccactataagaggtcccacccgggctcctcaaagaaacagatgattctgtatctgggccagaaaatgtaagggttaagactagagtgcctggtcataccagagagcatgaaagttatcaaagactacaaacagtgtcaaaaatgtcccagtaataacttcaagaagctcccccggtcaaagaaagaacaactgaacatcagtaaataactgcaatggattgaaacatcaaatacattgaaatctatgagttcataaagatacttttttaatagtcagtttgataccattggagaatgctaggaatcaactcaatattttgaaaactgttatgtaaattaacagaaaagagaaagaattaaacttctatcctgtcttttctctgcaatgtaccactggataccccagtagtagaagagaggaagtgtctctttatagaatgagtcccataaataagtgaaataaaagtgatattttaaataccacaatttggcaatgcttactaaattaatgaatccatgcactgaatatcagtgctaacatcacaaaagagaagtagtgtttatcatgcacattaaatttttccatttgaaaatctgtttaagagataattatattaaaggtacgactatatttgaaaaaaatttttaagttaagtaaaataacgaaagacaatccaatttatttttatatgcaagacaattatatttcacatcattactgagaaattaccttggacaaatctctgaagttggtgggcaaggtaagatccagttcttctgattcataattagtgatgacccaaggaaacactggatactgatttaagtcattataactccgtcctgatagggaaaaaagttactcgtaatttataattttaaaagtgaaataaacagattcagtaatataatttactaaaaataagattaaacaatttttgattgccagacatcattctcagtatccatactttctctcatttaatcctcacaacaatcctatgaaattgtatcatctccatttcacagatgaaaaaattgagtcacaaaaggttaggtaacttgccccaaatcacacaactagtaatggtcaaaccatattgaaatccagattttctggtcctaagtttgtgttcttttaaactacatttgataattttttttatcacttgaaagcctgccccaaataaaatactcttttttttatgactttaaaaagctatttgtaattctcacagtttttcaaaacaagaatcctttctctgccattaataatcaaccaactaagcaatcaagtttaaatgacttaaccctggtggacattcaccagtcatctataaaatgagggcattgcactaaataattctgaaatgtctgtggtagttttcaaatcctataatcctctgaaaataatgagcagtattatcaatgttgcttccttacatgcccaaatgtggccacatgctcttctatacatctttctaatgacattttcaatgacatatttagatttattaaaaatacaaattacagcaaaagaggaggtagtccttctacatatgtacagcagttttttggatattacctttttagggaggtagcatagtgggtgagatcattgtttctggaatcaaaatgctggtgtttgaatcccagttcctatttactagtctatacatatttttagttagatttaacatgaacagacttttacggtgaacatagagacaagtatattaatattgtttgaattcctttcttattatatattctatcatttccattcctttttctttctcaaatatatactgatgttatatcaatacgtagctgaatattaaagtagttctctgtacatactcttggtatctaagccttttttaggtctgatgtttttaactttttattttactctattcatcttaggcttgaggcctattagggtaacagagttcatttttggctgacctggaacagtcttataaaacatcataacaatgacatttttaattcatagatcattaatgtcactacatatttctatcaataattttaatttctccattaaaaaaaccaaacatagcagcagaaaaaaaaattttatgctcccccacttccttctccttctgatttaaatgttggtaaacagtaaaatcgtcttgtcccatctacttaaataatcagaaataattttttattgtacctaaaaaatgaagagtatggacctgctcagtgattagacttaattaagttaaactcaatacacagttattgaatatcaactgatggccatttgggaaatgcatcatgatatcatgtttatctatatgtggcacaaataataatgtaaaagaaatcttaagtgagacttaactccatcctctaatgcacatttaaaaaatctaaagcaaatgatagattctatatttataaaacatatacagggaatatacttaaaggacactgcaggcacaataaaagctatttgagaacacatgatttcataaatgttgctccataatcataactgtgcattcaacatgggttaattgatttactacatgcaaaatatgtccattaaacttgttatataagtttcctctcactacttaaaaattcttttagtcactagttctataatttctactaaattcaacataaccattgacattttcttcatcccttttcctcagctgactgtgagataaacttctaataaaatttagaactttcaatgtgagcccctcaacttccaattctttgcaacatcccctcactctttcccatttctctaacagggtcttttctttgctaagagtaattgcttcacctgagctctcaaacctgtctccctcataacttgaattgttacttttcttctctcctcctcttacatcatttctcctctctgccccaacccatcttctctttaataacacatttaaaataaccataattggcagggcgtggtggctcacgcctgtaatcctagcactttgggaggtagaggcgggcagataacctgaggtcaggagttcaagaccagcctggccaacatggtgaaaccccgtctctactaaaaatacaaaaattagccgggtgtggtggcaggagcctaaaatcccagctacttgggaggctgaggcaggagaatcgcttgaacctgggaggcggaggttgcagtgagccgagatcgtgccattgcactccagcctggggaagaggagagcaactccgtctcaaaaaaataaaaaagacctgtaattacatctacagttactatttcatttccaaccattcattctgaagtctccctctccactctgtaacatttgacacaggtgaaaatgccttcctccctctttcaccttgcctctcaagacatctgacttacctcagttctcctactatatctgcacattctaggatcactcattcctttttgtcctttactaactttccttctctcttctcatatgcaagagaatttccctgtcttatctcactgctttctgtattatcttccttgctgatctcacatctcttggtgatttcctctctatgcagatgaaatccaatgtcctagttctaagttccgaatatcctccttgacctatacttccaaaaactctgataccttaactagaaagtctgccggcacagtaaaatcatcatctttccctagatcaaattttctgacttctttttccattaattgcaccaccattttcccactaacgcaggccagaagcctggaagtcttttcagatactttcttctcatttaccacctacattcagtcagctgcatatcaaatggttggtgccttgtgaattcttatagaatttgttccttcttttttaattcccactgatacctaatggaagccctcattactacacacacacacacacacacacacacacacacacaccacacactaaattacttcctaactttactttctgcctagtctctagccacccaaatttatcttacacacacagcctccaagttaatttttgatgcagctctaatatcacttaggtgctcaaaaactttcaaaagtttcccaatgaactgacgctaactcttcaaactgacaagaaaatcgttcttcgcatttctaacattcttattttttcccattatatctttatgaatatatacttcatgcacacaaaaatatacagtatatacatagatatacaaactataccattcttgctctctaggtatactttatattttcccatctttgtatgtttgcttatgctttcagtcttacatggaatgacatctaacattccaaccacctcctctgctagtcaaatagtatccatccttatacaaccattgaaaccttattttctccttactcccaccaactgggtgaatataatttccctctctccctgtccttttaatcaccacagtactttgagttttttactgaatctatatccccttgctctagaatcatgtaaacattcacatttgtacttaaaatgacttctatgagagtaagcaacataccttattctctttgtatatcctttgtagtattctagtagcaataacggcaataaaacaagctagttataccactacttaaaataatctaacaattgaaattaataatttattgtctaaaataaatcaatacatggaattaggttacctgctatcgtgttgagaaacatcaagtactcaaaattagatatctctctgtgttgccatcgctgggtcatattagaagccttaaaaagctgacgtggactagctaatgaaatacgtctgcaagaaaaagaattcaatgtgatatgattaattatatcacaataataaatcatgaattatctgtgcttattcattcataatatctataattctgaaaagttctattcatgttagactaatgaatactagagaggtttcaatctacaattcatggttaaacaaatgatttagactagccacagaggtattatacatgttgtattcattcaggtaagctgtcattacagtgccattataatgtacaggttcaataaaagttgattaataacagtataattaataattcactgctttaatgatataaaaagaagaaattatagcagctgggaagtgcatataaaattctattcacatgtctttattaattgtaatagttatcttaaatgaacacatttttacattataaatttaaatatatttgcatacactttgtatcaaagagaagggagactctaaactatttgggcgtctgttcatggggtaaagagaaatttttttaatatagcttaatagaagacaaattttcctgtagcctcctaatgaaatgtaaacatcagtgaatagaactgatcaatacaaagagtagtgagaaacagatggcagaattagttattacattcaaagcctagaatctcagagaaataggctgtcacagttctttctaccacaaaaaacaaggtaattattttgtaaaaggttcactgaagtataattttcatgccataaaatttattcaatttgtacaattcagtaatttttaaaaaatatttcaaaagttgtgcaattatcacaattcactttagaacattttcttcatctcttctcggccttttggctaaaatcaagtgtagaacattttcatcactacaaaaatttgccttgtacctatttacagataatcttcattcctatccccacctacaggcaactagcaatctactctgtgtctctagtaaacccaccttttctagacatttcagatcaatggaatcatacattagtatgtagtcttttgtgtcaggtttctttcactaaacataatgtctttgaggtttatcaatatggtagcatgtatccacagttcattcctttttattgctgactagtatcccactgtatatagaatacagcacattttgtttatctagttgatggacatttaacagtttttgctattataaataatgctaccataaacattcatgtatatatctttatatgaaaatatgttttgatttcttttgggtagattcctaagagtggaattgctaggttgtatgttgagtttatctttaattttttgagaaaccgccaaattgttttccaaggtggctataccactatatgttccaatcaataatgtatacattcatctccacatccttgccaatacttgctcttgtgtgtattttgattattaccattctagttagtgtaaaataacagttttaatgtatgttgttgagcatcttttcatgtgctgattggtcatttgtatatcttcttcggtgaaatgactaatcaaatcttttactcatttattgagctgtttgcattttatcactgagttgttagaattctatatacattctgaatacaactctgtgatagttaattttatgtgtcagcttgactggattaagtgaccttagagagctggtaaaacatgatttctgggtatatctgtgatggcatttccagagagattagtacttgaaccagtgggcttagtaatgcggactgctctctccagtatggtgagcatcatccagtcaattgaggactgaatacaatgagaaggagaaagggtgaattccctcttctgctcaagctgggaatctatattctcctcctcttggatagcaggagctcttggttctctgtccttcacttcttaccccatccctctctccttaggccttcaagccttgggctcagtcatgggctcccctggccttcaaattaggattgaattacaccactggctttcctgggtctccagctgtagatggtgtattgtgggatttctcagcctccatggtcatatgagccaattcccataataaatctcctcttacatatctatacatatcctattggttttgtttctctgaagaatgcagactaataaaaagtgctttatcagacacatgatatacaaatgttgtatcagtctgtggcttatttcttcatttacttagtggtcaattttgaaacacaaaagttttacatgttggttgagtccaatttctcaattttttcttctgtggattatgcttttagtgtcacatctgagaactgtttgcctttcccaacatcagaaagtttttctcctatgttttctttctgacattttatagttttacttctcacatataggcctataatatattttgagttaatttttttgactggtatgtggtaagcatcaaaattttcttgtatgtaaacatccaattttgtccaccaattgtttaaagcctatcttttcctcactgaattgtgttggcacctttgctgcaaaacaattgaccgcaaactcaaggatttatttctgtattgtcaattctcttcctttaatttatatgccgatctttgtacaattaccacaattgaagactgagtacaatgaaaatgaggaagggtgaattccctcagtattttgataactgtggctctacaataagttttgaaatcaaggtacatcttccaattttgttcttatatttcaaaattgtttcagctactctaggtccattgcatttcaacttcccaatttctccaaaaacgtctatcaggaattgatagggattatacagaatttacagatctagggaaaactaccctattaattatattgaatcttctgatccatgaacatggaatgtctccatttattaaggtctatttttaatttctcttaaaaatgttttatacttttcattgtacaaatcttacacttctgtgatctgtaaagagggctactttctttcttcattcccagtgcagatatctttaatttctcccttccttcctctctttcttccttattgcacaaactaacatctccagtgtaacgctgaatagaagtggtaaaaatgggaggacatttttaccctcctaaacttagggggaaagtattcagtctttcaacattaagtatgatgtacgtattgggagttttttggtagatgatttttgtcactttgtggaaatttctttagttgaaagttacttgagagtttttaatcatgaatgtgtgttgaatttggtcaaatgcttttttctgaaatgatagtaagctttttctcctttataaatactggtgcatgacataaattgattttcatatttaaattaactggcattccagtgataaaacccacatgaacattttataaatcctttttatatactgctgaatttgtttcctaaattttgttttaaaaaaatgtgtctgtgttcaggacggaaattggcctatagcatttttcttgttagttttcctgtaatgtctttgtctggcagtggtattgaggtgactgaccttatagaatgagttgcaagtgtttcctccctcctatcttctggatgagtatgtgaaagatttatatcatttctagtttaaatattttattgcattagccaggaaagacaactgggtctgggcttttctttatggaaagatttttaaattaatagctcattttatttatgtgttataggtctattcaaatttccaatttctttttgagccagttttggcaattctgtttttctaagaatttgtccgtatcatttaagtatctaatttgttggtaggaagttgttcatgatattcctttctactccttttaatttctgtaggctcaggctgggcttggtggttcacacctgtaatcccagcactttagaaggctaaggagggaggatcacttgagcccaagttcgaggccagcctgagcaacataggaagaccctatctctataaaaaaaaaaaaaaatcaaaatattagccagacatggtggcatgtgcctgtagtctcagctactcaggaggctgagatgggagggtggcttgagcccaggagtttgaagctgcagtgagctataactgtgccaagtgcactccagccagggcaacagagcaagatcgtgtctctacaaaaaaaaaaaagaaaaataaacaggaaaaaagattctatatgctcaatagtcatgtctctactttcacttctaatttaagtaatttgtgtcatctttcatggttaggttaaagtctgtcaattttactgatctttgcaaagaatcaacttttgtttcattgatcttcttcagtgtttttgctttatgtttcattgatttttgttataatcttcattactctatttttctacttgctttgcatttagtttgctctcctctactgtctaacagtagaagcataggttattgatttgaggaatttatttcagatatgggtgtttaaagctgtaaattttcacttaatactactttagctgcatctcatatattttgatatgttatacctctgttggatataagcatccaaattagtatgcttctcagtcccatgggaggaagagttgctggccacagaagtaaccaaagcactaatagctacatggcagagacatggcagaatgtgtgaggacaaaaagaaagatgcccccaaacccaggcactctctaggttctgggaggtatacagaggaggaagtggtgcagaccaaggagcatggaatcaaaaaaaatgaagccccctacaccaccaccactctagccacacagcctaagctcactcccttctctgtacctctctaagcttctaactgcaaaataacatatctcctggtagctgttataacccctgatatgcatgtattaaactccttggttagtgctcctatagaaaaaaggaaatgcctgaaaacaagtgatagggttaggcaaaacttgcagtgaaacagaaaaactaaaatgaaaactattgttggtggcatctttgggctgactcaatatatttttgttacggcttaaaactggtatctgtgtgtatatgcttgtactgtaagagctcctgggtgtcagaaagaatattccagatcaagaaccaccacaggtagaaaactgataacaggactaattctcttgctgattgccatcagtggtgagtcaggatttagcacaatagtccctaccctctcacgtcctactggctgacaagtcagaacatttggtcttaatggccctgacttgtagtgttctcacaactaaaccaaaaggagtagctcataaatgccaacaaaattcagggtcctgcttgccaagtaaagcttcttgatattgtgtgggcaaattcacaacattcaatcctctggaggtcaaaagctaaatgtgatggacagttttcagtctatgtcttactgatttctcatcagatattttcatgtttaaaaactaccatcccttggtgatatggtttggatttgtgtccccacccaaatatcatgtcaaattgtgtattagtccactctcacactgctataaagaacagcctaagacggggtaatttactaagaaaagaagtttaattgacttatagttccacatggctggagaggcctcaggaaactacaatcatggtggaaggcaaagaaggaagcaccttcttcacaaggcagcagtgggggtgggagaaccaagaaaaaattaaaccatcagatctcatgagaactcactcactatcatgagaacaacatgggggaaactgcctccatgatccaatcaggtcctctgttgacatgtggggattataatttgagatgagatttgggtggggacacagagaaaaaccatatcaaattgtaacccccagtgttggaggtggggcctggtgggaggtgattatatcatggggtaaatttcccccttgctgttctcatgacagtgagtgagttttcacaagatctggttgttgaagagtgtgtgacaacccccctccccgcttcttcctcatgctcctgccatataagatatgtctgcttccccttcaccttctaccatgattgtaagtttcctgaagcctctccagccatgcttccttatagcctgaggaaacatgagccaatgaaaccccctttctttataaattaccccgtttcaggtatttctttatagaggtaccagaaaagactaatacacttggcatcatattttcctggatttcctgtcttttgagccactcctgtttttgctcttagtgttgttgtttttgggagggcagggatgtcctgtttcccttacctaacctttacatgttgaggttttctggatgtagctctagttcctcttggcattttacaatctctccccagatgaactcattccctctcatggcttcaaatttcatctacttggtagtcattctcaattactaggcctttcttttgagctctcaacatacctccttatatctagcttcctattcaacatttcaatctggatgtctctcaggggttctaatttcaaggacctaaaattaaactcattttctgtccctccacctcctccacacaaccccagccatggggatggaaggatgtttatacaaatactgttcgtccattattcctaatcccagtaaatgccactgagcagctcaagctgagacttgagtattgactaaagatattgaatatctccccttgtcatcaccccccaaatctctgagtcttataaattatatttcttaaaaatctctaaacaagaatgtctctcttcagctacattatcaacatcacatatcatccagatgtcttcaataggctccggtcttatataaataacaccctcttcctaatatcactaagttccagtgatacttgctttccaacatttcttagaacactagaagctccctgccttgcttcagggcctttgcatatactgtgccttcgttcaaagaatagctggttatatttcttcaaatcaaaacttaaaagtcacataggaagatattcctggttatcttatccaaagcaacccatctctactctactaatcactactacaacactctaattatatccttcctgtcacttatcacagctatttagtttacatatttgttttaaaaatgtatgggtaaaatggtttctatcttgtacatggctgagtgcttgacacattgtaagtgaaaatctatttaagaaactgattaataaattaagacttataggctgggcacagtggctcatgcctataatcccagcactttaggaggctgaggtggcaggatcacttcagcccaggactttgagatcagcctggacaatggagcaagacagcatctcttaaaaaaaaaaattagccaggcgtggtatcatgtgcctacagtcccagctaccgggaagctgaggtgagtgattcgcttgagcccagcagattgagctgccgtgattgtaccactgcactccagcactccagcctgggtgacatagcaagaccctgcctttaaaaaaaaaggacatctagctttaactgtgggagaacattacagaacattcccaggtatgaaaacatatactaggtgtgataaacaaaacttttctaaaataaagagataatttgtagaaaaagacttcttaactaatataaggaaatccactatgctcctctgggctgcttcttcctgaactctgaaatcctcattaaattataaaaattatctaatcaaaagcattaccggtattgtaaggcaacatagcttataatccagaaggaccactttatttgccccatttacataaaagttgtgacctgtggtagttctggaatacatcctcgagaggtggagcttaattcccctcccctggactttgggctgtatttagtgacccacttgtaaatgaatacaatgtagcagaaatgatggtgtataactatcaagagaaagtaatttttaaaaattggggtttctgcttcattctctcttggatcacttgctctgcaggaagccagctcccatgtcatgtaacactccagtaacagatggaaaaactgactcggtaaggaactgaggcctactgctaaggagcacatgagagattcctttgacagccatccagccacaggctggctgtagctactactaacatcctagctgatgtttgtgcattctatcgcaattgcatttgtaataggatacttaaaatttaaaaataaacactgatcaaaagtagctcaattcaataccaaattaggtatgctaaaagtaaactgtacgtttccaccacgaatatgtttcaatcaatagaaaaatcccagtgttcgctctttccagttcttaaattagttaactaaattgtattgatgatgaatcaatacctactatgaaaggaaataatcagtaattatgctacttcaatgtagtcccagcatacaggagaaagatgcatacacctacactctcccaataccctataccatgagagatattttgccattttaacatttctctcagagacttattaggttactttcaactatataaatacttgttattaagtccatacattcaaatacaaaactaatatgtgaattctgatttaccagaggctacacatacaggttttaattaaatatagttacaaaatccttaatctatagatttaatatttatattaaataaaaaattgtatgatgtaatagagcaaaatccaatcatttttatcaaaacgatgaaaagtttcagatttatcatgtgtatattaaataatgctatagcacatactaaaatgattgtaataaacacttttttaaaacagcatcacatgtacagatgtaataagcacttttggcttagatatttttaaatatgcttagaaagcttatctttcaataattgtgattggaatataattaattttttatatttatttaaacagttttacatagatgtaataattgtacatatttatggtgtacgcagtgatgtgatatacataagacatagtgatcagatcaggtaattaggacacccattatctaaaacatttatcatttacttgtgttagcaacagtcaaaatcctcctcctagctatttgaaactgtattactgctaactctagtcatcctacagtgttatatagaactttagaatttattcctcagtccagctcttattttgtatactttaacaaatctctccctatcatctctccctccccactacccttttgatcctcgagtatccactgttctactttttactcatatggagattaaccttttggtagcttccacatatgagtgagaacacgcagtgtttaactttctgtgcctggcttatttcacttaatataatgtcctgcagttccatccatgctgccaccaatgacaagattccatgtttttttatggctgaatagtattccattgtgtatatatggcaccttttccttatccacttatctgttgctgaacaccactgattccatctctttgctagtgtgaacagtcctgcaataaacatggtgggtgcagatgtctcttcaatgtactgatatcctttcgtgtggatagatgcccagtagtgggaactctggatcacatgggagcactatttgtggtttcttgaggaagagatataatttaatacattatattaaatgtataatatttatcaaacttaagtgtacaatttgatgagatttgaatatatatatatgtttctgtaaccaccaccacaaccaagatacactctaaaaggtccctcataaccctctgcagctaattcccttgccccaactcttggcccctggtaaccaataatctgctttctgtcattgtgtagttttgctttttcagtaatttcatataaataaaaccatggcctatggctatgatgtatggagcccgtaatgtttaatttctttcatttagcataacacttttgaaattcatccatgttgttgcatgtaccagtagtcatttcccttttatttctgagtggtatttcatttattccagtgaatacaggtattgcaatctgtttagccactcacagttgatggacatcagaaatgtttacaatttgagactggaataaaactgctattaatatttgcttaaaagtaaatgtgaatatgtatgttttcattactcttgataaatgcctaagagtggaattagtatgatatacattaagttcctaacctatacatcctcattaactttacacattctttgttgttgtttttgaaaatcaagtttgttgaagaataatttacatagagaaaaattcattatttttaggtgtacaatataatgagttttctaaacatagaggcttatgtaagaacaattatgacatggaatatttccatgatccccaaaagttccttttattctcccttgtatgcaattcttcctcttttcccatagctcctagcaatcattgctctgttttctgtccctaacagctatgctttttccagaatgtcatataaatggaatcatacaacatgcagccttttgttttggctttgtacacctagtataatattttcaaattcatctgtgttgttgcatgtattagtgcttcactcctttttattactaagtactatatagattccattgtatggatttatcacagtttgtccatttaccagttgataaccatcttggttatttccaatttttgtgatgaatatggctgctataaatattcatgaagcagtcattgcatgaacatatattttcattcctctagggtaagagacctagagtgagactcctaggatgtatgggaaagtgtatggttaattctatatgaaagtgccaaattgtttacaaagaagtcgtaccactttacttccccatcaacaacatgtgaggttccagttgccttgtatactgctcttggtattgttagatttttaaaaagttattcgaataggtatgtcatgggatcacactgttgttttaatcagcatttctcagatgactaatgatgtttggcatcttttcatgtgtttattcggtatctatatctattctttgttgaagtatctgttcaaaacttacattttttttttgtagcaagcttatcttgttatatagtatgtttcctacatatcctggatgtaagtgctttatcacacataagttgaacaaatactttaatccagtctggcgtatattttcattttcttaagagttggcatttcaaagcaaatgttttttattttaatgaaatcaattaaagatctaaagaaatatttacctaattcaaggtcacaaagatttttctcctatgtgttctttcaagaagttctacttttagcacttacgtttgtctacactacgtttttttctgttacattttgagttaatttatatgtaaaattaaggggtgaggttctttttctttttggatatggataaccaattgttcatcatcatttgttaaaaagatcattttcccccctgggcataccttgacatctttgtcaaaaatcaaattgatcatatatgtttgagtctatttctggactctgttacagtccattggtttatatgagtctatccttaaataacaagctatcctaatgaatgtaattttatattaagtcttttgtttttttttctcaaaattgtttaaactattctggatatttacaatttcacttaaattttagaatcagcttgtctatttctcttttttcctttttttaagttaaaaaaatagagatggggtctccctatgttgcccagactggtcttgaactcctaggctcaagtgattctcccacatggactttccaaagtgctgagattacaggtgtgagccaccatgcctggccatcttgccaatttctttaaaaaagaaagaaagaaagaaaaagcctgctcagattttggatagagctgctttggacctcagatcaattctggagaaaactgacatcttaataatattgagtcttccaatccatgagcgtagtatagtacaattctccatttttaagttttaattctccaaaacagttttatagctttcagtgagtaggtcttataaatacattttcaaatttatctatatgtatttattttttgatagtatttaaacactagttttaatttcaatttctgattgttcattgctagcatacagggataaaattgagttttatatactgacccagtatgctatgaacagctaaactcatttattagttctaacagttgttgttgttgctgtttttttcctcatagattccctgggactttccacataaacattcaagaaggtatgctaaaatgactattttatttcttcctttccaatcaggatgtctgcagttcctatttcttgaaaggcctttgtatgcatttggtgttcaggtaatgctggtctcatataatgtttttggcaatttaacctccttttctattttttgcaagagtttgtgtagaaatggtattatttcttcattaaacatttgatagaattcatctgaactacaagttttctctgaggtaaggtcttttactacaattcaatttcctttgtagaactattaagattaaccatttcttcattagtgatatttgatagcttgtgcctttcaagaaatctatttcatctaagttgtctaatttagtagcataaatttgttcataatatttctttatttttcttttaatatctgtagtgatgttccctcccttattcttaatatttttaatttgtgtcttctctttctgcatctttgctagatatttactattaatacatttattaatcttgtcaagagacagcttttcattacactgatttttttctctatcatttatttttattatttttttctttcttcagcttactttgactacatgtgcttctcttttttcccacattcttcagattgaagctaagatcattgattttaggcaatgatcctctcctcctcccctcccccttaccctctcccttcttaaataaaatcatttaatgctataattctacattaggcacttctttatcttcatgttaaacatttctataggttgtgctgttattttcaattagtagaatatttctaatatctcttctaatttcatctttggcccatgttttatgtagaagcgcattaatttccaaatctcaagagattttccaaaaacctttctgtaactgatttctggtttgtaattaaccagagatccaagatctcaatctttctaaacattttgagacttattttagggctgaatatggtcaacgtgataaatgttctacgtgtatttaaaatgaatgtattttgtgcaattgactaaaatgttttatacatgtgacacagatcaaggtggttaataatgttccagtcttcagtatgcttactgattttttgtctacctgttctctaaattactgacataacagggagaggctgtctatatttcattccacttctatccacttttgtcttatgaattttgaagctctatttttagatgtatgtaaatttaagatcatcaccttgatgaactggctcttttatcattatgatatgtcactttttcctctgataatataatgctttgtgtggtaatttgataattgttatgggttgacttatgactccttaaaagctatatattgaagagctacctcccagtacctcagaatgtaacaatttgcagagagaatattttcaagttaaaatgaagtcatcagggtgggcccaagtccaatatggctggtgtctttgtaaaagagggaaacctggacacagagacatacacagggggaaaacaatgtgaagagacagagggagaagagaggcatctaaaaaccaaggagaccggcctggaacagatccttccctcatagccctcagaaggaaccaacactgatgaaaacttgattttgaacttcttgcctccaaaactgtgagacaacacatttctgttgtttaagccacccaatttgtggtactttgttatgacagccctagaaaactaatatagtaatgatatgactagctggctgtttttattaaggtagtgtttgcatggtatacctttttctgtccatttacctttaacgtataaatgtatttatatttaaatggggcttcttggttgccagaggcagaggagtgggggaaatggggagatgtggccaaagtgtacaaacttttcattgtaagacaagtaagttctgggaatctaatgtttaatatgaagattatagttcataatattaaattgcatatttaaattgctaagagagtagatcttaagtattctcaccacagacacacacacaaaggtaactgtgagggatggatatgttaattaacttgaatgcagtaatcatttaacaatgtatatatgtatcaaatcatcatgaggtagaccttaaatatgtgtaatttatatttgtgaattacaactcaataaagctggaaaaaaatacctactgcaaaagaaaaaaaagggtgggtttcctctaggtagcacataaatgagtattgcttttttatgcaatttggttttttcttcctttaaattatatagtttaggcaaatagtacttcaaggtagcatattttttattatattattttataaataagacattggtcataaaacttgaaagaaaaaatacataaataattttaccacagcattttttataataatgaaaacatggaaataaagcaaatcttcagcaatgagggaattactcaattttgatatattcatatttcagactattagcaaccaataaaaattatcatttttttgtcttgtatacatcacgaaatagctaatttgagcaaattaatatatccattacctcatatattcatcattttttgtaatctagtctccacaatttttaagaaaacaatatgctgttactaactatagtcactatgctgtaagatagatctcttcaactattcctcctaactaaaattttgtatcctttgaccaacatctccccagtcaccccacccctaacctctacccttggtaaccacgattctactctctacttctatgagtctaacttttttagatttcacatatttagatcatacagtatttgcctttctgcgtctttcttatttcacttaacagaatgtcctccagttcatccatgttattgtagataacaagatttccttctttttaaagactgagtagcattccattgcatatatatacaaccaaaatttctttattcatcagctgatgtacacttacgttgatttctgtatcttggctattgggagtaatgctgcaatgcaaacaggagtgcagatatctctttgacatactgttttcatttcagttagatatatacccagtagtgggattgcaggatcatgtggtatttctggttatacgtgtgtgtaccattatgatatatatcgtgtgtgtgtatatttatacacacatataccattatgatatatattatatatatatgtatctttgaaaagaatagtaattatatcgatatatatactataaatatctttcctaaaaggttagtatttaaactttccataaaagagataaaaagtaaatcttacaatatacacttttcttggggtaaggttaggcaatcttttatttaatgattatttgctaagtatatactctgctagacaccataccctatgctagggaaaacagtatattataatgcagtttagtcaaaagaaaacttaataacttaaaacagtacattataatgcagtttagtcaaaagaaaatactaataatcattatttactatgaaacataaaacagaaagttataaatttcaaaataagtgagaacattaatacagattaatgttaataagaatattaatactggttaattattataactattaagacactttactttccctaagtttctcatataaaacagtacctggtttgaggcaatccaaaacttgttccaacgccaacacgaggtagatagttaaccactttctttactgttgcagggtctgggaagttgaacatcacagcaactacaacagatgatttttaaaaattagaacacagtataacttcctttctggaaaactgactccttggtccaataaaatatttacttttaattcaggtatctattaaatacaattcttactatattccttttatatagtatatatcaagttttagtattaatatgccagtgataatattcatttcacttataaattcttttaccatagacagtgctttcctaaatactattaggtgttataacagttgatgttgcattgatatgacatgaagttgagattatgagacatgataataataatgataatgatagctgagataatgtgacatgaagctgcaactttaaatttacaaaaatgaattttggcaagtcaaaggtatttctaggagtttccagaaacaaatattaaaaatttaagtttatgtagttaaacaactaacactaaaaaacaaccaatatagctatgaaataatcagttacatttatttccaatcattaagttttaaaacagtctttttacaatgtctatatgtttatctttcatatgttcaaatgagcaaatgttcatataatccaaaacaatgtgtgatctgaaggaacatttttcctctgcagttaaaaatcaaatttaaatgctttctcatcctatttcaataatttcacatacatgagaataccaagaagtacatgtcaatatgtaaacatatttagcaataaatgttaatttatgagagtaatctataaatttttacccatttaaagaacatgaaagtaaaatcatacaatcttgagagagtttagaagatattcatttggtcagtcatggaattttaacttcaatgtcagaatcatatgtaagctacaagcgatcatctagaagatggtccttcttctctaccaacccttaaaaaaatatttaaagccaaaaaaaaaatataccaatgttcctatagtttttaaaacactggcattgccaacatgtttcaggtattcaggtaaataagtaatcgatcattcactaagcacctataacatatttagtaatgtcataatatatacacacacataagaatatatacacacacataagaatatatacacacacgagaatatatataacatataatatattatatataagaatatataacatataatatatataagaatatataatatattatatataagaatatatattatatataatatattatatataagaatatataatatattatatataatattatataagaatatacaatatattatatatcatatataatatataagaatatataatatataatatatcagaatatataatatattatatataagtatataatatattatatataagtatatattatatatacgaatatataatatattatatatacgaatatataatatattatatataagaatatataatatattatatataagaatatataatatattatatataagaatatataaaatatattacatataagaatataaaatatattacatataagaatataaaatatattacatataagaatataaaatatattatatataagaatataaaatatattacatataagaatatataatatattatatataagaatataaaatatattatatataagaatatataatatattatatataagaatatataatatataagaatacataatatatattatatataagaatacataatatatattatatataagaatatataatatattatataagaatatataatatataatatataagaatatataatatataagaatatataatatataatattatatataagaatatatattatatataagaatatattatatattatatattatatataagaatatataatatataataattatacataggaatatattatacatatatattcttatctgtgtgtgtgtatgtatcctttagataagcctcctttacatatccactattatactgaattcagggggaaaaaataaacagaagaaaaaaatcatcataggttatggcagatggtcaaggccacgaggcaaaggcaacagaaaaacacacatataaaaacaagcatgcataagaaatttcaaagaaagaaaatgaatgaggatgagcaagtaataaatattctaagattgaagctcctttgggacagcaaggatgcggactgaaataaagtgtgaaacattctcttgattatttgcctagaagaataatgtttagattagaagaagaggtatgtgccaggaggagatcaaacaggaagggaaaaatcttttcctaaagaaatttgtattccctaaagacagataatttcataaaggaaaaacaagatgtgtgtgtggaatataggcagttatgtgtacctttaaaaataagaaaccatcaacccatgtatatataatacaaggaatatgtacaataaatcagtaggttttacatatattccattgtacacctccacccataccaaatgatgcttttccttcaagttcaacttgtctccccttcttttcttaatggatttcaccaagttccatcgtaaaactgcaaattaaattttagttcaactttcaagaatgatgaaatacagagcaaacaggacagttcagtatcattttctcatggttcctttataaaagcaatatatcacatatatcacacaaaagattaaatagacatatgaatcgttattgtcctctcctctccccaaatgcagccaccttccagaaggaattaagtatcaaagcaatgctcaggacatcaaaactcctcttcaagctgattaaatggttatgtattccttatgtttataaagccttatatcaatttgtgatatggcaaaaaaaagaaaagaattacaaatgattctattaataatcaaggtgggaaaaaaccatgaagaagcatttggtacaaaaaaagaggtcactagaacagaaggtgggctacaaataactatctaaattgaagcaatatggtatgttcaaaaatgaaatcttaaagagatggaagttagctctgtaacaacgtatttctgtaacacattacctctgtttgccataaagatctccagggctgtattttgcaaaagataacgacgagaaaagattgatcgtatctctgtgaacagccattttccatgcagcccttctgtatatgccaagatctaatgaggaaaaaaataatcccaggtaagtaacaatacttgttttttgttgttgtttctttccccaattaaaatagaaaagaccctattaagaaaaataatttttaagaaaaaggatttaatagttacagacataatttggagatgaagaaaataaattgtaatttatagaaaagaagcttaaattaaaaagcaaagtaaaattataaaacatttaagtatatattcgggcttttaaaaacaatgatataatctactgcttctgaagaaatacatattgcatcatttactgattgatttttaaaccacattatgaaaagtaaaacttcagataaaatcttaaaaacaaaaagccctcaaaagaatgtcatatatgcttataaatcacatacacaattcagtttcacatgattataatttgcccaataatgcttttacatacattataatacaaatatattaagttcataactttaaaaaatgacacttttaaggtcactgttaaggcaacagtcactcattcagaaagcacaaacactgactatataagaggttaagtatcattttgtcagctaaagctaaacacaaacctgcaaatgaacttagcataatctccctatggggtaggtggttgtcagagtaacttgttacaattcttgtcatcccaggtgacagacagagttgcttaaaatgctttgccaattcaaagtaatcctgtctttagtcctaacccactttgttgctttgattcaagttttgtttttcaaaacgttcatttcaaaagcttaattgtgaaagcgttaagggaaaaccagactcagcatttctctacaccagtactatacataatacataagaaaatgagatgcacttgctatcaaaacctgatattctatgacagcaaattaagtttaaaaaattaagaaatatatctcaaaagtaaccactattaaaaattacaaatgaaacatttgattatgatactacattgtaggaataaagatgggatgagcaaagaggtaaaataacgagtagtaaaaatttatccttctcaaactgttttgtctttactcatttttattttcaaaatcctaatggcaaataaatctacattctccagtgcagaatgtagtttttttgaaaaaaaaaaaaaagagtaacaaaccttatttaagtcagtaagtatgtatttcagtctttctacaaaaatgattctatttctgacaccacagaatctagaaatagaatgggtataactctaagggagagtgtttcttgaaaatacaaaacaaaaagttcaaaagacaagataatcatgcgtgcagttttgaaatggatgagagagaaatcctactaattcagtaatataatcaacgcctatgtaaaataaaggtaaatgaacaggaaacgagaggacaaaaatatgaacattactctcagagattgcatgtatccctttctctcactttgaccagagataccaccagttggtctatggccccaaggtcttcagaggcatctatttgttctctcttttattcttacctctgaagtctaccatgaccagaggacccttcacctcaaaattttaaaatacaaatcagatcacatcattcctatatttaatagtatccagtgacttcccatgacatgtataataaactcttaagctctttatgactgcataaagcctcatatctgggactgtcagatgagttcaactcattcttcctcagggctttgttttgcccttgttttccactctgcctggaatgttctcccacatctccacatggttcactcattctcacatttagacttctcctcttatgtcacctctgcagggaagccacaggatctaaaccccagttactccattaacaactcatcccaccccaaacttaccagattttcttcataatacttatcactacctgaaattttaaatattaatttaattttcaagacagggtcttactctgtcacccaggctggagtgaagtggtgtgatcacagctcactgcagcctcaaccccctaggctcacatgatcctcccatctcggcctcttgagtagctgggactacaagcacgtgccaccacatctagctaacttttaacaatttttttgtagagatgaggtctcactatgttccccagggtggtcttgaactcctgggctcaagtgatcctcctgcctcagcctcccaaagtgctgggattataggcatgggccactacacctggccactaactcaaactataatatttgcttgctagcctattgcctcttcagcactagaatactagaatctaagttctgttggagcaaaggctttgaatataccctacttccaatgcctagaaaaatacctggcacaaagtagcaattttcagaatgactaaatgaatcaatgtatggcaaccttcagtccatatttgatccgcatgatattttaacaaaatttcacatggttgaaaatagttgagaaaacagatattcgcaaaaatattcggatttctgtcttctcaagaaaaactagggtatccagcaaacctggatctgtatgccacatggtaacaattggcatgcactctccattttggtaccattttcacttcatttattattattcactaatgtgatgtgagcattcactcatttactattatccacctagtttccattggtacttgagtttgctaccctggatttaccaaatattagagaatccaatatatgttctgcaacatttatagtccaatgtatccataagaaaaacaagagccagggccagtagcttacactggtaattgctgagctttgggaggccaagatgggaggactgcttgatgccaggcaacatagcaagacctcatctctacaaaaaattaaataattagttgggcgtggtagcatgcacctatagccctagctactcatgaagctgagatgggaacatcactcaagcccaggaatttgatggcacagtaagctatgattgcgccactgcactccagcctgggcaacaatacaacatcctgtctctaaaaaaagaaaaaaaagaaaaatgaggcctagacatgttaaatatttgatacaaaattccttggcaagttagtggcagaaaatggcctatacccaggttttctaacccaaaaatacagagcttccattgtatataccacattgccacatttttaagaaagggttaaatatctgttaaactagaacccaactaactgcttaaaattttcctgcacttgggttaaagaggaaagaggaaaatcaaaagaaaacaaacaaaaaatattttaagctctttgatatgttaggaatatcacacactggtctgaaaattctaccttttgtatctatagagctatataataagacctgttgcccataatagtgaatccactcattgcaaagtcatgatcatacaactaaagatttaatcatattctagactactccatttattaggagaaatgagtatactacagcattgttacaagatttttcatgtactgaaatagttttctgattaaataaaatataccatttatattccattcccttaaacagtatggttattcaaagatctacttgaaacactgcaagtgtcatagtcctttaaaatctgttttattccaatgtcaaaaatattcagtagtaggcggggcacggtggctcacgcctgtaatcccaacattttgggaggccaaggcaggcggatcacgaggtcaggagatggggaccatcctagctaacaaggtaaaaccccgtctcaataaaaaaataaataaataaaattagccaggcgtggttgcgggcgcctgtagtcccagctacttgggagtctgacgcaggtgaatggcatgaacctgggaggcggagcttgcagtgagcctagatcatgccactgcactccagcctgggtgacacagcgagactctgtctcaaaaaaaaaaaaaggaaatgaggtaagctccatgtacctactactcagtaaccttataaaatcataacactttgccatattattctatacatctataagaaagtgataaatgcattacagacagtgttaaaattcacacgcataacgcttcctgatcccattttcctcctctgtcacagccaatcactatcactatccttgtttttaggattatcatctatatgtaagtttttatattattagtacacatatatccataaataacataccacatcactttgtatgttttcaaacctgatataaatggtatcatactgaatgtataatgatatgcttttcaagttaaacatgacaaagtctaatgaagttttaaaacttagagaagaaaaaacagcatgagagaaaattatttaaaattgtcaaaggtgtcaaaaattaaaatcttaccaaaaaactagcctaatcttttaaaaaattaaataaaattccacaattagggtcaaaaaatttgagatttaaaacagaaactagcaatctcttaactaaggaattactagctgaaatttatataataatatttctttaagtgttcattaggaaaaggtgtcagtactgaaaagcagctgaggcctagctaagcaaggggttcatttcttattggaatagtataggcctggtctgaggcttcacttcaaagtctctagagttcaattaaaactggattaggtagaaacagacccttctttgggactttctgttcactgaaactctacatacactgacagcaccttagacagaggtctagccctccaatgaatcagttgccatagaaaccatatcattaccattgctctgcagttatgacctcaactcctgaattgcttgaaatctttactctctttgaatgtttaccaccttgttttattattgttagtattattattagtaaattaagctttcaattgttttaaataatttgtttcaaagctggtttattaaatgttgagacagtgtgttagagaggagagaaaggatttagtattgaatacatagattatatacacacataaatattctatttatttactgtaaaacatcaaacctatcttttttaaaagttttatttaaaaactgtgccttatgaaaaggatatattatttttcccaaataatgcatgtatttcttccttctgtcctacaaatagtatactattaacacataagaaaattgcttcactttgttgcacttattcttagtaaaagtaaggcattttttactttccctttaccagtccatttgtaaaagcttataagtttatccaaataaaactcttttttgttttcttgtcctcatgaaagaacaaaaatagaaaccaacactcactgcccaactatatactcttatttattgaatactagggatttttaaaaagtagatttaaaatagttaaagccaatcctttaagtgaatagaaagggaggttttatttttttaaaaaaaactatccttgatacattttaaatgttttaaaattcctcctgaagggtaaatattaaaaagtgataaaatgttttacctcaaaaaaaagaaatacttacatgagagcctgcacatgtaacatcaataaaaggtattttaaaaattactattcctaaggtttaaaactagcatagcatatccctatgccaaatatttcccaaattctatagtaattttattttttcagacaattccagatttctgaagattttggtgttaagaataaaatcaggtaatatatatcaataacaatatttaaaaattcacaacagaaccatctccaaaccctatcaatacatttaacatcaggaaaaatgttgttagccaaatatacaaaatgtaaactaatcataccattcattaagcaataacacaatggctaagaaagtctagaaaatattcactatatcccattttaatggaacataattacatagtcacaggttaacactttaatatggaaaaactaattatttgaaccacctttaaaataaagacattgaaaaatactttcatatcaattcaccaataaatatatgtgcaaatgttttatgttacaataattgtaatttgaacaaatagcttaaagaattttaatcaagtattttaaagttgcatcactgttattaacatagtttttacattttgctatagttttctctgaaggtagatatcaaagcatagcacgtaatttactcaaataatattgaatcctagttggttcaaggatttacttcatcaccaaccatatgacttttggttttaaaattcaaggatatattctttaagtaaaatttagaggtcttttttgaatttgacaatgacaatgacacacagtcgactctggtggaaaatttaagttgataattttcttactaaatgtatatccatgaacacttagaatgtccccaaacttcaacaaacaacaaaaatgaaagtcatacataaaaaataaaattacctcttaaattaatcatgtgttgttatttaatttttttcatctatacagtatatttcccttctggtttcaagtactatgatgtagtatagtattcatagcatttcatgggtgacaaattcaattaaacatattcattactctaatgttctacttggcagttttagtcagtatgaaaaattaaaaatatataaataaaatgctatgtgacctttgtattgattggactaaaatggctttagcctgggtgtggacgatggggcagttgggaggggcaagaggggagcctacaaacacacacactcttatgttttctcttccaattactgagggagatgataaaaccacagcaaatgatgtatcagctcattttatcttatcgctttggggctaggtgacaatgaagttcatatttcacgggctcccattgaagactgtgaaaattacttgcccttatgacctgaaatttcactagaagacagaaatttctcttctgcaaagtaatgcaatttttcagatgtcaacctttagcccagctttaaaaattaatttcatttatattaaccaatgatattgatattttcacagaacactctttgatacatgaagcactgactggcaaattgatgttgctttagatgggtaaaactattttattttaagctgctgtggcacacagatttatggcaaactgaaattcccatttcataatttaatatttgtgctggagttgatgcacctttaagcccttggcctgtaaataattcagactctttacttggttgttttattttcaatattcctcagcttaaaaataatttgcattctaaatgatgcatcttaaaagccatctcttattcaactagcattaaatatcaatcttaatgagtcaaaagccaaacgtagtaatgaaggagaagaacaaagaaggtatttatttatcttccagctcatttttaattcagtttttaaaatttaaactataccataagtctaaatttttttttgaaagaaggcaagaaaccaaaatgaacccgcaaaaggatattaaggaaccatagcaaggaacatgaatatattttatatctttttcatagcagcacataaggtgaagagctgggtgataaatttgtagagaaggaacaaaatgaacttagatatttatctaaattaaaatagatatttagctttgaaggtaccttttaaaatacaaacaaaaacaaagccacaatgtcaatatcattgtgaacgaggcataaaagggtctcatctgattttagtaaaggagatactgaaattaccttgtatctgtacaaaagaaacatttcaatatacaatttcaatattttagagtaataaaaatgctactaaaagatgtatgatctggtgtctttacaagttacaactttattatctttatccagtaaagagttttgtctaattcaaataatgccttgagaagataatcattaaacaaatacccttctattttataaggaaagtcaagcataaatatgcatataacttatacattcatttatgatcttaaaattagaaaaaggctaagaaagccatttatctaatttaggtagtttctccccaaatggtttaacactgctttggctaaatttctatactcaaaataatttttgcacctttatgccaacaatattcaaattgttttttcttcaaaatatttatatttagttcttccttacatgtacggtatagaaaaaaatcataatataaattttccctttataattttttcatttagattgaaaatattcccaattacttctcaaaaagttgtgacaataacatgctattgttgctgaattaagctataaagtatttctgtcagggccaggcaaagtggattatgcctgtaatcctagcaatttgggaggctgaggcaggaggatcacttgaggccaggaattccagaccagactgggaaatacagcaagatcccatctctacaaaaaataaaattagatgactgaggtggcatgtgcctgtagttccggctactccagaggctgaggtgggaggactgctcgagcccagaaattgtttgaggctgcagtgagctatgactgcaccactgtacttcaggttgggcaacagagacttttttttttttttaagtatttttgtctaatgttccccatattgattctctatagtcataagctttctattccttactagagagttaaaatttaagtcaccactaataaaaaactaactttaaatatattggaatatttcacaataagtactttaaaacaaccaatgggcagaaactctctttcttctcaatgccaattcttccttcatgaactccatctttgatgggtatcaaaagccctccctaaaaaagtgttttacttctcatagaagtaaaaagtaaaacagaggatactagaggttggaaagtgaggtgggaagcaaggaaagtgaggtgggaagcaaggaacatggaaagatttgttaaaagatacaaaattacagttagacagtaataagttctagtgttctataccactgtagaatgactccagtgaacaataacatatagtttcaaacagctagaagtaggatagtgaatgttcccaacatgaagaaaggatgtttgacatgattaatatgctaattaccctgatctgattactatacattatgtgtatacaacatctttatgtaccccatgaatacgtacaactgttgcttaaaattttttaaaaataaaatgaccaaaggtaaagttaaaaaaaaaaaaatccccccttgggctgggcgccggggcttatgtctgtaatcccagcactttgggaggctgaggcgggcaaatattcctgaggtcagtagttcaagaccagcctggccaacatggtgaaaccctgtctctactaaaaatacaaaaaattagctgagtctggtggcgggcgcctgtaatcccagcttactcaggaggctgagacaggagaattccttgaacctgggaggcggaggttgcagtgagctgagatcggactactgcactccagcctgggcagcaagagcgagactctgtctctaaataaataaataaataaataatcccccctctcccagatgtatgaactaaatcttcaagttagagtaatatcagtttactgatagactattctgtgtagcagatacaatatgatttagccactggaagtttctctgttacctaagctacttaaacaaattaaagggaaaacctttgtttatcttgaagaaatttgcttttgttctttgaacacagcaagcaagagaaatgaaaagcaaaatggaaaggaaaaattaggaacatagaacttgatgctaagagcctaaaatccccaggatacatttttcctaatcagagggaaatacttttctacttttttaaaattagtacctgcctcctactaaatattaagcttgtttagttggagtcagttataaatgaatagtacagatttgtattcacttccataatagagcatggaactaaatgctatgctcacatttgccttcagacgtaatcttccaaaaagccattttcttaaaggacctatatgtaatagaacattatgaataaaacttaaataagacttttggggttaacctcatttcattgcgtaactccatattgttgcacaatcctcactagattggagttcatactttaactggagttcttatgacactacatcactagtcttagtcatctttctattcacagtatctagcacaatactgaagagactgactgatggatggagggccaactcagcttcactaagtgtctacaatcaggccagatgtggtggctcacgtctgtaataccagcactttggtaggccaaggtgggagaatcacttgagctcaggagttcaagatcagctgggcaacacagcaaaaccccgtctctgctaaaaaatgcaaaaattagctggaggtggtggtgtgtgcctgtggtcccagatactagggcggctgaggcaggagaatcacttgggcctgggatgcagaaggtgtagtgagccaaggtcgtgccactgtactgggcaatagagcaagaccccatctcaaaaaaaaaaggtatctacaatctaagattctgggaacacatgaacataaacacagcaaaaaacaaaagggggaagaagagtaaaatggaaaactacaacataaaaatttttaaaaatcaaattcaagggtcagaatacttccacttttgatgaagatggagtaacagggcctggatttatcctacctaaacaatatgcaaaatgaacataatatactgaaaagttgttttcaaaatattaaatattaagcaataaaaaacagtgattcctgaaaaacaggaaacaaaattgtgacacctattaatgcccaagcacaccatctggaaagactttgcagggcccagaggaaaatagagaaacgtagttagaacgtaatggtctcctgcagtagagaaaacagagcttgaagtacagggagatcaaggcatcaaaagcttgcagggcagagtagcagatcagagagagctgcaaagcaacagagctccagagatctgcagccttcagctgagtactgaccaagctatgaaagaaaacaatgtgagaccagtgaaagaatcatcctaagaaattacaatgaacagtactcagagctcacacagaatgtaaaaatctcatgattcatggagcactgtagagactactcaaaagggttttgccacagaagtgggggaaagttagctctagacttaatgctgctctagttctccctaaaaatcttaaaaccaagctccagatggatcaaactatttctaagtaacttaactgtatcccagaacaatgtattataaggaatgcaaaaatatccaccacacaactaggcaaaaatcactacaactggcattcaattcataattactgggcctgtaaaagaagcaaaacaacatgacccacatgaggagagaacttaattaaacaaaactctcctagaaatgaccatcaacagaatttttagaaaaagacatcaaggggagccaagatggccaaataggaacagctccagtctacagctcccagtgtgagcaacacagaagacgggtgatttctgcatttccaactgaggtaccgggttcatctcactggggtgtgccagacagtgggtgcaggacagtgggtgcagcgcaccgtgcgtgaggcgaagcagggcaaggcattgccttacccgagaagcgcaaggggtcagggaattccctttcctagtcaaagaaaggggtgacagacggcacctggaaaattgggtcactcccaccctaatactgcgctttcccaacgggcttaaaaaatggcacacaaggagattatatcccgcacctgactcagagggtcctacacccacggagtctcgctcattgctagcacagcagtctgagatcaaactgcaaggtggcagcgaggctgggggaggggtgcccaacattgcccaggcttgattaggtaaacaaagcagccaggaagctcgaactgggtggaggccaccatagctcaaggaggcctgcctgcctctggaggctccacctctgggggcatggcacagacaaacaaaatgacagcagtaacctctgcagacttaaatgtccctgtctgacagctttgaagagagtagtggttctcccagcatgcagattgagatctgagaacaggcagaccgcctcctcaagtgggtccctgacccccgagtagcctaactgggaggcaccccccagtaggggcggactgacacctcacacggccgggtactcccctgagacaaaacttccagaggaacgatcaggcagcagcattggcagttcaccaatatccgctgttctgcagccaccgctgctgacacccacgcaaacagggtctggagtggacttctaccaaaccccaacagtttggtagaactgggtctggagtggactctaccaaactctctgcagctgagagtcctgtctgttagaaggaaaactaacaaacaggaaggacatccacacaaaaaacccatcaggacattaccatcatcaaagaccaaaggtagataaaaccacaaagatggggaaaaaacagagcagaaaaactggaaactctaaaaaatcagagcacctctcctcctccataggaacgcagctcctcacgagcaacggaacaaagctggacggagaatgactttgacgagttgagagaagaaggcttcagatgatcaaactacgctgagctacaggaggaaattcgaaccaatggcaaagaagttaaaaactttgaaaaaaaattagacgaatggataactagaataaccaatgcagagaagtccttaaaggacctgatggagctgaaaaccaaggcacgagaactaggtgatgaatgcacaagcctcagtagccgatgcgatcaactggaagaaagggtatcagtgatggaagacaaaacgaatgacacgaagcaagaagagaagtttagagaaaaaagaataaaaagaaatgaacaaagcctccaagaaatatgggactatgtgaaaagaccaaatctacatctgactggtgtacctgaaagtgatgggcagaatggaaccaagttggaaaacactctgcaggatattatccaggagaacttccccaatctagcaaggcaggccaacattcaaattcaggaaatacagagaacgccacaaagatactcctcgagaagagcaactccaagacccataattttcagattcaccaaagttgaaatgaaggaaaaaaatgttaaatgcagccagagagaaaggtcgggttacccacaaagggaagcccatcagcctaaaggctgatctttcagcagaaactctacaagccagaagagagtgggggccaatattcaacattcttaaagaaaagaattttcaacccagaatttcatatccagccaaactaagcttcataagtgaacaagaaataaaatactttacagacaagcaaatgctgagagattttgtcaccaccaggcctgccctaaaggagctcctgaaggaagcattaaacatggaaaggaacaactggtaccagccactgcaaaaacatgccaaattgtaaagaccatcaaggctaggaagaaactgcatcaactaacgagcaaaatagccagctgacatcataatgacaggatcaaattcacacataacgacattaactttgaatgtaaatgggctacacagactggcaaattggataaagagtcaagacccatcagtgtgctgtattcaggagacccatctcacatgcagagacacacataggctcaaaataaagggatggaggaagatctaccaagcaaatggaaaacaaaaaaaggcaggggttgcaatcctagtctctgagaaaacagactttaaaccaacaaagatcaaaggagacaaagaaggccattacataatggtaaagggatcaattcaacaagaagagctaactatcctaaatatatatgcaaccaatacaggagcacctagattcataaagcaagtccttagtgacctacaaagagacttagactcccacacaacaataataatgggagactttaacaccccactgtcaacattagacagatcaatgagacagaaagttaacaaggatacccaggaactgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcagaccacagtgcaatcaaactagaactcaggattaagaaactcaatcaaaaccgctcaactacatggaaactgaacaacctgctcctgaatgactactgggtacataacgaaatgaaggcagaaataaagatgttctttgacaccaatgagaacaaagacacgacataccagaatctctaggacacattcaaagcagtgtgtagagggaaatttatagcactaaatgcccacaagagaaagcaggaaagatctaaaattcacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagttggttttttgaaaagatcaacaaaattattagaccactagcaagaataacaagaaaagagagaagaatcaaacagacgtaataaaaaatgagaaaggggatatcaccaccgatcccacagaaatacaaactaccatcagagaatactataaacagctctatgcaaataaactagaaaatctagaagacatggataaattcctcgacacatacatcctcccaagattaaaccaggaagaagttgaatctctgaatagaccaataacaggctctgaaattgaggcaataattaatagcttaccaaccaaaaaaagtccaggaccagatggattcacagctgaattctaccagaggtgcaaggaggagctggtatcattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcagtaaaatactggcaaaccaaatccagcagcacatcaaaaagcttatccaccatgatcaagtgggcttcatccctgagatgcaaggctggttcaacatatgcaaatcaataaatgtaatccagaacataaacagaaccaaagacaaaaaccacatgattatctcaatagatgcagaaaaggcctttgacaaaattcaacaacccttcatgctaaaaactctcaataaattaggtattaatgggacatatctcaaaataataagagctatctataacaaacccacagccaatatcatactgaatggacaaaaactggaggcattccctttgaaaactggcacaagacagggatgccctctctcaccactcttattcaacatagtgttggaagttctggccagggcaatccgtcaggagaaagaaagaaagggtattcgattaggaaaagaggaagtcaaactgcccctgtttgcagatgacatgattgtatatctagaaaaccccattgtctcaggccaaaatctccttaagctgataagcaacttcagcaaagtctcaggatataaaatcaatggcaaaaatcacaagcattcttatacacgaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtgggaagaatcaatatcatgaaaatggccatactgcccaaggtaatttatagattcaatgccatccccatcaagctaccaatgactttcttcacagaattggaaaaaactactttaaagttcatatggaatcaaaaaagagcccgcattgccaagtcaatcctaagccaaaagaacaaagctggaggcatcactcttcttgacttcaaactatactacaaggctacagtaaccaaaacagcatggtactggtatcaaaacagagatatagaccaatggaacagaacagagccctcagaaataatgccgcatatctacaactatctgatctttgacaaacctgagaaaaacaagaaatgaggaaaggattccttatataataaatggtgctgggaaaactggctagccatatgtaggaagctgaaactggatcccttccttacaccttatacaaaaattaattcaagatggattaaagacttacatgttagacctaaaaccataaaaaccctagaagaaaacctaggcaataccattcaggacacaggcatgggcaaggacttcatgtctaaaacaccaaaagcaatgttaacaaaagccaaaattgacaaatgggatctaattaaactgaagagcttctgcagagcaaaagaaactaccatcagagtgaacaggcaacctacagaatgggagaaaatttttgcaaccaacccaaatgtccaacaacgacagactgggttaagaaaacgtggcacatacacaccatggaatactatgcagccataaaaaatgatgagttcatgtcctttgtagggacatggatgcaactggaaaccatcattctcagcaaactattgccaaggacaaaaaaccaaacaccgcatgttctcactcataggtgggaattgaaaaataagaacacatggacacaggaaggggaacatcacaaaccggggactgttgtggggtggggggaggggagggatagcattaggagatatacctaatgctaaatgacgagttaatgggtacagcacaccaacatggcacatgtatacatatgtaacaaacctgcaaattgtgcacatgtaccctaaaacttaaaataataaaatttaaaaaaaaagggggggggggggagaaaaagacatcacatgagaccaagcagttttgttttgttttttttgagacagacccttgctctgtcacccaggctggagtgcagtggcgtgatctctgctcactgcaacctctgcctcctgggttcagacgattctcctgcctcagcctcctgagtagctgggactaggactacaggtgcccaccaccatgcctggctaatttttgtatttttagtagaggcggggtttcaccatgttggctaggctggtctcgaactcctgacctcaaatgatccacccaccttggcctcccaaagtgtgggattataggcaggagccaccacgtccagccccaagtagattttagagcaaaacatttaattagggataaagagggtcattttataataatatcatttcatcaagaggctttatttaactatcctaattgtttatgatctgaataacagagcttcaaaacacaagaagcaaaaactgagagaactgaaagaagaaacacatgaacccacaatataaacatttcaacattcctctgtaattaataaaacaagaagattgaaaaatcaataaagatacaaaggagttgaacaagaccatcaaccaacagaacctaactgacatttatagaacagtccaaccccagagcaaggttacgaaaagcatattttgggctaaaattcaagttgcaataaatttaagactcaaatcagataaagtatattctctgactacaatagaagtaaattaaaaatcagtaacaatagattgtttgcacagcatggtgactatagttaatggtaatgtactgtttatttcaaaattgctaaaagagattttaaacattcttaccacaagatataagtatgtgagttaatgaatatattaattagccagattttatcattccacaaaatatacatattattaaaacatcacacagtaccctatatataccattattatttttcaattaataagaaaatttaaaaaaagctatctggaaaaggccccaaatttgaaaattaaatagtacacatctaaataacctatgagtaagagaaaaaaacgaaaaggaaattagcaagtatttaaaattggatgaaaatgaaaacacaattttaaaaaattctagaatacagctaaagcagtacttagagggaaatttacagcactaaatgcatatattaatgtgaaagaaagatctcttttcagtgattttgacatcccctttaggaaaaaagaaaaataagagcaagttaaacccagattaagcagagaaaggaaataataaaaatcaaaagaatagaaaaccaaaaaaaaaaaagagagaaatatcactaaaacctaaagctgtttttgtgttttgttttgtttttttaaaaaaagatcaataaaattgataaacctctgaccagagattagggaaaaaaaatagatgtaaatcacgaatatcaggaattataacaggaattaccaatattaggagagaagagacatcaaaacagatttttagacattaaaaggataaggggatatcataaacaaatagtttggactactttgatgcgatgaacagatctcttgaaagacacaaacttggccaggtcctgtggctcacgcctgtaatcccagaactttgggagacagaagcaggcagattacttgaagtctggagttcgagaccagcctggccaacatggtgaaaccgcatctctactaaaaatacaaaaacagccaagtgtggtggcacatgcctgtaatcccagggacttgggaggctgaggcaggagaattgcttgaaaccaggagggaggtggaggttgcagtgagccgagatcacgccactgccctccagcctgggcggcagagtgagactccatctcaaaaaaaaagagaaagatacaaactaccaaacccctttcaagaagaaatagattgcataaataatacaatatctaataaagaagttaaatttgtagtttaaatcttcccaaaaagtaaactccaggctcagcagactacactggtaaattctaccaaatatttaaggaagaaactctatacaaacttgtccagaatattaaagaggaaagaatacgtgccaactcgttctatgaggtcagcattatccagatgtcaaaaccagacaaacacagtataagtaaaaaggcagtctgcacttaaatatttgtaaaatttctctgtcttgagacttactgtggataccctacaaaataaatatattaaatgtcttctcatactaccttcccactcttgtaccttcacaaattgtcactcaatgcacccatctttctctcggatttctcaaaaacatctacgcagtttccttttgtagtacattccaacttgacttcctttggatttcaacagagtggaattcttagccttcttagtttacactgagtgatttcatcccgaatcactgcttctattgttgccaaagcacgctggggtgtgagatgtagagctaagatattagaggtcagttttagacccctatatccaatcacctataaatagctccaccatatgccctctaaactctcaaattcttttattttttattattttatttatttacttttcattattttttgagacagagtctcactctgtcgcccaagctggagtgcagtggcgtgatcttggctcactgcaacctccgcctcccgggttcaagcgattctcctgcctcagcctcctgaatagctgggactacaggcacgtgccaccatgcctggctaatttttttgtatttttagtagagacagggtttcaccatgttggctaggctggtctcaaattcctgacctcaggtcatcctccggccttggcctcccaaagttctgggattacaggcgtgagcctccatgcctggcctaacctctcaaattcaacacatccaaaaacgaactcactaccacccctcaacagctgtcattagtccaattgagactatttcagttagcagagccataaacaccatgtaagccaaacaaaaacttagttatgctaaatactacatctcactccttttgaccctcactcacctctcaatgaactacttcacttgactctatctcccttctgcttttagtcatatagggtaaaacctactttagaagaggttcttatcatcttttaccattttcatagacatatcttatattctaaacatgtcatacaacataacactccttcaatcacgccatgctgcttcatgcttaagcatctcccagtgtgatggtcttcctaactgcaatgcagcttctttcaacgtgcaccaccaaggaggtggtggcagtggttgtattaaagtagtaccagacagtaatagcggtagcagcaacaaacacaacttacttagatctcattgtatcccaggatctatgctaagtgattcaattcagttatttcagctaactctcaaaatggcactgtgaaatcgatgtcattttcaccattttataaattaacaaacagtctttgagaggttagatgacgcagtcaaaatcacataactagtaagtagtgtagccaagtctatcagacttctgacattatgctctgagccactatataatactcccaccacagagaacttctcatccttaaaggccaagccaagattttgcaaaagctctgacttctcaaacagatgtgctaccacaggcctcttacaaattgtaaatgtctccctcactagacaattactgaaggcagatactaaacagtacttattttagtaattccagtgctactggtacatcacagaactcaataaatgtatacccaatgaattaatgatgagattaacaatttcagttgaaacagattcctcatcttccactccatgtttctataattagtttcaaaactgaacagaaaagagagatctttaggctttttaaaatagcgaactgtgtatttcagcccctggtaagggcattggggaggccataatcaaggttagccaaatttgttgtatctggagaaagtggttcaaatgacctttcataactactaaggaactggaaacttatgatttagatcatttaaaaggaacttattataagaattaaaaagtgagtgttatgaactgaatgtgtctttccaaaatatgttgaaatcctaacttccaacgtgatggcaacaggaggtgatttggactttgggaggtgaacaagtacttagaggagagccctcatgaatgggattataataagagactccagaaagctctctagccctctttccaccaggtaaggatagaatcaggagtcagcagtctagggctccacaccagaatctaccatgctggcatcctaatctcagactttcagcctccagaactgtgagaaataaatttctgttgtttataagccacccagtctatggtactttgttatagcagcccaaacaaagacagtgctttttgagaaaaaaaaaaaaaaaaaaaaaagatgaagagtccttgttctgcagtgaattattagaacctaaaagaaacatgtttctgaacaccttcacctccccccaaaaaagggaacaggtaataaaaatatgcaatgtagatttgctatattatgtaagaatattcaattctgctttagaagacaagaaaacaaatgtgatagatgaacacaaaagaaacattaaacattaatagtaacataatagcttccaagatgtaggcaaaaagtcataggctatgttaagtataggtaaggaagtaagtggcttatgagagacagacaaaattcaaatgatgttaaatacgtacagtcaatttaaagtttgaaatcagcaagacctgtcaaagacagaatacattgaatgtatgatggcacacaaaaaaagtgctatttacagatggatggaaagaccacctcaaggtataatcatactacctctgtgctgggtctctcatatttctgcagatcttagaggaaagtagtaattgccatcttatatgacacactgttttcaaggatgtttgcataattaatagccttggaagagacagtatctcagtttacagcaatgggcaggtttgtttactgtccagtataagaaaggtaatgatgctttataaggcagaggccagatcttactgcccattgtaaaaattttaggttctctacagttgaggttgcttaactgggatgtaaactcactgggaacacagcatccacctgggtcccacctgggtcctcattgggaacacagcacccacctgggtctgttcatgatgccctaataaaatactgcagactaggtggcttaaacaacaggtgtgatttcttggagttctggaggctgggaagtccaagatcaagttgccagccagtttggttcctgctgagggctctcctcctggcttgcagatgacttcctgctccctgtcccctcacatagtggagacagagaatttctctttcatcgtcttcttataaggccaaagtcctatcagattggggccgcatccttatgacctcatttactcttcattacctcctaaagagtctatctccagattcagtcacactgggggttacagcttcaacatataaattttggggaaatacacatcagtccatagcatctccaacaagtcactccatgaaacttggggatgcgagggaaatagacactaacaagatgcttactctgcttgtgctgtaagtctttgtccctaacctttgtcctatgtcttctgccaacatctaagaaactgtggcaagataaattgttagcttgcatttcagacctttcatagtttttttgttgttgttttgttttgtttgtttttgagatggagtttcactcttgtcacccaggctggagtgcaatggcatgatcctggctcactgcaacctccgcctcccgagttcaagtgattctcctgcctcagcctcccaagtagctgggattacaggcatgtgccaccacgcccagctaattttgtatttttagtagagacggggtttcaccatgttggccaggctggtcatgaactcctgacctcaggtgatccacccgccttggcctccttaagtgttgggattacaggtgtgagccaccacatgccgggcccctttcatagttcctgacaacctggatgatatctatgccggctttaaattgcccacccattgataatacccagtatagccccactctggcccctgtggttttatctgcacaagaaatgcagaaaaaaacttgtaaaactattcagcaggttaattggttggctccagctatgaccagggatagctgctgctgtgtgtctctaatagagctggtgtgtttcattggaccggaacactttccttctgtggtctcccttgtactcaaacctcaattctggcacttgtaacatcaaagaaaggcatacgaggcagaaaaagagacaggacatataaatgttacatgaaccaggactcaagaactctgatctttctacctgcttgcattcgatccgaagtatattaacttatcccaactctcttccatttcttcttattgcgtatgttaaattgatttaatgaatcatctgctttgagaagcttatttgatctgtgagcccttctgttctgtgaaatctgggacgacttgcctggtagtgtactaggaggcaacattgcattaggtaatttcccacagaacaggttcatagctaacctttatctcgccttaaactaccgttgaaaaaaattattctaggccactggggaaaaaataggaagctccataattcatttattaagccagcataatgttaatgctgaaaacttaaaaagagataaagagactatcaaaaaggaaaataatagagcatttttatcactgaataaagatacaacactcttaagtaatctgtaagcaaacagaatccagcaatgtctaatgagaacaatataacattaccaaggagggtattttcttggattgcaagagtggttcaataccaggaaatccacaacaggagatctactccttatatcaacaaattaaaaggaaaacattgcatcatcatttactagatgctgaaaagcatttgatcaaattcaggaaccaccactaaagaaaaaaagttagtaaaacaggagtggaaaatattacgtaaaataaagactttttaccagaaaccaacaacaaatattagctatgtgatctggggtcagtcatgtaggcttctcacctcagatgcttgtcttaaattaattagtgtaggtacagctagtaaaacagggcctggcacatcataagcactatgcatgggttagcaattattattacaataataattatcaccagtcaaattgcaaaagttgtaataaatgaaataataaaatgtaaaacctggtataaacattgaaaagaaagatgaaaatgcatttgaaatatccaaagtactccaaatgattaacggaaatatatataagataaacatgggaactattaatatttgttctccattttagcatttgacacaaatattgaaattagaaaaaaatttcattcataattgcaagaaaaacattacacacttaggaataattttaacaagaaaggcagagagggaccatgggacaaaaaatataaaacaattattagaggaacacaaagtacaatctgaacacccaaaaaacttttataatagtaagaaaataccattaaaatgtaaatttaccaaaaaccaatatgtatatgagttttataaattataattaaagtgacaataggacttttttaaaggcttcataaaattatttaatgtttacaaactatataccagaaaatagtcaataaaaggatgaaaacaaagactagtaaggagtattctaccttaaacaatatgcaaatggcataaaaacaaatatatatttttttaaaacattagactgtaattcagtctgacattttctattctcttttttttttttttttttttttttttgctaagtacctgttgtgatgcacaaagctgatagcacagcttaatgtggaatgatcaacacatatgcaaagcacctagactgtacagtggcttgcacacagttacctttctattgttcttcccatgtgactacatatataatctaaaggccaagagaatttttaaaccataattggaactcagaaagtactaaaaaatatttatacctataactttgtaaaattgtaaaattaatggcaaaaatatgactgataaagtcaaatagtgaaagatctgaaaaagctatttcatgataaagggttactataatatacaatacttataaaataaaaaatgaatagaaaatggataaagaatataaaaggaatttcacagaattcaaatgtccagcattttaaaaatgctgaagtttattagtagtactaaaaaagacattaaaataatttataccccagaaacaataaaaaaattaagagttataatacattttgctgacaagagtgcagacaaaagtgtatattgttggtagaagcatgaaatgtaaaatccctttggaaagtaatccaaaattatttatcaaaaataaaaatatgtatggcctttgacccaacaagcttttggataacaaatagaaataatagttttattacatcaacatgtagggatggttattcccacatttttcatagtgacaaaaaaatgaaaataagactttgaaatccaatgcaaatcactgggaaaatggtggtatatttatgatgtatcttcttcagtcatttaaaagaatgaattaaagtcacagagttgacttggctggatatccacaatcaatatattatggagtgagataaacaaacataccaagttgtatatattatatgactttatttttgtaaatcaatgacactcactccctacaacatacataagtttatatgaaaatgaagaaaaacatgagaagattacgtactaggttgcaaatatatgttaaggtgttgccaggcacagcggctcacacttgcaatcccaacactttaggaggccaagacaggaagactgcttgagcccaggagttcgagaccagcctaggcaacacagggactctgtctctacaaaaaaatacaaaaattagccaggcatggtggcatgcagccatagtcccagctactcaggaggctaaggcaggaggatcaactgagcctgggaagtcgaagctgcagtaagccatgatcatgccatcacactccagcctgggcaacagaacaaaaccctgtatcaaaaaaataaataaatagaaggtgttctgggggatagatgatgggggcaagaggagaaagccaagacaaagaaaaacaggatgcataaaagtaaaatgcacatgctaacaaaaaacaagcaatgagtagattatatttataataagctgcgggtatattcacaaacatataaaatctgaatgatagcaggtatgacattatttctaaatttttttctatgtcatattaatagtatttgtataaagtagaattcccttatccactcagaggtatgtttcaagaccccttaggggacatctgacaccacagacagtaccaaactcaattgtcatcagttggaacatggttttcttcagactttccgcccacaaatgcaatgctttttccaccttaactaagcacttattatgcactgtgctggtaacttttgcagtttgaagtatgacagcaaaactagcacaaatttcttattccctcttcacaattttatagataaagatgcattcttactatggatcttagcaacctcaacatacgctatttcttctttcagttcgagaactttcaccatttcacttcgaggaatcattttacagcttctctttagcatatctcaattgccaacatcactacttttgaactttgggacgattagtaagtaaaataagggttacttgaacacaagaactgtgttaccacattagtggatctgataacctaagcaactaacagcaggtagtgtagacagtgtggatatgctagacaaaggaaagatccatgtcccaggcaggaaggtgcaagatttcatcatgctactcagaatggtgcacaatataaaacataaattgtttattttgggaattttttatttacaattttcagtctacgattcaccactgtaactaaaactatggaaagcaaaaccatggataaggggaggctactgtatggtcatgtaggatgaaagtcaacttatctttctttcctttcttttagtttccagagctcaacctgcttacctttttttccctactttaacgtttgcaaaattctttctataggtttttgagaattcttcgcctacaaccagcctcccttccttctcattgtccttaaaaataagaatacaaaccctttgaattttaaatgttttactcttgttttctatcaggcaccaaatattcaggtgactgatagaatgattcacagacctttgtgagtcattaagtgtgaaacatgattcagaagtagcaactggaaacaaacacagtcctctgttaacatctcagagttcaccaaacttttttcttacccatctctgatctccataggcctaatgtaacaacaagagtagaatactaattttctggggtactgtgggtttgtttgcttttttttcctgaggaccggtatccttaaatgcctatctctgtgacctctgccacaaacattaatagtcccacatttgttaatgcatttttatgttgatacaaatatagtcctttcctagataattttttttcctttggtttattttacttcattcataattcatatcaaaatagcaatatttaaatgagacaagtcaattccttataatacattcttccattttcaaagccttgcacatttaagaattaaaataagagaaaacctttagaagtttaaatccattattctttttttttacttaaaattttattaaggtatagaaaatacttggtaaaatacaaagataacaggtgtggaacttgatgacttctaataaattcagacacctatgtaatcaccatcctattataatataatatttccatcatcccagaaaggttgctcacatctcttcactgtcaacatctcctgtaaacattcactgttctcatttctttcatctctgattagttttgcctaatctacgcatgatacacatggaatcgtacatcatgtatccttttgtttatggcttctttcactcaccgtaaagtttttgaggttgttccaagttgttctgtgtattgataattcatttctttttattactgagtagtattgcattgtataaatgtaacatgattggtgtatctacccttcatttaacattcaagtagtttactaagaataaagttgatgtaaacatttgtgtactagtctttttgtgaaccttgtgttttcagtcctcttggacaaatatttaggagtgacactgctgtttcataggataggtggtatgtttaagttttgagaaactgccagaacagttttcaaaacagttgcactattttacactcccatctgcaattgataggagttccagttcctacacatcctagctaacatttggtgttgtcagtcttactaattttagctatcctaacgtgtagtagtgtctcctggtggtttttcaagacaacaaattgtgctgaacattttttcaggtgcttattggccactcacctgccttcctttatcaagtccctaatcaaatcttttgtccatttgttttattgagttatctttttattattgatttgctaatatttagtagacacaagttttgttagataaatacatggaagatattttctcccagtttgaggcttgcctaatcattttgttaataatctaatatcattgaggagatataattttctagaagtctcttgttcttcaatggtaaatgggtcttgaaaagacatcttttgcaaatatattttttaaaggcagcttgtcaatttcttgaaatgacctactgggaatctgaatgggattgagttgaattgatagataaatttggggagaaatgacatctttataatactgagtcttatcatcaaagaacttgtcatatctttcaatttatttaggttttatttttttttccttaggaatattttgtagttttcagtgggcttacagatatttcaacaaattattcctaagtattttatgtttattgaatattattgtaaatgatattaaattcatatttttgaattgttcatagaaaaaacaatttttatgcccatcaatggtagatcagataaagaaaatgtggtacatatacaccatggaatactatgcagccataagaagaatgagatcatattctttgcagcaacatggatacagctagaggtcattgtcctaagcaaactaacgcagaaacagaaagccaaataccacacattctcacttatttgtgacagccaaccattgagtactcatggacacaaagaagggaacaagagacactggggcctacttgaggttgaagggtaggcgagggtacctatgtacctattgggtaactatgctatataatagtataatagtatacctattgtatactatcttgtacttgggtgacataataatatgtacaccaacctatattgtgttttagctatgtattcattttcttaaaaacaatagagacctaattaggttatttatttttaattaaataagctttagaagtttctgtcttcccagtaatttgttcatttaatctaaattgtccaatttattattttcatggctataacatgtataatgttcttttattccaatattggtagttcataccttctctgttttttattaatctgattagatgtttatcaatcttatcaaactttttaaaaaacagcttttggtttcactggatttctagttttttaaagttgatttttttccttttacctttattatatccttccttatgtttgagtttaatttgctcttcttctgacttcttaatgatgagcctcagatatttgattttaaacttttctgttgttctctatattgttatttataaagatataaatttcacagttataggttttcctctaggtactattttgtccatatcccactaattttgatatattatcttttcttttcacttttattgtggagattgggtttcactgtgttgcctggtctggtcttgaactcctggcctcaactcatcttcacacctcagcctcccacagtgctgggattacaagcatgagccagggtacccagcctctattttcattatgactgttaaatacttcctaatgtccctaatggttgcctaaccctatttaagaatatgttgcataatttgaaatatttgggatttcccagatatcttcattactttgatttctagttcaactgaattatgaataaagaatacaatctctgttatttaaattctattaaattagtgcactccttttataaccaaacaaatggtcttcacagtaaatattgcacttgcatttataaggatgaggaattctggagttaaaggtgatgtatcaatctcaattaggttaaatttgttgatagtgttcatgaattctacataattactgacaatacctattgttctatcagttactgatagaaaaattttgaaatctcaaatataaccatgaatttaaatattttcccttcagtttgcttcacatttaaaatctctattatttgatggtatattaattattactgctgtaacaaattaccacaaacttagtggcttacataacacaaaattattatcctataattctggaggacagaaataaaaaatgttccttaatgggctaaaaccaaacctgagttcttttcggggccccaaggatggtgtcatctataagaaacaggcttccaccagacacaaaacctgccagtgcctcaatcttggtcttttcaggctccagaacagtaagaaaataaatttctattgtttacaaattacccagacttaggtattaatattttgttagaggagcacaaattcactaaaagagaaattgttgtcaagagtagaatattgctacaacatatatctaaaaatttaaagcagttttggaactgggtaatgtgacaatattagtatgaatagaaggaagtcagatgctattcatcaaagcaatgcaagaataactccccaaagcatttcagagatctttgagtctgccacacctattacatgcccagagtgccagggcctgagggtagatctttttcaaaggaggggcccacaacaccagaggggctcaaggcacccgtggtaacttggggctcaccaaccagcacagctcaagtctccgcttcccgcattccagtacagtgctctttggccaccccagctatagctgaggaagggccaggtgcagttcaggccacctctctggaggacataagtgataagcctcagtagcatccatgtggtgctaattctgcaggcccacagagtgcaatagctgtggaggcatgacttctccacctagattttaaagaatccttccaagagtcccatggccaaggcagaaaactgctacagaagtggggccactgaatagagcccccactagggcaatgcctagtagagccatggggttgggaccaccaaagacagcacccactagagcaatgtctagtggagttgtgggacctgtcccacagttgtattttgaaggcggtaacttgtttgatttcacaggttcacaactgaaaggcaacttgctaaggctaaaacacaactttcagtctcactcagtctgacttggatggcatctacatgatattctggacgttaaacttttgagctagaaggagttaagacttttggtgctattgtggtagaataaatgtgttttgcatgtgaggttgacatgtattttgcggtgggaatgctatagtctgaatttcccccaaaattcatgtggtgaaacttaatctctattgtattgggcagtgtggtctttggaggtgatcaagtcatgagggctctgcccttatgaatgggatggataactttataaaagggctgaaggttgaaggggccactatcttaccctttctccatgggaggacacagcagcaaggtgccacgatggaagcagagagcagccctcaccagacacaaatggtactgacttcaccgtggaattcccagacaccagaactataataaatttctgttcttcataagttacccaatctcaggtattttgctataccagcacaaacagactaaggcaggtgagaaatgctctagttgacatatcctatgaggaattatatgagatccagatgatatcactagtgatggtaacttcatcacttgattaaggtagaattagccagattttaccaccgtcaagttaccataattcacttcgcatactcttttctatggaaatgtgtcactgaatctagactatcctcagagggaggtgggaagagtaggaattaagttccagctcctagaatgggaagaatctatctatctacccatccatccatccatctatacacaaatacatactagattttaaagttgtacaatctctgtcacttctgggactccactatttaatgatgtttctcctggattagaaccatattttcctgcttctttgcatgtctagtcattttgtgtgttagacattatggactaacaattattttatctacatgttgttgtcttactttagagaataatgaagttttgctctggcagatgggtaatttaattgtgaatcagatggttccttttcaaggttgttttaagctttgttaagacaagtacagagtactatatattatctaaggatacaggagagtacttatagtctcctacaagcacttcttatacatggtcataaaatagaataattggggcaggatgggaacagcagaaattaattttttcttatagttacatcactaacaatccatactaccttcctgacagtacttttcacctaggcaaatgattgtactccataatttctcacacaaaaattaatctacaggcttcttgcaatgtttatttcaccataattttaccttaataaatgtgaacagaagagtggagacagggtaatatagccaggctaatttgaatcctggactttccaagggataaaccaaaaccaatgggcacaaaccctgatttcactgtgttctacccaatagaaaataaaccagcccaagcataaagcagcccaagcatcattcaggaattttatacagttatctatcatgggatctttgcttcttaaactttattatatttactaatggctttcacagtctgtaggcatatttttcactgataatgaaatacagtagaaaatatcctgaggaaaaaatatttaagctttaaactcaggctacaggtagattgtcccttcaacttacaaatattgtgtattgtgaaatactgcctgtaaactagcaattagtcccactgaaatttaaaaatattaattagatgccaaggttttctcataaattactatttgattcaaaaagtgactgaatcatttaataattctgaattctaatctcgcaaaggccaaacatcctcttagcttcttcccatctcaactccaaagcctgacagaagtaatcatttttatagaggttaacaataattcaaaatttctaagtaaagagtgacctatatatatcttgatatttgtttggaaagtttgggaactctttaatcaattgtccaattacaaaggtctaattctactaagagcaaatgttaaaatagatttcaattctatatgtactgaaaacagacttacagacaataatatttttctatttatgtcttatatgaagtattatcagctatggagtgagcatcagaaggcattgtgtatagtctgcatatttaaaaaaaactgaagaaaatattattttatgctgttcctatgcagtcaatgacatgctctggcttttttttttctactaagagaacacattttgatttcagtgtttttccattatgttcttttttttcatagcccaaaagattcattactttgataaccatttatcagggactcaagttcaatctataatacctattgaaatagcaaataattcagcctcagtgtctgtgtgtgggaaaatgggctgtgtgctagataaacggcctacctgcctctgacacagattaggtcatcattcaaactaaccacagatctctagaacaaatacaaggaactacaggttcactttagctgatgtttctgttttagaaacagtcttccttttagagagttacaatatcatcaaagtatcatggcacaggcttgaaaaaccagcatccaggaacgtaaggatagaaatatttcacaatttttacaaaacaccaattatgcaacacatacttatatctgatttctcttttacactagggaatcttataaaacccctgctatttccatctgaatgaaattatataactatattatgctaggttgtaggcaaggaaagccgttacagacatacatctctttccatatacaaataagctctattttattcctctcaaatttctaatctcttcaatcttgctattagaagaaagaagtaaacattatttaaagaaggaaaccagttggctaccgagaccaatcctcacagggtgtaattaccttggtaaattcagcaaaatccagtttacattaattttacagattcagaaataaagtgttattacaaaggaagattcatttgtgaggaatatatttcttttaaccaattatacaaaatagaataaatgacttttaagatctacagaaagcaacattgccaatgaggagactagacacagagtacattccttttgtacagagaaaaaagaaaggaagaaaagaaggccaactaaattcagaatgacagcttactgatttaaaatgagaaattataatggctgttttctggttaaccatgggagagtaaccttacatttttatctactcccttgccctatggcagactttgaaggttacatcccttaacctccatttccaaacctatgtttccttgcattcttctgtaacagatgtttcacctcctctataatatgctcatttgcagttacagattgtaaaaacagtcttacttaatgagatatacagaaaaatttgataagggggattgtgggacaagcatcagtttctcaataaaaagatggataaatatgttatagccattctctcttcactttctccctcctatttaaactttttattacgaaaattttcagaccttcacaaaaatagactagtataatgaaacctttatattaatctatgaaacaatttcaataattatgccagatttgtatcatctatttcccttgcgacttctttccttttggaatattttaaagtaaatcacaggcatcataacatttcatccataatttcttcagtatggattcctaacagatgaagacttctatttttaattaacataaacatgatgccattatcatgtataacaaaataaacaatttattaaaattatctatgtgtaaaaatcctgattgtctcaaaaacatatttttatatttaactgtttccaaacaataatcacagaagatctatatatcacaattcgttgatacgcttttcaagtttttaatcaatgagagaatctctctcttcttcttttcttctactttttttttttttaaagaaactgggttatttaatctatagaatttaccatattctgtgcctcgctgattatttcttcatggtatcatttaatttgtttttgtatccactattcttggaatcagcaatttctccaaaatgagatgcaagcgtctcatgaaatctgctcagtgatttccaagaacggttttgctttctcaatatagaaacttttcaaccatacttttctttctagattatttaaacatcgaatccgagatacctacatctctgccagagggctctgtacctgagggaagtactggctgaaccaaggacataattttaaaattctgaaggaagtgatggtcaacctgaagttctatacctaatcaaactatcaaccaaacttgagggcagactaaagattatttcagatattaggcatttattaaaggatatgtacttcttaggcatttattaaaggatgagcattaccaaacaagggaccaataagacaaagaaaaggaagaatgagatctaagaaataaagaatccaatttacaacataaatcctaaaatgacagctatgggctatgtatattaggcaaacaatctgagaggttggagcagaagaatggatgataactaaaatatactggaaactgcttatttttttctcagcactatcctgctcttctaagctctatcttgaataatgagaactgaaaacttataaactatgtttcctacacttcttgccaggaggtttttcacttagagcccacaatgaaagaatttgtacaatatttagatggcagaagaaaatgagaagccttgttctccagggacaactgagggcagatgcagtggattccaggtgccaaagacaactgacataagtagctgtggttcacctgcaattcctgtactatcacatttcttgaaatccagcaatgatttcccattggttctgttagtctgtaattttaggcattaattcctttctttttaaactatgtaatgtagtttctattttccttacctaacctcaagtgattcaggaattctttaggtaaaaatatagaagtaatggatcatctgatgcttgaatgatgaccattatttatatactcactgtactataaatatcaacttctgattttatttagattgtggtatacctatatttggaagatagggatagggaaaaatgcgtgtgagaaatatgatgataaagaatgatacgttgtaatcccagcactttggcaggctgaggcaggtggatcacgaggtcaggagatcgagaccatcctggcaaacacagtggaaccctgtctctactaaaaatacaaaaaaaattagccaggcgtggtggtgggcgcctgtagtcttagctactcgggatgctgaggcaggagaatggcgtgaacccgggaggtggagcttgcagtgagccgagatcacgccactgcactccagcctgggggacagagcaagacttcatctcaaaaaaaaaaaaaaagtgatactttcttaatttccataaaagaaagtctatatacagtttaaaggtcttaagtttttttaaatagcagcataagcccaccccctctccctttttttattttaggcagtaaggttgtcttaggagagtgagtcaaggaacgaggtagaggattgattttaggtaataaagagcttttcagcatcatcgattttttaggtagataatatcttactttgttaaaaaggaatttttaaaaggggttagcaaagaaaaacaaaataagaaacagacaaagttttaaaacaaacataaaagatgcttgtgaaataactgggaaaatggctgcaaatacagttgcaaaataatgacctgagtcctctgtgacattactccttctatatatatttatatgagatgctaaattacaataaaatgtgtgcttgtttttcatttggtatgcatagaaccaaatgaaggaagttgagcaaaataatttaaatttgtaatatacttagctatgatagcctaaaacatttttctctacatgagatcatacatgtcaccaggacttatgggtttaaaagatttcctcttcctcagaaagaacatatattttcatacagcaaaatcattagcagtgactctgtttatggatcctagaatcgaccagtttcccaaataactggtttattcgcatatgcaggtctgtgtgtctatcaaaacaggttatagattaaatctaactcatctggaagccactctttacctttacggtgagtatgcatgttcctctcaaatccattttgtgaggatctattaattaaatttccaggtatccaagtattttgttaattaggagtggtaacaggagtggggatgtcactgggttcccatgtaaaacaaacaatattagcttatattaaaagcaataatctggccaggtgtggtggctcacatctgtaatcccatcactttgggaggccaaggcgggtggatcacgaggtcaggagttcaagatcagcctgaccaacatggtgaaactccatttctactaagaatacaaaaattagctaggcatggtggtgcgtgcctgtaattccagctacttgggaggctgaggcaggagaattgcttgaaccaggacccaggtagcggaggttgcagtgagccgagatcatgccactgcactccagcctgggctacagagcgagactccatctcaaaaaaaaaaagaaaaaaaaaataataaccagcttaagacaaagtagactgtaacaatcagtacactcttttctctactttttcttatggaaaattcgaaacatacaaataaagtagagagaatataataaattcccatgtagccatcacctagactcaataatttttttattctgttgatcttcttctatctatttcgcattatacttttctttctagagtatttaaaaactagtctcagatatcatgttatctcataatccttgcattccaaaatgtagactaagccatccttgactattttggcaggaattaatatttgaatagatatttaaatcttttgaaatttaatatgtgaatcaattgctctggcataagaagaaatacatattaggtgttgtcatatatactcttcatggttcatacaaattcagaaaaccatttaagaaaagaactgtccaacctcaggtgtgaaccataaagctctttcagggcatctattctctaagaagatacaaaagtgctaaggaagcagaaaagtatagagaaaaaaaaagtgatctaggaaaagaatcatcaagggagtatagaaaatctgaacttagagataaacactcagatactctggatgcctaaaaataagactatcatagtagacattgttagggctctcctcatatcccttggcaatttcaacaatctcctgtagacttccatctggcagtatctacacatccatgtgcctgagggagtactggttagacttggaataattttctgaagttggtgtataaataccacagctccctcaactctctcagttgggataattatgtgttatattttgcactgtttccaaaagttatcctgtaggattaaattcatctggcagctggcttataaggagcccatcattgtttcccctttccctgttccattttcccacctccctactagtgtcaccagctagtgtcaactacttgcactggaattcctgtttcagcatctcaacctggggaaacctgacacaattactaaacaagattcctttcttgttcttttagatgagcaaaaaaggaaaagaaagaccttgtattaggtactttacaaaaattaccttagtaaacccttataatgataatgtgaagtaagaattatacacatagggaagctcagaagttgtgtctgtgatctcaccactgggatctgaattcagaaataaagactaggaaaagcaccagcgacacgaattcagtaaacctgaatttccatatgccccaactcccaagccaattttacccagtgttatttcctcaaagcactgtagtatttgaaattatcttgtatatccatttgtttacttattgtctctctctcccacccactttagaatggaaggtacataagatcaaggacttttgtcctcattggcatatctccagagccatgggtacatttagacacaaattaatattttctaaatgaataattcagaatgattcttaaaatcaaaatattttggcttatattttgtaactcatctttcccagattttttgcaactcaatcccactttgctgattttccagaaacaccatgtttccttgccattccagtcacattcctccctccaggcctttccatttactgttccctctgcctagaatgttcttttcattagacagtcctcatggcttcttccctcacttcattcagatctcttttattgaagagacattattgctttcctttgtccttagtaattatcaccatatgacatacgtgtttatttccatgtctatccccactagactataagctcaacaagaggagaagattgtccacatttcttcactggtatattctcaacacttagaataaattttctagcatgtaacaggcactcaacaaattttgatgaatgagtggataggcacaatataaatttaaaatgtcatgatatcaacaacctccataaaattattttggttttctgaaataatcttcaaaagtaccaatacaaaatatgaaactgaaaagacccagttaaagttaagtggcactccatgcttaactgtaactgatgtccaaacagttggattctcctaattaaaataagacacaggacatggaatcaaaagacactttccagatctcaaatgtaagaaatcccagctactgtgctagacctctaccatgcgtatcatttaaatataaatgaaaacttcacacacatttgattaaatgtcctcttgttagttttagctcagttttgcagctgcaactgttaattttcaacagtttagtgaaaactgaagaataaagcccacttttcaaatggcatgttcttacagatcgtatagaggactgtcattctcatctcccaattggagcttgattgattactccttttccttatgttcattaatctcgtcaccttatcttttataccacttcattttagcagaaaggtaataataaaaccctcatccattatccttgtactcatctagtcaagcggaaatggttaataacatgctacaaattgaacttcaatcacttcattttctcctttgttgaatacacattaaaatatattccaaaagtgcaatctgttttacaggagaatttgtgttatattgctacagacaactaaaattaagtgtttctcagtttggttattaaatatatccaagtgctcttttaccaataatactaaaacattaactcattttattagggtataataatacaagagccttatctcttagaacacaaagacatctagactacctaatagtatgtgttatatgatagggtcatttatctttaaaaaaaaataccagtgataatttatgaattggtatattattacaaatgaaattgctatttttaaaagttaatttgtttacatgcaaccttatcttgaaatgcaagccctattagtgaaaaagtctataactgtcatataaaacagaaagagaagaatgggcatatacataaaatagactcaatgatttaagattttaaaagtataatcactgaaagaaattaaatttaatatgtaattagactagagttttcaaaagaaaaaagaaaaaatgacttctgaaattacaaaagatttttatgtacatcacaacaattgttgaactgatttctaatagtcttaaaaatactgagaggaaaaaaactatccttttgggaaaaaagaattttctactaatgtgggtaagtgtcttctatctatttataaatggacatgctcaccaactaactaaaaactagacctacagcaaatgttgaaaaacttaaccagataatcaaggcttattgtctattatctttctaccatcctgaaaaaaatgttcttctgaatctagataacaatgttagcaactgacaatatcaatatttgagcacccgaactctactacttaataaacccatctttttttgtttgtttgttttttaatttttttgagacagggtctcagtcacccaggctgcagggcagtggcaagatcactgctcatcacagcctcaacttcctgggctcaagcaatcctcccatcttagcctctcaggtaactagtcacatgtcaccacatctggctaattttttaattttttttaagagacagggtttcaccatattgcccaggctgttctctaactcctgagctcaagcaatctgtctccttgggctcccaaaggctgggattacagatgtgagccatcatgcccagccaaaacccatttttttttaattattgggaaagatacatatatatatctatttgcttacactgctgctgttgttgtttgaagggcatgtgtgtcagctatcaatttatcacctcttagttccatatttacccttcattatctgctctgaagtaatgaacctggatactttaagtatttctcctttgtagtagcatgacgttgttgagctttttcaacagacagccctggagggacgctgcaggatgaaagcagcttctttccccccattccagtgtgctcaactcatcgggcttccttccactcagacattagctaatgagtattaatactgagtgcctgaaatgatattttggcaagtttgcctgacctaagagtcatagagatcacagtggctgataagtcaatctccattccaccaccttctgttttatggcagaatgtgccataaaacaaccctacggccatcccatttggctcagtcatgaagatgctggattctatgatccacagacccacatcaagtatctctaccccagtccttgtcttttcctgttgttcaggatgaataccatatgtatttgccctgcctttctcagaagcaacaaaggatgaatgattaaaatgctgcttttaaaaagtgcattcctttttatccattaaattgtttcactataaaatatacacatagataatatataataattacaatgttatattttataagatcatttagtcaaggccttggtttttccagaatatagaacagtagtataccaaatgtatacattattgttcacatttaagactttttagttgtatacatatgtaactaacctgcacattgtgcacatgtaccctaaaacttgaagtataataataataataataataataataataataataattttttttaaaaaaacactttttagtacatcatccagtattcctaatatacaaagctaccctcctttttgcatgatttacacgttttgctttagtggaaagtttttaagatacttgtcatgttaggcatgaattacctgtcatagttacattatgttctccacaaataatccttcttttctgtaaactgtacaaaacaaaacaatattacaaaaacaatagcctaaacgtttttagatacttttttcctacaaaaagctgtaagaacatgctactaagtttatattacatatattacatagttccttttaaggagacaggaagaattaacatttaatattatttagcatgtgaaaattggaaaggaatcaatcaataagcctatgtatgcaacaatttttgtttcaccctctaaacattcttaaactatatcagatgccattgtctataaaaaatgaatttatcaatttaatgaggatttaggcagattagttgcttaatgagaactccagctaatgtgacagaggttttgtttcagtgctgacaaaatcagtgtgataaaactgtgattaaactgatgagagtacatttctttttaaaatcattatttcacataattaatgttaaacagcaatatataatcatttaaaaatattgtttataccttttatattttaatgtttttatatttagacataatagtttcaatattttacaatcctgagccttctcctcttacctttatctattgtgtattattttgttttgttttttagagatagtgtctttctctgctgcccaggctagaggggagtggtgcaagccttgctcactgaagcctcgaactctggggctcaagtgatactcccacctcagactcctaagtagccagaactacaggcccatgccactatgcttggctaatttttttctttattttttgtaaagatggggtctcactatgttgcctaggctggtccctaattcctggactcaagtggttctcccactttggcctcccaaagcactgggattacaggcacaagccatggcagtcaacctactattctgtttaattgtttcactcatttttcttgattttctctccttctttgttctctttctatatttacacaaatacataatatcaccatttaaataaatgcaaattacaattcacgcaagaacagtaattcccaatatattggctaaaagaaaactctattatcaaaagctttctccttagctgggtaatgctttggttcatagattagagaactatctaccttaaaacaaagactttttaaaattgaagatagaaaacatctgtaaacattctacattttcctatgttgtttcctaaataacctaaaaggtcaataagaaagagatattttgtactataaaatactttcgttcttaagacaagggtgctgtggcccatacatttgctagtattcctcttactgactctcagaggtggtgtagttaagaacagaacttcgacatgactaatgggggtcagcagatattacgtgtctcctcatatgttccaatatgaggcatacatcatcaactatagttcacctaaaaatatttaccttaatataaccaagcctttacatttaacttccagcttaaaggattacaaagtatcttttacaatataaataactactataagcaagtaaatagataagtgcagaggtaggacactctacagaacaaatgcactggtctcctcaacaagccagtgttatgagtaaagaattgctctgaaatgaaaaaaagacttaacagacagaacaaccagatacaatgaggattcccagattaaattccactttgggcaaaaaagttacaagggatatttttggagaaagaggacacatttaaatattgattaggtatgagataatattaaggactattattaataatttcattagataatattgttactttggtctttgtaggaaaacatattgttttaaagacatagaaaagtatttaggaatggactgttgggtaccaatttattttaaaacccttcagcatttcacttgtggtagtgactgaatttcaattgcggtcgattttggggcacaaaggtggcttctggtgctggtaacattctgtttcctattctagttgctggttttatcattctgtccactctgcaaaaagttagtgtgttgtacaattatgtgcagttttcagtatatgatgtatttccatgaacagtataaaacaaactaatcagcgttaaaaaatgtttacatgaattaattttaaaatgcaacagctctggattaaattgtttggttttcaattttggctctaagcctaatcaagaacacaatcccatttataatagacacacacacacataaacaaatgaggtgaaaggtctccacaaagagaacaacataacattgtgaaaagaaatcagagatcacacaaacaaatggaacaacattccgttctcatgaattggaggaattaatatcattaaaatggccatactacccaaagcaatttacacattcaacactatttctctcaaactaccaatgtcatttttcacagaattagaaataactattctaaaatcatatggaagcaaaaaagaggctgaatagccaaaacaatcctaagcaaaaagaacaaagctggaggtttcacattacctgacttcaaactatactataagactacaataaccaaaacagcatgatactggtacaaaaacagacacatagaccaatggaacagaatagacaattcagaaataaagctgcacacctacaacaaaagttttaaaaagttgacaaagataagcaatggcgaaaggactgcctatttaataaatagtgccggtataactgggtatccatacacaaaaaatgaaactggaccactgcctttcaaaatatacaaaaattaactcaagatagatgaaagatttcaaggtaagacctcaagctataaaaatcctaaaagaaaacctaggaagtaccattctggacattggccttggcaaagaacttacaaccaagtcctcaaaagcaattgcaacagcaatgtcaacaaaaaatgacaattgagatctaattaaaataaagagcttctgcacaccaaaagaaactatcaaccaagtaaacagacaacccatggaatgggagaaaatatttgcgaactatgcatctgacaaaggcctaatatccagaatctataggaaacttcattcaacaagcaaaacccaaagaaccccattaaaaagtgaacaaaggaccgggcacagtggcttacacctgtaatcccagcactttgggaggctaaggcaggtggatcacttgaggtcagcagttgctcaggaccagcctgaacaacatggtgagaccaccatctctactaaaaatacaaaaattagccaggcatggtggtgcacgcccgtagtcccagctatttgggaggctgaggcatgaaaattgcttgaacccaggagggggaggttgcagtgagccaagatcacaccactgcactgcagcctgggtgacagagcgagactctgtctcaaaaaaaaaagcgaacaaaagacattgaacagaagcttctcaaatgtgtccaatgtgcaaccaacaaatatattaaaaagtgctcaacatcactaatcatcagagaaattcaattcaaaaccacaatgagataccatctcacactagtcagaatggctattattaaaaaggcaaacaaataacaggtgctggtgaggctgcagacaaaagagaacttttatacactgttggtggaaatgtaaattcgttcagccactgtggaaagcagtttggagatttctcaaagaactgaaaacagaactaccatttgacccagcaatcccattgctggatatatactctaaagaaaataaatcattctaccaaaaagacacatgcactggtatgtttattgcagtactattcacaatagcaaagacaaggaatcaacctagatgcccagcaacagtggggttgataaaggaaatatggtacatatagatcatggaaaactgcacagccataacaaagaataaaatcatgtcctttgcagcaacgtgcatgcagctggaagccatcatcctgagtgaattaatgcaggaacagaaaaccaaataccacatgttctcattcataaatgggagttaaacactgggtacatatggacatacagatgggaacaagagagattagagactactaaaggggggagatggggaggggtaaaaggggtgaaaaactatctactggccaggcgcacacctgtaatccaatcccaacactttgggaggctgaggcagaatgattgcttgagcccaggctcagtgagccaagatcatgtcactgcactctagccggattacagagtgaggccctgtctcaaaaaaaaaaaaaaaacaaaaaactacctattgggtattatgctcactacctaggtgacaggatcattcctaccccaaacctcagtgttattcaatattcccatgtaacaaacctgcacatgtagcctctgaatctaaaagttaagggttttaaaaacctttaactttttttttttgttagacagagtctcattcttgtcacccaggctggagtgcagtggcatgatctcagttcactgcaacctctgcctcctgggttcaagcaattctcctgcttcaggctcccgagtagctgggactatgggcacgcaccaccatgcccggctaatttttgtatttttagtaaagatggggtttcatcatgttgttcaggatggtctcaatctcttgacgtcgtgatccgcccgctgcggcctcccaaagtgctgggattacaggcataagccacagtgcccagcagtttgtttaaattgaggctgtaccatgaactgggtaagttattaacagccctgcacctcaatttcttcatctgaaaaatgttagccataaaaaattttttaccccaatttctaaactaggctattctaaggtattttcttctttcacttgccattttttgtgtgtttatattactttccttattcagtccaaaatagatttccaatgccctatctctaaaagttggaaacattctgaaataaatctaaacaagagttttcaattgaaattaataccagtagtcttataaagtcgaaaggagattcacagtatcaacatagtcttaagcgcatcttaaacaatatatctgctctgaatagttacctggaagtggcagtgattgtatggcctcactagaatccaacgtaacatataccagaatattatacattaattgacctgaacactactcagtgtgctaagtgatctggagaacagtaactgagatacatatacatctagaagttcacaaagggaagtagaaaaggtgttgccgagaagactattcaagattactttgtcagtactgaaactgtatattttatcagaaataaaattctaggaatatcttttagagtatcagttcgttaaacatcagtaaaggaataaaaacatttatgtactcacaaatatcgtattaatatttgaaagttttttaatgtttagtattttattttttaatttttatgtatttatgtcatttgaagtatactgaatagcttttaaattaaatcatagctaacttactttccgttatatgtcttgctacttaataaagaatatcacaaaatacctaggttttacggacattttaataatataaactgaccattatttttgcattctcgaaaacagaccataatactcttaggtagtatgctgaacatttgggatgggtttttatgggtgttgttgttgttgttgggagacggagtctcactctgtcacccaggctgaagtgcagtggcgcgatctcggctcactgcagcctcctaggttcaagcgattcaagtagctggctacagatgtgcgtcaccacacccggctaatttttgtatttttagcagagacggggtttcaccatgttggccaggctggtcttgaactcctgacctcatgtgatccgcctgcctcagcctctcaaagtgctgggtatacaggcatgagccaccagcgcccagccaacattttgaaaaacaataaaaatgaagattttaaggcatgctattgttttacaaaatagcctggcttaattttgtagttgtaaagtaactcaacaaaaagcaattgtaagaatgtttataatacattccttaataacaatagcaacttatactttcttaaaagtgtttttcctttataactttcaaaatgttactattacacaactcagtgatatacatgtgtcatataagttggtgcaattatctagcagaaatacagccacagaagctaagaagggccctgtgtcagcaaaatcaactttaaagaacatcttgcttagaaactagagagcataaactcaaaatttaaagctatttttgttgctgtaaatttttaaccatatagatgcaccattaaacagcaaaacttttctgattttcaggatgaattttataatgctaatatagagcagcggaaatcataaccattactgtcctcaaaaaatggtggctttatcagttctaggaaaatttacatatgagtaacagaaaacctaactaaaaaatgttgtaggcagcttagattcctttcttctcaaataacaaaggtaaacgaaagttagccagttactggatttagtcagttcaatggctcaaatagtataaaggctcggggttctattattttcttggcttgttccacgtattatgtttaagttccagggaggaagaagggaaaggagaaggataaagaccaaagagcatgactgagctgagtcagctccacctataaaaaggtttcccagaactccaacccagcttctacttatctcttgctggcaaaaaatatacctaatgatcagtcctagcttcaaggaaagctggaaaaactgggacaggagaaggaggttaagctggaacattggttcctttcaaaattcacagtcctatcagttttcttaaaatatatttctgaaactactgccatccaaactacttcatatataacagttcttaagaacatgccaaatatagacatttctcctctttgaaaaaacacctaaggaaggaaaatattaaaaaatagaataaatgattttttaaaaggtatcaatttcagaagtttaaatacatttttatagtgtctagtaccgttttatgctattttaatgattcaactatatactatctacagaagactcactttataattcatttatttttagagacagggtcttgctctgtcattcaggctggagtgcagtggatgcttccttgaacctcatagctcgctgcagccttgaactcctgggctcaagtgatcatcctgcctcaggcagcaataggtgcacactatcacacctggctaatttaaaaaaaatttttttttgtagaggcagtgtctcggtatgttgcccaacctggtcttgagctggtctcaagcaatccacctgcctcgggagactccatttagatttaaagacagaaataccttgaaagtaaataaatggaaaaatacttacaatatttactgcatatattgcatactaatatgtaaaattaagcaataaagcatatgttatgtctgaatcatgcattgcattttagaatagtattttaaaatttatagtacttattaaccagctttttacttttgaaatcaatctcaaacaaaaatgggttcattgcctcacaagtgtctctaaaccttgctcctcccctatcctctggtttcctgcaggcaggcagtataaccaatgggtaagagcatgaattctggaattggactacctgggttcaaaactagctctagcaatgctgggcaaactaattaatttctcttagctcattcagctataaaacagaaataataattgtaagaattaaatgagttaatgtatataaaacttacagcatatcacacattaaaagtgtcatttcttgttattgttatgaccttttccttcatttgtgatacatgtattaagcacttaccatataccagacattgtgctaaatattagaaatttgggtatttgggttatgaccaaatcagacataaactctgtcttgcacatatcaaaaatattaaacatgattttaccacctttttattactataaaaagtgaatactgaatttgttttctgcagctaacgagaagaaatcaataaaggaaagttaatataaacacaaagcaatgaaaatatttataaggcattgatgatgctagccagttcctgcttcctgtaacacctagctatgaatgttcttaaaagacaaatccagaatcgaaaaacaaactcaatgatttaaaatcacccaatcttcagaatttctattccatataattatgaatctgataatgacacatccataatcatacaaaaaaattttaaggtttcatagcaaacttcaagaaaattttagatagtctggtggtactaaaaaattagaccaaaataattttataatgaggcttaacattaaaatacaaaaatgcaaataaattgccatctttattaccaaaaacataagtgtcccaaaattcaccagtcccccacaaaaaactagaacacatatttattaactcaaggggctttgctaattatgtaaatgtctatcttttctacatgtaatttcattcaaacttcctctctttcccccaattaacgatcctgccaaatgttgggacttgaaaaggccacagctttatacacaattaacagtcaaattctaacacaaattacatgtcattcttatctctgtatacacattgaactcctatatcttgttgccaagagggagcttgcactagggaatacatcctgaatttgtttaatgtccaggaataacatttcacacttagaaaggagatactatccactgccagctatgtgaactgaaatttgccatgtcctatccttttcattttgttcaaataggtagtttagaaaatgagtaactatccacttatctgttttaaccaaatattttcttgacgcagaagaggcaatcatgatctttggttttctttagacactttttaggatgattacagaaacttttatgaatggtaaacttattttctgaatagaaattggggaactatcatttgacacataatctcactaccagaaaaaatatttgcaattggatcaatcccagaaaattagatttacatatatggtcattatatttatgattgcttcccgagaaaaggtttcaacagcagcaacactagaaataaccaatttcttattcagtaagtatatgagacaatcatcacatcaaaatagtcagacatgtcccaatcttttgaagtatagcattttattaccaaagtacctcaacaaataccagtcatttacatactaaaagggcaactaaaatatattttatatatattaatatgtacatgttatgacctaaagttatgaaagcttgtaaaacacagcacttttagaatacaaacatccccaaattaaacttttaaagaaacaaatctgattgggtttagttactagcttactgctcttcagtagtctccactgtccttagaatagtatcaactggcatttgtctacctgtccagctttgcctcctacaatctgcttactaaaccctcagctccaaacataattcttcctttctttttttttttttctttcaagacagagtctcaatctgttgcccagactggagtgcagtggtacgatctcggctcactgcaacctcctcctcctgggttccagtgattctcatgcctcagtctcctgagtagctgagattacaggtgcatgccaccatgcccagctaatttttgtatttttagtagtgacggagttttgccatgttggccaggctggtctcaaacccctgacctccagtgatacacccaccttggcctcccataccataattctttctattcctccatctcaacaaactatctctttaaactgacatttaccctaagcctggaatacaataaccgctcatctttcagttcacacttcaaatgtcgtttcctcaatgaagccttcctttaattcccttctcctatccctgacccccaaatagattcagtgcccagatatacatttccatgctactccacacttccttgccacagcaatttctacagtatattgaagcttgttgttcaccccctgttggcatgtaagctctgtaacattaagaaaaaccatgtttgtcttgctcactattgaattcccaaggtctaaacatatgggcctgaccctcacaccctcatttgatttctaaaattgggcttacatatatcaaattaaggcagggctcatatgcattgcaacattcagttaaaatactctcttccatcgttataaattccttcatatgaatataaaatgttctgataaccaaaacaaacaagaaaaagtgaaaaaattgcaatttgtttctacactgccttcagtttcatgtggtgaatctggagtcagaaccctagatttgacttcagattgtatcgcctgttacctatatgatgatgtgaagtgcttaacatcacaaagcctcatattcctcttctgtaaaatagaaaatattaatgcttgtcccacaaaccttaaagagctgggatctattaataaaattatgctcatgaaagcctttaaaaacgatgaagcatttcataataaaatgaattaacatctttgttattaataccataatcaaggtaatctcagttaaaaataatgcatacaaattatttcagaaaaactttggcatatatatgagctagaatgtactagttaaaataaatacaaaagtttaacctcaaaagaagattacaaatcaattgtaaaatacattccaatattctaagatattgttgctacaatctcagaaaattttactcctgaaatttcatatccttcgtgatatctgaaacctatcagttaaattcattattaattcttttattttacttattgcactttagaatcccatccagggaatctgttattattctgagaccacaatcataattctttttaaaataaaaatgtgaacattaagcttaaaaaaaataattcgcaacttaactctgtggtaaacaggtgaacaaaacaacaattatataatatctaaaaccattttatgctttaaaaataggtttatatgtactgaatactggctaagataggaaatatttgatttcaaatttgttaagaatttaaagacataaaaagttagattagaagttatcttaaaacaacaataaggtagtcattaaaaacatgatcaaacaagaaaacaatttcttttaactcatgctaggaaagttattcaatattctattacttattagagtaaaaataatcttggtctttgatttttgagtgttaaaaaaccaaacttttccaaaattcaacttctgatgcaacagctaattcagaaaagaaaaagtttttttttttctttttcctatccatttgggctacatgattctaaaattacaggtatagtcacaaagagcatatgcttcccccaaagctctgaaggcatgtaagaaactactgtagttaaagcttgaacaagcaagtcttttttaatccacatttttcatatagaagaaagatttgtgtattttgcaaaagtaatgctattgcgatattacgactttgaactaaagctctaaaatcatactattcaactaaaggtttctttagcaatattaacatggccacgctgcacatgttacttttagcttctttgtgtacaacaaactgcattcaattggtgaacaaatacaatgtttagtatcatatttaaaaccactattcaaaccttttcttaatgctgttatcagttttccttttgcaacaattttgtgtataaaaataaaagcactggatttttattagcgctgccccttctttgttttgctccactctgcaaagcccttttgggacactaagcctgcatttaccataatacggattaaactttctttgtcccattgcacaaggtttgttagcaggttagtctttttacacttttcacaggctgcctgcagcttaccctttaggcctcactcaaaatacttctgtggatttacaaaaataccagagtggtcttggggttaattggaagataagtgcagtctttaacatagagactcattaaacatttagccttaccacaatccactatccttgaaagagaaaagttctagagacactttaggaataataacacagtaaaattgttttaaaaaatgacgattagttgtttcacagacttggaaaaacttcatttaactaccccaaaggtgatatagtagaacaaagcaatgtccctggtcagctctctacattggttttaatatgcattgatcatagaggaaaattgaacagattttctaaggaactaaaaggcaaaatcttccaaccttctgttgggaaatttaaagtaaaaactcaactgatgggttatgacagataatatttatttgtaaacaaaacatatttaattctaacagtttaactttgttgatttaaattttacccaagtaaatcacatcaaacatgtctattagagccaaatgaaaaatttataaaattcacccaaaaaacttagaaagtatttaaaaatttaagttccttctttaatttctaaaatacatacatatacacaaatatacacacttaaaatgaaatctgaaacctactcattggtattaggttattttttagaattatgcaagcagattgttaaacagattaacttttccatccccttacctccttccaacactattactcccacacaaaaaggaaaaaagaaaaagaaaaatgcgacaaaacacacagacacttgaagtaaaggattagacatatttgcccaagatgcagataacaaaagcaaaagtgaagaaaattgaagagacagccaaacttcagcaacaaaatggttaaagaatctgaagtattgttcccgttattcttaaagtctgctatattgtagacagcgcaaacatcagacaagttaagattactgaccattatctccttaattttctccgctttccctcacattccctcttgctatctgggcaccatttttctaaagctttatttctggtaagaagtaaactttccctaatccatctattatggaacctttaattggattgggagcagggtggtgtataaaatagcccctattcactcaaaaggactgtagttttagagacttaaaggagaaaggtattgtgaaacaaaatcctcagggaatcaaggattaaaatgtggctctcctaaattcatcaactccaggacacaaatgaattgcttccttaaacaggtaactttccaaatacatggcatagcaaaactgaaattaaaattataattttactttaaggaaaataatgcatttacactaataatttttcgctttataaatgacttttacttgctgtttcttcaactcagaattacaatgccagggaacaaatggaatgccttaaacatatttatttatattttctctacatacatattttccctgtaaagtaaggagaaaagcaaaagaatatgctttaatcaattaagtcctgtacgttatatttgtgcagccttaaagcagcaagcactgccataatacaaacatttttttcaaagtaaaaatacatttcgttcttatcagatagtgtcagatacataataatcagcagtcactcttcttccctcaatcagttatcctctctgttttcttcataaacatccccaaaccactctttgttaggctgtagtacttttgtcttctgtcccgccacagtgcacacccaactatttgggatgtcttcaacagtaagatgaggatacagctcatactcagttattctcttactgaattaaatatatttaaagtgccaaacctgctatctaaagtaaaatgaaatccagaatgtatctaccaactctaaattaatctcgcaaatgtctacatactctaccaaaacaataggaaactgaggaagagaaatgttaggagagttcaagattctaatgtaacacttaactctgcatagtttactagtctatattaaaatataaaaatacatcaatattagttatttacctaatggtgctgttaaaaacagatttaaaaaaaaatttaagaaatgcaattaattttaagaaaaccctcaaagtatcccctctgttttggaacctgtatcacaactcaataagtgctacttattattgattgaacccttactaattgtctgacattgtgctaactgctattacatgaattatctcattttattctctcaacaattgtatgaggtagttgctattacctgtttttccacaaatgaggaagctaagtttttaaaatttcaattaaattgtccaaggttacatagctgcaaagaaaataagctctgtgaaagcttttcattactatattataaatgtttagtataagaaagcaggctcatttgccaaagtcaatctgccaaaaaataaatgtgcctaaattatcaaaatcacctatgttccaaccgtaaatatttaaagaatattcttcttgaatgtattaaatctataactatattcttctaatgaatatattctaagatatatttaatactttttaagcaacattttaagaaccactgtttttcaaaactaaagtcatcatagggtagctctgtcctattaccaatataactaaaattttaatgtttcatatgacattttttagttcgtactgatttctatttgtatattttttctatttttctaacattctgtcatgtagaataattgttgctttattttattttattttattttatttttttatttttttttagatggagtctcgctctgttgcctatgctgcagtgcagtggcactatctcggctcactgcaagctccgcctcccgggttcacaccattctcctgcctcagcctcccgagtagctgggactacaggtgcccgtcaccacgcccggctaattttttgtatttttagtagagacagggtttcaccgtgttagccaggatggtctcgaactcctgacctcatgatctgcccgcctcggcctcccaaaatgctgggattacaggcatgagccactgcacccagcctcatttgtcacttttacctatttataaagtattatatcagttgagaattattttaatacttttcaaagtgtatgaagtcttatttgaacagttttcatcttgttttcataacaaccttggagggaacctccatttgtctgtcccaaatcactacagttgaagctgaagaaagcttttttagaggaaagatggaaaagaaagcaaatattccagggagagattctgattcctgaaagtattaggaatgagtatcagggttgagtactaaatggcactatcagagaaagaagatgagggaactacgaatcctggccataggtttcatagtctcttaggccacacctcttaggctcttttaacccatacaacacatagtgtgtaaataaaaaaatacaaactagtttagggtaattttaatatagcagagaattcattttctgtaaatttagctcattagttttagcaaattcctagcacaatggcatgcatatttagtagggcattaaaaatatgtgtggaatggatatattaaaattttatgtaaagtaaaactttaaacactgtattttgatttcaaaaataatctttaattggtcagttaaagtattttaaataaatatatttttaaagataacatgaacatgcatgctccactttaggggtagctaaaacaacaccccaaaacaacctcatactaaaggattattgaattttacatttaaaaaagagcaactatagggaaagaaccaaaaatggatctaggaaaattacaaaatacagcaagtatcttaaaaatgatttaattattaaagcatatttagaatacaaatgagtatttactattttgagagcccattaaaattaagatacccaactattctttttctctgatgccattttactaatagctaagtgtgtatataaatatctcagtcactggtatgtaaatgtcataataaagtgtaatgtatttcatcacattctatctgcacttatgcttccttatgacttcagctaagtttctacacacagtggtttagttttaaatggttgtccccaaaatatgatgagttagaaattatcttgcatttgtgtgctcattcataataaatcactgtttttaggcctcaaataacatcaggtctctatttgctgcttagtaagaggcaactaacatttcacggaaaatagttctttaactaaaagattatatcagggcttcctcatataagattactcaaattttgtataacattggatctctgttgtgttataaaatatttggtacaaaacaaactgctatggtttgaccatatcccccaaagttcatgtgttggaaactgaatccccattttaacagtgttgagaggtggggcctttgggagtgactgggttatgagggctctgccttcataaatggattaatgtgattattgctagggagtgttaattatcacaagagtgagttcctcataaaagaatggagcttagacccctcttgctctctctgtctcacatgctcacttggtcttctgccctgggatgactctcaccaggtactggcaccatgctcttagatttcctgcctccaaaagcatgagccaaataaattctattctttataaattactagtctctggtattctgtaatagcagcagagaatggattaaaaaactaatgaaatgaatatgtaaattagcatataaatatatcaacttgtgtatggataaacatattcaacgacagctacataaaaaagactaaaaagcaggagtggtggctcacacctgtaatcttagcattttgggaggctgaggtaggtagatcacttgagcccaagagtctgagaccagcctgggcaacatagtgaaatcctgtctctacaaaaaacacaaaaattagccaggagtggtggaacatgcctgtagtcccagctactcaggggaggatcactaaaaccagagaggtcaaggctgcagtaagccatgatcatgtcactgcactccagcctgggtgacagagcaagaccctgtctcaaaaaataaaaaaaaaagcaaaaagcttaggaatacaccctgattgaaatatatgatactcataagttatacatgagagagccattttaaaccactaatgaaaatgactgttaagtcccatagaaaagtctattaaaatatatgtatgtgtatatatattttttacacacacacggatatacatataatttcttacatcatacttaccctttagaatagcagtcctcaatcattttggcaccagaaactgatttcgtggaagacaatttttccacagaccaaagtggggtggggggtaggaggtatgattttaggatgaaactcttccgactcagatcgtctgacattagagtctcataaggagcacgcaacctagttccctcatatgcacagtacacaataaggttcgcacccctatgaaaatctaatgccacagctgatctgacaggaggcagagctcaggtggtaatactccctcacctggcactcctctcctgctatgtggcccagttcctgacagggaaactgggtagggaacccctgccttagaagacagaatacaaaaatacagtttatgccaagatccaaaaaatagtcaagtcagaaagttaagaatattatacttttcataccaataaccatatcctgtacaattctcctgtacaggagtgtatcttgtacaatttctcaaaagaagacatttatgcagccaaaagacacatgaaaaaatgctcaccatcactggccatcagggaaatgcaaatcaaaaccacaatgagataccatctcacaccagttagaatggcaatcattaaaaagtcaggaaacaacaggtgttggagaggatgtggagaaacaggaacacttttacactgttggtgggagtgtgaactagttcaaccactgtggaagacagggtggtgattcctcaaggatctagaactagaaataccatttgacccagccatcccattactgggtatataaccaaaggattataaatcatgctgatataaagacacatgcacacgtatgtttactgcggcactactcacaatagtaaagacttggaaccaacccaaatgtccatcaatgatagactggattaaaaaaatgtggcagctgggcatggtggctcaagcctgtaatcccagcactttgggaggctgaggcgggcagatcacgaggtcaggagatcgagaccatcctggatagcacggtgaaaccccgtctctactaaaaatacaaaaaaatagcctggcatggtggcaggcgcctgtagtctcagctacttgggaggctgaggcaggagaatggcatgaacccgggaaacggagcttgcagtgagccgagatcatgccactgcactccagcctgggcgacagagcgaggctctgtctcaaaaaaaaaaagaaaaaaagaaaaaaaagaaaatgtggcacatatacactatggaatattatgcagtcataaaaaaggatgagttcatgtcatttgtagggacatggatgaagctggaaaccatcattctcagcaaactatcgcaaggacagaaaaccaaacactgcatgttctcactcataggtgggaattgaacaatgagaacacttggacacagggaggggaacatcacacaccagggcctgtcgtggggtggggggaagggagagggatagcattaggagatatacctaatgtaaatgacgagttactgggtgcagcacaccaacatggcacatgtgtacatatgtaacaaacctgcatgttgtgcacatgtaccctagaacttaaagtacaaaaagaaaaaaaaaataacactccctcacctggcactcctctcctgctgtgcagcccagttcctaacagggaaactgggttgggaacccttgccttagaagacagaatacaaaaatacaatttatgccaagatccaaaaaattgtcaagtcagaaagttaagaatatcatacttttcataccaataaccatatcctgtacaattacacacagacagatggggggtagaaggagtcaaatcccacttctgacaccagattgtgtcaacctaaaaatagacactagagaaatttgtctccaaatatgttgagtttgtttgggaatgacaaatgaggattatgacatagaatggcaagccaccggtgcatctggtgagagaagggtaaagggaagcttttattagcccaaagagattcaagtaaactacttagaaacagagttcactggttccagaggcttaaagtcagagttatcatcagttcattggtgaagctgctattactggtcaagggttcatttaagagcatcttctctgaattgctatagttctaaaggatgtctagtgataaaccttgccaaaactagtgagaaaccttgctaaagcaggagatacatgcaggacatgaaggagtttcttgtgggatttctagaaagtccttggaaatcattcttatctcagatatataagcaagagcctcctctcctttctgccttcctgtaccaattttgccagggtctgacaaaattgatttcatccccatatctgtaactttcacaggggaaagaggggtaagatagttaaattaaacagagtccctcaaaaatcacccttcctttcttccccttaatttcaaagagccaatttactttacatgttggatactgcgctggagcaagaaggtaaaaccaggaagtaggatcagagagacaagagttactaagccaggacagaaatcagaaaccaaaatgtaataatctgctagagaattaggccataaggaatatctgttattttgcttattatctgtaagaagaaataaaattatagcacagtgatgaaagcacagtgaagagaaaccctaaaatgtttttagtaaaagaatgataaatgaaaattgacaataaagaatcaatcacaactaaagtatagaaagatgctaatatttctttattttacaagcttcatcaatatatattagtaaatataataataatcaaaagggcttttatagactcctttctgacctcatttctgcttactttttccaaaataatcttaaattcttcaacaaaacattctattaccaaggaggcttttcaggaatgttatctttagtataaggtattactaatccttcttaatgatgttctatgccacttataaaaaactcattaggatggcaaacaaaacagccttttgttacattaaactcagtgtttaaggaaaatagttacatattcattcattcaaaaaataagtattttttggaaagcctagagatacagaaatcaacaacaaaaagctgggggaaggaaggatacgatagttgtaagggttagataactactataaatctgtttcaatatgtacctttagcagtaatatttatagaaaataagattcaaaggcccttaaaatatctagggttactctttaaacaaggggaggaaggaatctgaaaacaggtgactccaatatcaattctttccatcaactctaggtcttgtggtgaacacttcagttgtttaattgtataaagaaatgctatcacccacacacatataatactacaatgctactacctatcctcaaattgtatattctactatttacttaaaacacagtagaccttaagactattctgttcaacccataacaattcaaatctacaatcaagttttagtaaagacagcatacttgcagctaatctatattcataaacgacactactatgctagctcatcaagtataaagaattaaaaacaattatatcttacaatacaaacagaattggctgggtgcacgcctgtaatcccagcactttgggaggccaaggtgggcggatcacaaggtcaagagatcgagaccatcctggccaacatggtgaaacgccatctctactaaaaatacaaaaaaattagctgggcatggtggcgcacgcctgtagtctcagctacttgggaggctaaggcaggagaatcacttgaacccagcaggcagagcttgcagtgagccaagatcgcaccactgcactccagcctgggtaacagagtgagactctgtcttataaaaacacacacacacacacacacacacacacacaaacaaatagaatctaaaaatattctctttttttgagacagggtcttcctttgtcacccaggctggtgtgcagtggtgcaatcgcggctcactgcagccttaatctcctgggtccagccaatcctcccaagtcagtagcccaagtagctacacagcaggagcacaccactatgcctggttaattctgttcattttttatagagatgagatactgttatgttgtctgggatggtcactaattcttgggttcaagagatcctcatgcctcaatctcccaaagtgctgggactacaggtatgagccactgtgctcagcctagaatctaaaaatattctagcaaaatatataaaaaataaataaaataaaaattttatgggacctgaaaaatgaatatggagaagccaaataaacatgctctccaatagcttttaatacagttaacacttatttttatacatttgttctaaatattcaaaaaactaaatttaaaaactatctgatggatggtaatcaaaaacatttttgtttgaaaacaaatcatattttaaacagcaactatgtttgaagtttaatatattcaaacatttgattatatggttaatgtctaaagctctacgaggaaccaaatcagagctattcttacttattgctgtaatctcagcatcctacatagttggcatactggcagataatcaaaagtgtttgtgaaatgaataattatatacatagttacacagaatgtgaataccttattagcctatttacttatttattttagtgccataactccaatctctttacttaaaagctcattgattgcttctgcattaaatgtgaaccttctaacattacaattttccctatgaaataagcataatattacttataaattatacaaatactgtgaaaatgcagattgacatattatatagtttggattttgaaaagacatctttatgcatgcacaaatgcaatttgtcattaaatttacaaatgttgtggtgtataaattggatacttcttcctaaatgtcttgcaatgttttaatatcaatgtgacagcaaaatctgcaatcaaaacaaggcctacaaggaaaatgcaacctttttaaaaatatgtagctgaataacaagatgtcgcaaaaatagggctgccacaattaccaaagaaagataattaaaaggacgtttgttatgtgctgtgtttcacccggtacccacatcttggtttctaatagcattcttcactgaaaagaattaaggctctccaaagtaatagctgattctagagctgcagaagggaagctacaagatgagccttgagcctcttgccatgtcagaaagtcagaaagtgctcaagaaaatgaaggggtaagtaaaaaaaacataagaacaagcttgaaaggcttcccactggcccaatctggaagaatttgagcattaaagtaattatgaccaccagtgaattattaaccattgaaaataagaaaaattcatgagtccatagcaataatagatggataaatacatggggaatgcagaagtgtataaagttaaggcataatgtcaactgataaagatggaagaagacgcgatatgggaaaataatcattttataaccatcatcactgtagagattaatacagggaagaactgttaagcggactccatatttcattcagatttcatcagtttttctctcaagcttttttttttttttcttgtcccaagatcccatccaagacaccacattatatttagtcttgatgtctccttaggcttctctggattttaatggtttttaagacttttcgtggttttgatgacctttgacagctttaaagagtactgaccagggcatttgtagaattcccctcaatttggatttgtctgatgttctcatggttagaatggggttacaggttttaggaaggaagtccacagaggtatagtgccatccgcatcacatcatatcatatcatagctacatgctatcaacgtgttttgtcactgatattagccttaattacctggttgaagtagcatttctcaggggtttccactgtatagttattttagttatttcctgctgctctgttccatactgtaccctttgtttttttgtttgttttgagacagtctcactctgtcacccaggctggagtgtagtggcgcaatcttggctcactgcaacctccacctcccaggttcaagtgattctcatgtctcagcaccctgagtagctggaattacaggcacataccaccataaccagctaatttttgttatttttagtagagatgggtttttgccacattggccaggctggtctccaactcctaacctcaaatgatccacctgccttggcctcccaaagtgctagaattacagacatgagccacagcgcccggccccatattgcactctttggaagcaagccactaagcagagcccacacttagcaggtggggagtaatggtccatttcttttggggggagtatctacataaattatttagactccttctataagggagatttaactcttctctcccctactaatttatttagctatttatttcagtatggactcctatttacttcatactttaggttataaaccaaaactaagttatttattttgttgttcaaattattttgactttgactattgagagctctttcatttggctcttgtgtccctttgacctaatcccattattctattcttcggacacttatgtatgttctggcactataatatgctccaggctcatcttgtgtagtgttggcctcagcaacagattcaaccatttctctggggagtcctgggttccttttattggagcatggtattagaaactaagacctgggcattgagtattctcattgctactggagtgtcattacttctagacaccctggtgaacaaagctaataaatgtatgcatatataccaatccatgtatacacacctattctttatttttctatgtatccatttgtatttatattaagctaaatatgatttaagactctgactctaatctagtaccacatgatttattctagccttcagggaggcaattttgatgagaagcaggatattcgcatggtatcattaaaggctgcttaataattacaaaggaaaaaataatacatagactagcaatatcagacaacatactgactggctgatcaaaatatcaccattgaagggcaggtagacatcctgtgcctctgtaagtgaaactctcagacagacatatcacttacatagtataacaactagacgtataacctgaatccaatcataaggaaacatcgcacaaatccaaatgaagactattctgttaaaaaaaggagagaactacattcttcaaaattggcaatgtcaagaaagacaaagatagcctgaagaattgtttcagatttagtcagactaaagaaatatctaattctaaactagattatctactagaagttaaaaatattggcagggcatggtggctcatgcctgtaatcccagcacgttgggaggccaaggcgggtggatcatgaggtcaagagattgagaccatcctggccaacatggtgaaaccccgtctctactaaaaatacaaaaattagctgggtgtggtggtgcatgctggtagtcccagctactcaggaggttgaggcaggagaatcgcttgaacccgggaggtggaggttgcagtgagactccatctcaaaaaaatatatatacattatatataagataaatatatatatttatataaatatataaatatataaatatttataatatataatgtatatttatatattgtattattttataatatatatttatataatataatatataattataatatatatattatataatatattatattatatattatatattatataatattatagattatataatatataatataatatataatatatataacattatagattatatatattatattatattatatataattataatatgttatatataataatatataataatataaaatataatatatataataatatataattatatataatatataattatatataattatatataattatatataattatatataatatataaatataaatatatatatatctatataaatatatatataaatatatatatttatataaaataagggacattatttcgtccatcgatgaaactcaagtatggatggcaggttaaagtattatctcaaagcaaatttcataaatttgattactattatagttatataaataagataacattcttattcttaggaaatacacactgaagtattcagggggaaaggagtataatgtgtacaaatggctcagaaaaaaagtggtgtgtgtattatatacacttgtatgtatgtgtgggtgtatttactaataacatacattatgtatgtatagagagagacaatgtcagagagagcacgaatgataaatgaggctaaatattaatggcaggtaaatctgtttttaaaaaacatgtgatccttgtttcttatataataaatgtgataagcatgtgatgagactgagccaacattagtgaaatatgggctttaaaatgttttccagaagcagttattctatcctgtgatgtcctctgtgaccaaaaactaaatgaaggatgtctttggaagactctaaagctaactggacaatttggaaactgacctctaactatactttgattaataccactggcgaatcattcatagggtatatacaaatacaaatttggcctcttgtttaaagggtttctgtagttcaatcattatgaactcctaactgatacttagtagaacagcatataggtccatatttataattcaaatcattggcaattaaaagcgttactatcggccgggcacagtggctcatgcctgtaatctcagcactttgagaggccgaggcgggcagatcacctgaagttgggagttcaagaccaggctgaccaacatggagaaaccccgtctctactaaaaatacaaaattagtcgggcatggtggcacatgtctgtaatcccagccactcggcaggctgaggcaggagaatcacttgaacccagaagtggaggttgcggtgagccaagatcacaccattgcactccagcctgggcaacaagagcgaaactccatctcaaaaaaaagaaaaaggttactatcagtaaatgctagctgaaactacagtaacaatttataaacagtaattctctactaaaatttaccaaaacataattctttctgagaacattattgtcacaagttttattacatgcttatattataaacctaccaataatatatttattaatatgataaatactaatttaaatctgttcttaatatgacaaaactgtgttattctaaaatccatgaagatgagctattccaaatgagaactttttctaaataactgaagggctagtaacactgtattccttctaaaccacaaaggtatagtgtggtatgcagaatgatgctccctcccaaagatgtccacattctattccctggaattcatgaatatgttattaataccataaaaggcaaagaggaattacagttgcaaatggaataaggttgctaatcagctaacattataacagagagattaacctggattatctgggtgagtccagtgtaattacaagagtaccttaaagtacaagagggtggcagattaagtcagagtgatgcaatataagcactcaatctgtccttactgactttgctgaattaaggaaggaagccacaagccaaggaccatggaaaacatctagaagttggaaaaggtaaggaaacgaattctcccctagacgctctagaagagaatgcagtcctgccaacaccttgattttacttctgtgaggcctgcataaagccattacttttgtggaaatttgttatagcagcaacagaaaattaatatatattctattttcttttctcttacaaaaagtgtaataaatataatttgatcttaaaacttcctgtagcaaatcattgcaggaatcaattcctgtactaaacaacaccctaccaatccctacctccaagcatatatagattcccacatctatgctttagaatataatatagttttcatgtaatcttttgataacagagatgttctatctattatctattactacccttcatctactgtgaatggctgtgctctctctaccctcagcaccactgactaccctagatgtccactattctctttcccccttagcctctccttcaattattttatatttgctcacacagtatctcctgagcttcttggctctagcagaagactgtccttaaatacatgaggctattcaatgccttttacccttgtctacaaatctaccaatcaacatataatattctgtgcacctcagctctttccattgttgctgagtattcaccggttgctttccagggatatttctccctctatttgcaataagcattaaatttttctttagaaggatatacatacatacatatatattcagcctatctgcaaaatgtaatgggacagcagcaggaataatgatagcgtagttacaagtatactctcattgctatgggcaactatgataatggcaatgtaagtacatattcattttctctatacataggcatcctcccacaccctgctatgtatgtatgttctcagtaaatgtttagaggacagaggagaaagtaaggtcttaacctcctggtatgcaaattataggaagaagagagaactaagcaaacaaacttaagttacataaagtaacagaagaaataatacatatttaatccataatatattttctaaaaatttatctgcattcaagacattaaaggccttcaaatatttaaatagtagaaacattacactgagagttattagacgacaaaattatgtcttactcattttcatttctctcatgcccacaattaagtttgctttgaaataattttttttttaataggggtcttgctctgttgaccaggctggaatgcagtgggatgatcatagctcactgcagccttgaactcctgggctccagcaatcctcttatctcagcctctcaagtagctgggactacaggcacacactaccacacccagctaatttttaaaatattttgtagaaatggagtcttactgcattacccagactgggttactcagggctcaagtgattataccaactcagcctctaaaagtgctgggattacagaaataagccaccacacctggttgaaataattttttttaaccttatgacaaatttgtatatgagcctaggtacacagacccttgcaatctaacaataagacttactagtattagcatcacataatcacaaggctgaaatattatagtgttagactctctttaaaatctatgtttttacacaaatcaataaatgtaatctatcacataaaaagaaccaatgacaaaaactatatgattatctcaatagatgaagaaaaggccttcgataaaattcaaacatcccttcatgttaaaaactctcaataaactaggtattgatggaacatctcaaaataataaaagctattcatgacaaacccatagccaatatcatactgaatggacaaaagctggaagcattccctttgagtggccctctctcaccacttctattcgacatagtattcaaagttctggccagggcaatcaggcaagagaaagaaataaagcgtattcgaataggaagagagaaagtcaaattgtctctgtttgcagacgacatgattgtatatgtagaaaaccccatcatatcagcccaaaaactccttaagctgataaccaacttcagcaaagtctcaggatacgaaatcaatgtgcaaaaatcacaagaattcctatataccaataacagacaaacagagagccaaatcatgagagaactcccattcacaattgcaacaaagagaataaaatacctaggaagccaactcacaagggatgtgaagaacctcctcaaggagaagtacaaatcactgttcagtgaaataaaggaggacacaaacaaatggaagaacattccatgctcatggataggaagaatcaatatcgtgaaaatggtcatactgcccaaggtagtttatagattcaatgccatccccatcaagctaccaatgactttcttcacagagttagaaaaaaagtactttaaagttcatatggaaccaaaaaagagcccatatagccaagacaatcctaagcaaaaagaacaaagctggaggcatcatgctacctgacttcaaactatactaaaaggctaccgtaaccaaaacagcatggtactggtaccaaaacagatatataagaccaatggaacagaacagaggcctcagaaataacaccgcacatctacaaccatctcatctttgacaaacctgacaaaaacaagaaatggggaaaggattccctatttaataaatggtgctgggaaaactggctagccataagtagaaagctgaaactggatcccttccttatccctcatacaaaaattaattcaagatggattaaagatgtaaatgttagacctaaaaccataaaaaccctagaagaaaacctaggcaataccattcaggacacaggcatgggcaaggacttcatgactaaaacaccaaaagcaatgacaacaaagccaaaatagacaaatgggatctaattaaactaaagagcttctgcacagcaaaagaaactaccatcagagtgaacaggcaacctacagaatgggggaaaatgtttgcaatctacccatctaacaaagggctaatatccagaatctacaaagaacttaaacaaatttacgagaaaaaaacaaccccatcaaaaagtgggcaaaggatatgaacagacacttctcaaaagaagatatgtatgtggctaacaaacatatgaaaagaagttcatcactgatcactagagaaatgcaaatcaaaaccacaatgagatactatctcatgccagtcagaatggcgatcattaaaaagtcaggaaacaacagatgctggcgaagctatggagaaaaaaagaatgcttttacatcgttggtgggaatgtaaattagttcaaccactggggaagacagtgtggtgattcctcaaggatctagaactaggaatttgacccagcaatcccgttactggataaatcattctactataaagacacatgcacatgtatgtttattgtagctatgtacaatagcaaagacatggaaccaacccaaatgcccatcaatgacagactagatgaagaaatgtggtacatatacaccatggaatattatgcagccacaaaaaagaatgagttcatgtcttttgccaggacatggatgaaactggaagccatcatcctcagcaaacacaggaaccaacaccacatgttctcactaataagtgggaattgaactatgagaacacatggacacagggaagggaacaacacacaccggggcctgttgggccatggggggaaggggaggaagagtatgaggacaaatacctaatgcatgtggggcttaaaacctaggtgatgggttgatgggtgctgcaaaccaccatggcacatgtaaacccatgtaacaaacctgcacattctgcatatgtatcctagaactaaaaataaaataaaaaatgtaaaaaaaataaaatctatgttttatattgatcatacacaacattgtagaatagattttacatatataattagtatacattttaaatatagagatttaacataacaactctcctggcaatttcagctgacaatttccatggcaaagtacaagctgcacacaatggaatcctgacttacttctttaacacataaaacacttaataaaatgtggaaaagctataccacctaagagttattctaaaatattttatagtgtgaaatacatttatatgtatgtatgtttaaatttactgaataaagacaccaattaagaaaattaaacccctaaaagctaactactattcacatactttaatttagtttgcttattcatttcaagtctttcttcattaatataagtttaacatatgtaaaatcatagcatagaggccaagcccagtggctcacacctgtaatcccagcatctggggaagcgaagataagaggatcacttaaacccaggagttcaagaccagcctgggcaacacggcaagatcctgtctctacaaaaaaaaaaaaaatgtagtcaggcatggtggtacatgcctgtagttctagctacttgagaggctgaagcagaaagattgcttcaaccctggagttcaaggttactatagcttgctactgggctccagcctgagagacagagtaagatcatgtctctaaaaaaataaaaataaaagtttaaaaatcatagcatggaaataaccttgtgcttttatcttttgaaatactttaagtataactaattttattactacataaatctaccatttcaattctcctttaagaaatctacaaagaaaaactcacatgatactttcatgacctctgaagattaaattatatctggattgtatctgaatcaaggatataagataattcatgaatgaataaaataggatttaataaagtaaaatataaaataaagactgatttcaaaataacaacttgttttaggactgtagcagactttcttttaattatagatttccaattaaactatttaggaaaagctatactttaattttaatcttaaaagttaaaagaagatcaagtaactgatactaacttcacattaaaatgtatttcactaatacaaatagtaataatgaccatcacaaaaattttagctaaatattaattgacctttatctgtatactttgactgtatttagttatttaaatactcacaatcaaaatatacagatacaacttttaaaaatacacagaaagtacttcagcacttatgaaatagaatgccatcatcttccgtataaaagctgaaatcaaatcagaaattgaaattgatgtcagtttatttctgagagcttaatatatttggtaaactgcttcctctttgataacagtggtttcagttttgtataaagactcattataagccacaatatttcctaagtataaaatatgcagcattttattaacttcatttccatcttttatgaacagcatggatataactaccaatcactttaaaacaaaatttaagtttcaagtatttttcatgtgatttgctacaaattattttggaaatttcctgactatataacattgtttagactgcaatcattttattaaaacttacctaaaatgataataacaactgctacttggccctccatgtatttaaaaaataaaaaacgtgagccagagatttccagatctctatatattatctgatcatgtcgcaacatttcagagtaggataacaagatgctcttttgaaaattaatgggaaaaaggaaagctttggagcttcttgtgaaaacaagaaaaagtgtaaagaaaaaggtaggtgatataacggacactatttaagttgtgggaaggcaaaacttacttaagaaactgtcatggacaactgcagacagggcattaaaaaaaggacaatggcactgatgggataccagtaaaaatctgatggctttaaaataaactgccaacatcttcacaaattatgctttactgcttctgagctctagcaaggtttctatacagatagggataataatagaatataagtcattatagatttgttgagaggattatgacaattaaagtgcttagcatagtggttggcacagaataagagttcaataaagtggtgtgttattcttatcatctcatttcaattgagttttgcaagactttcacatctctagaaatgtcatactgtaaatttgaacttgctgatagaaatctgttggaaaaagaagggtatcaaatttatcactctataaggatttatttagcatgtactatttacctaggcatgtggtgctaccaagtaaataacttgatatctgccttccaataacttttcacattggtaggttaacaaagggagaggaatacatggataataagaggaaagaacaaaaacaacgatatattagagtgtttaagatcaacggtaactgaagcatcagttcaaagagagcacttgcccgggcactgtggctcacgcctgtaatcccagacctttggaaggctgaggcaggaggactgcttgagtccaggatttcaagaccagtctagtcaacatagtgagaccccgtctctacaataaataaataaacaataatattaaatttaaaaaacaaacaaaaaaaataaatcagagagagctctctgtgtggcatccaatgatagatgtaagaaagctagcctggaaagacaaagacttcagattgggggccaatgtgaaacaaagttgaataggtaggactttaaggattttaaagcactatggcatgatgacagtgttttattctattcctctaagtaaaaacctgccaagggaactagaataaagcatgtatttaatgaaatcatttaattattaaaccactgacaattttcccttcttttattccctccttctttctataaatatttattgaatctccactgtctagcaggcagcacgtaagtggtggtaataaggaaacattaagatgaggactatacctggtttgaagagaaaaactttagtgtaaataatcccaaagaaaactaaccaagattattttatcagcactgcacctgcacttcattttcttttaagtaggtagactgttttcttattacaacttaaagattttagagtttcaagattatatcaaattaacacatttattacattttagatatatattcatatcaaaagcattctaaaactccatcctcaaagctctactcacttaaactagtattctggaactgcacatgagcattcggttttaaaatgccttacaattttgtcagatgccagaaaacaacaatgaaaaattaaccctggttgaaaaaagggataacttataagtagatttggttcagaagactataaaactataactaacttttaccaggcaatccaagatttataaaagcatgtaaccttgagcaagagacccaaccttcccatgcctcagtttcttcatcagcaaaatggtgacaatacctacctcaagggcttgctgtaaaaatgtaagagttaatacaggtaaaacacttaaaacattgtttgccacacagtaaatgtttcatatgtgctattatcattgtagatgcatctttccaacatctgcttggagaaaaaaataccgtgacaaaagaaaatggctctaaagagccttcagatgtaacacaatagaaggacaaacaggtagtcgcagaattgtgttagattagtgacctaagtgtgtttaaggaacaagaggtaaagcagaggtcacaatgtgtgtttaactttaaataaatatatgaaacaaggaaaattatattctagattttaaaaatgtaaataactttctattgctttacattgtccaaacaaaagctgtgttaataataaagagtatacttctgaatctggagtcccatcaatgatttgttcagcttgcgtaagtcacaactgattggacacagtccctgtgggcttgccatttcatccagactggacggttcattagtcataactactataactgtacagcagagactgcagttttatctcatcgtacatctttgatcaagctgcctcaattctgcttcatcagcatatgaagttacattattggagctttttattttccagtcggtaattaacagagattatgctttttatcaaaacatgtatttggtcttcacatttaatagtgagggcccagatctgaccaccatttgacctctgaaatttctaccacctaaataccatgaatcataaactgaaatccagaataccacagagaaaattaaacaaagaaaagaactgacctgtgttaaaaagcataagatgattgcacttatctaaattgagactaaccatatttgctgcagcttctcattaaacattaaatcgcacaccagaagaaaacatcatacatatttattgttttgcactgtcactttcaaaagactcataccacaattagtgtttctctcaaactataagctacataaagaaatttcccatgaagcctgaagacaaagtaatgtaaaagatggttcaagaaggttaaagaacagatggataatagatttcactgaacactaaagcataatacacttacttcagaaaagaaaatgttgccaaaacttagttcaaatataaaatactgaatgaaattgatgtgtcgggaatttttttttccttccaagttcttttggagaacaatagggggctaaaaggcctgtctcactatttttgcatctcactattttcgtgtgtaaagtgtccccactgtaggctgcatgaacaatcataatcgacagttacatgcaggcactgaggctgcaaaaatcccagagtaattagtgttgtctgaatgcaatgacatctgtgttctcatggttctcgagacatgtcaggccaataagatgtatatgaaaaaatatgacaagcattgcaaatgcccttctgaaaggtcttacactttaggggaaagctgaagaaataacacatgtcatcttctctttgtaagcaatatatttaagattacaagatctagaaagatcttttgagtcattcattctctttttgtaactataaagcatttgttcagaatacatcactagggtatgaaaaaaatctgttgtaagttggcttctttttaaaactttctcagcacatgtgattctgtgcagtgcaatgtaggtgcccattcctgtaagtgacaaaacagagagcatatcttattaacattccttggtttcgttaccttttaattaaaaaatattacctcttagtactgaacataaaatagttcaaaatttgtggttaaatgccttagaattatgtttgtatttttctaataatacagagtgtcaaattgactgtattaaaaagtctttgttttaagacaactaatgcttttgcttactgatgcctattactgaggcctctccctctatatgctgtagcagtatgtttgagcatgcacttgctccaagaaagacattagtcatcattaacagaagcactgacaccaaatctaagtgcctctccacaatgaccaagtggcaatcatctttctcttacactgtcactgctgattaggattttctttcatgaaaatttaatttgtacccctttctgcagcttcttttttttttcattcctgaaaaagcaacgtgttcaggagagattacagataaagcaaagaagctctacctataatatagctaatgatatagagattgcaagattctcaggtaaatcttttctctaatccaacagaaaaacacagattaaatcaatgattaataaacagaagaaaaacaatgattttaaaaggaatattgctttattgctttaagaatccataagcctcaaaaggtaactaattcaaggaatccaaataaaacttccctaaatattaacataatcccaagcttctttaaaactaagataacactttgatagttgccatctttcactaggtttcaaatttgtattctccattttgtaaacaaaaagacaggggcattcacacagaaatatcactataaactgaagaaaatacttaagcattcatacctttagtatgcattaacctactggttagttgtttttttttttttttttttttttttgagaaattttcagttgcactggacaaatgaaagtgattcatttggccaagcagggtactctacagctagatgatactacagacaaactctggttctgtacaatatcacaatgttaaacaagatatcatagcaataagttatttaaggaagtttttaaaaacatttacttttctgttttatttcaatctgtttaaagtttttttttttaatgtaagcatgtgatagtttgcaagggtcctggtacgacccaaactcccacttctagttataaatattatcatctcttcgtattacttaggtattataacaaaatagagattggtttaaatttaaattatcttgaaattattttatatcccttttagaacatatgtacttttagtcaaaacatgtaacacttttgtgtttacatgagcataaattgtatctttttaaaatgtaaataaccacatgaaatgctctgaaagcaaaaatcaacattatttctttgtaaatcagaagcaagtacaattcatcaaactttagtcattaaacgatccttctactcctattttattctgaaaaataatacagaaagtcaaacagcaactgcttagtgccatttacaaatggtttgttttttctttttttctatttaaaattggtctgcaattagaacatgtaagaggagattaggaattaaaatggattctgagaggcaatttctaactactgaacttttataacaggagtatctttgattaaataaggagctagtctaaactaaaagcaaaactgtaccataataacccaacttaattatctttgcagaatacatttataaatgattggctcatttctacctttacttgactaagtaaatatgcctcttaaattctcaaacattgaaaattctgattctcacagttgcacagacttatctaaatcaaaacttcaaaaagttacaatataattactgactccattgctagatccagtacaagttcaagtaaggaagtttagctctgtaacttccactcctcaacctaaacctccaagtcacttgtcagttaaaggttgggcgatttattgaccgcctctggatgcatactgtcagtgctgaaggaaatatgagggagggttgttgctactgttctggagctcattgataatgacatacctgcctctgtcacccattacccatactacaaactacttagacctaactgaaaaatcaatagcctacttgcactggttcctgtggctgcctcctttgattgtcagctcctgtctagggtcagcacttacatgaaaggggctgtgactgcctgatgctttcaggacaacctaacgatatgaaactagccaacagaacagtaaattctgcctccctgccctcctcatcaattaggctttgactaggcttgcctgtagaaacctgaccttttaagtttaggtgaatatggactagctgaacacaccattgccctcagcactgagccaggaaatctactgacaggttaaacaaaacagaaggttgtaactgtcataatttgcattgcactttcacgccaacaagggtgttatcagtaggggcaagccctggaacacacaactccagcacccttaagccacgctactcataaattttcaagtgaagtgagataaaacataaattcacaaatagcaatgcatttctcatctctcagtcttttaggtttgcactttgcaaacccacagagtgcccatcaacaactccttttggtcacctggcactcccattgcactaattagggactttcaatgaccataacacagaagtaaaaataacaatgcccatttaagacctattttagagagactatataatatagcagatagactgactggtatatatgtcaaaatgagaacaattagatctcaatatgctatcttttcttgcctcaattcactctctccaaaagtatccacaagcttagacaaacaataagttatcacgtaagtgaaaggaggtgttgaaattatttcctaccaagctactctgatatagcatcttttacagtttgagggaaaactaagaacatctgtaaaataaaagatgttaacacttttatgcttgtcagatcttctgatgaaaacaagtgaaaagcatgagaaagcagtataaaactttcctttgtttagtgactcatgttttgaaaaccacttccctgcttagatctatcttttaacacagtaggaacttggtaatatcatagttgcttagcacaatgtcatttctctaaggagaagaccaataatttatttttttaagttaattgtgaatgggaacttactttggcttcaagaactaatatttacacaatacccaatgttcattaaaatgtccaaaacattgacagtccattaaatatttaagggaaaaaaacatattgtttatataaacatatattatttttctatatacaggaacacatactgcattttgttttataattttatgattcaacccctatcaagcaataattagtatactcaggatttttcccaagttgctacttcattgtccctcacagttgtctccaaactatattttgtaaattttttccataaatctaaaatatctataagcttattcttgtctgagtttaaaaactttcatatacctacgttagagcagcactgaaagcctaaacatctgcagaaagatttctgatagaaataaacaaagatgtcaacaaatttagtcatgtaatggtggaaaattttagacttttttaactagaagagatagaaaagattacctagtccaacccactcatttagcaattgagaaaataatggataaagatagtgacttgatcaaagtcacccaggtaaccaagccaggacaaaaatttgggactttttgtttcctagattgatgctttgctgatacgttcacactgtctccttttatctatccaggtattctggatagcaaccaccttacatttaaaatacatatctatagatttgtatcattcatttttaatttataaagtttatagaaagctttgattagcagaaaagattagattattcgtagagcatttaaccaaaaagttacccaacaaatattagaaatagaaggcccaattaagtatggttggaatcctttactgaccaaatatgatgattaactaagcatctggtcatctttctgctcctttgtgtgtacatagctgatagcaaagtgaaagggtatggatagtgtctgatcccagcaagcaaatcatttgaaaacagtcatagctacaggtcaaagattttctactcagtctagatggatctaaacgtactaacctcgattttaaacctaattacctatataccaaatcagtcagaaaataagagaatgactctttatgatccaaagataataagggaagataggaaggaaaaattcaggaaagagactggcagaaccttgatatccataggccaagacagctgttttatatcctagctttatatcagatggttaaaggaaaagtttccattccttagatcattaaatattatttcatttatattacacagatgtcttccatacatagattacaaccaatgaagcattttgttgttgttgtttaaccactacaagcaatcagagaaacctctctgcacatcacttttactctaattcataacatttaaaggatgaggcaggctagatttttaacatttccattaaaaataacacaaagtccattaagtatttcttgtaatcttagcagatgatcaatgccaaattactactattcataataatatagagtgctacagaaccaatacatttttaaataaaatgtttaaaatggctagtgctcctaaagtataacaaaaacctacccatacgatatgcttaactaataattttaaacatagacccacaaaatgtctcatatgacctgaaagaaatagcacataatgccaaatattatattttgaaccaagtacagctcaacactagcataatctacgtctctaatttcactcatctgttttgttaatgtctggcactgatcacaagagaaagtagaaagggagtggggatggatttaatatcctaagaaacatattctacacaatttttgtttcacacacattgttttggctcacaatgtgagtcaataatattatcttcataaacaaaagatatcacaccttgaaaccataaggtcagctttcaattttctttaacacttaaattcattattatctgatcctggtttttctgtctaccttctggaagtgatgttaaaggccagcaaaatttggttctccaggtagaaaagtcacaaagaataatccacaaattatacaatcatttcttaaagttaacagttggctctaccaaatataccctttcatgtgaagataatagtgacttatgaaagtcaaagttatttggcaggtaaaatttaatatttatctaatagtacattaataagttcaaactggtttttaaaaaaaaaaaaaggaggaggggagaggaaaagaaggaaggaacaaggaagaataggaaaagaaaatttttaaaaattttgcttcaacttttcagaactgcttaactatgtatgtaaataaaagaatgtagtgttacaactcaaaaatgtatacatttaaaatgagaaaaagatacacgatttcttggtaaggtcaaaagacatatgccaatataagtgtgaatatagcaagttcaaagaaactttctaaaaaatacttgctgaattaacttggatgttaacattgcacattctagcgcaataatataatggcatttacttcttagtcaggctaaaagctgcttactttaattttcctgagcacaagtcccttactctatcattgtatatttttggtgacatcaaattatgtatagtttaataaagtactcatttatgcagttgctattcaacttgggggaaaaccctgatatacagcatactctcaattttctcattccactatataatacaagaattatatttgtaaagtctaataggtaacaaacatctctaatcatatatattatctaaggcaatccaaacaaatttaaaaggcccacaaacaatactcatcaaaagtacataaaagcattttatttttcagtacagtttgataggcttactgtacaaaattaaagctactgcttttacctgacataaaattatctgaagttcaacctgttcaaatgagaacaatacccttgggttactaatcaaagagagtaaaaaaaaattttttttattaaggctattttgtgaggggggaagaataacttgtttcaacagcatgcttgaccatataaaattattaacaggcactatggtgaactgttcaaggcaaacattcaattactggttattttagattgattccagaataataattacaagtagcttagaaacaatctccttaacactttggaattttagaaaattaaatcctttgacagagaataaaagagaatgtagttttactgtgacttataatgtggacagtataatcttgatgactgtcattaacacatcttacatatatttaaatataattacttcaataaaatttcatcaactagaatacactaacaaatcatatctgggttatttacttttctttctgtttttagtgaaataatttttaaattcagagaacttaatagtgttttatttcctcatttacaatttgaccaaaaataaaaatcaatgttcatttttttaaaaaaaaaaagcattttcataagtatgtagaatgattaagtatataagaactaaaaatgtagcacccacatagatgtttcaaagttagaatttagaggataagactatataccagtaaacacgtggtcctttgttttccaaaaagtataaatcctccagaaatgctttcttttcttaagtcaataatctgattattttttgaaagcttctaaaatatttcctggaaaataagatcatgtattctaaaatttgtttactctttagtaaagattattgagatacaatatattatttttacagataataaaataatagataccttttaagtctcgttaacatgataaagtaacaaatgcactgacgttaactcagtaaatacatttttaagtaaagatcagcaaaaaataaaacagtttaagaattttgtattctctggaaacataaacaggattataactgtcagattacagaagcactgacttcagccattagtttggtttggctcctgagaaacacaacatgaactactgcatcatttcttttcaaatccatacattccctgcagccgttcaagcttcatcagcagtgcaggaatgtataaaaatgacaggcaaagggcattaggtttttttacttccatactgttttcctataaatggaagacaggattctttctcaaagcacttaagctcaagctcagtcaatgctgaaggaaaaatacaactgaattctctatgcaagaaagtatcacaattggattatttactacttttcaaggacatgttgataaatctaatactgtattattatcttagaataaaacattgtaaggttagcattctagcttaattacccattattcttcaattagaaatattttcactttttaaagtactctgtcaactcatcaccttattttaacaccaagtattcagttttgcttctaattttaattataaaaatttccttaaaatatgccaattttttttgaaaatatatttgtataaatagttaattttttatttccaagtttctgtactcataaaggtttcggtgaaataggaaattccattaataattaaaagtttatttaaccatgataagtaaaaataggatgtaatgagtaatctggttatttgactggaccttaaacattcacattgctataaaactagtaccgtaattactacaacctgactcaattttttgaagaaactgggaaattttcagactaaagttttaaacatcctcatattttagtttatagtaactaaaaacatgcccacttcagtactatcacctacattctttatgttcctaatgtaatgatgcaagaggtaaagcctagagaagtctgaaggttacggactacctgatatccaaaacaaaaaattcagatcacaccctgaatgtcctccttccctttttaggaatgtcctgcagctagcccagcaccacagctctgggctgaagcatgccaatgttggcactgcctaagccaaacaaacaagatgtttaacagtcaaataaaatgtcctgcagcctccctaatgaatttgtcaaggaccatcagatttcgcaccccctcctttgcctcattaactcaagtatgatgagacggattataacaagagaatacagatgaatcggtctgaagacttgaagtggcttttagcctctagagtttctttctctcacttggtctcctttaatagaatatagtatctcctgcagaaggagctgccagttcgttttaatacaccatcaaggagctgctgatggacttctatactaacatacataaaagcagaggtgacaggggctcttcaattacagcctcctcggataccgtttcccccttcaattattcaaccagaggaagagaggaccgcaaaggcgcagctgaagctgctcttagagcagaggcagccagagtgagttggggtgggggaggggggagaaagagaaccagcaagagggagcattatttgctggaagtgtttaagtttattgctcgaatgatgtttctaattagtaccacggccataaattaaagtcgcctttgtttaactgatttattatttactagagcatctacctaagacagggtaaattggtaatgaattgtttttaaatcaaaacatttgtaacgttttatcatccttccctctgtatgtaaaagtggagaagcgtaggggcaaggatgcgagaaaacttagccgagcttgacagagccgccagtggaggtgcagcggagtgtccggcgagtggtggcgcgaaggtccgctcggcctgggacgccccacccgagagaagaggagaaggcgcaggacttgcggcgcggcggcggagccatgcgaaccaactccgccacccctgaggctgtttgcaaacactcactctcgggagcgtcgcgggccgggccattcgcgaaccagacgcaacgacgaagcgaccacctcgagagtggggcgggaaagctccgcaccctctatccccgccaccagtctccgcccagtaactgcccccggagaagcaaccacggagcccctcccggccagtcgcgctctcccggcagcgcagtgccctccggcccaggcagttcccagagcgccggcaaggcctcccgggttagagccgggctcccacaggcgcgaactccgagggcgcgaggtcccctagatccttaggcggcgaggcgttccgggacgcacgcggcctccccggagaaggctggaggtcaagcagcccaagtctctgccactccagagaagttaactaaagctctggagtccaagagtcgcgcggacacttaattctgactcttcttcctaatcgcgggaagacaaaccctaagcaacaaatccgagatagtttttttttaagcaaatattccttagaaagggacttatggcaacgagagaggaagggtgacaaactgcctgtggtccgcaccaggtatgtaagaaagaaccaagaggcccaattgtctgataccaagtagatagaaagaaattaacttccctatgcaattcaattcaggttcacccggccggactttaagagggtaagtcaagccctcccaaggggttttgaaaaagccgaactaccaggtttctaaaacgaagtcttcacccaaatggacgcatagatttttatttttatcgcataacccagggctggaatataacctcccaaatcaaactaaaaataatcacatctacctgaaatacgttaaaaagattcagaatccagacatcttaggttcatacataaaccctcagtatcaagcaaatcagaaacaatgttctagctttttttttcacccaaaagtatggaaaggctacagtgggtacaactcgtttaggataatacatatactaaaagcacatgcatgcctttcattgaaatgcctagggaggagtgaagccatctgtgtaatcaataacaggatagttatagatttttgtggcagtgaagtcttttaaaagcaagagtcaattatgaaaataaaatcattttacaaatgaaactctgtacctgtaccccctaagaatacattcacaattagatttacaacagtaagattttaagaaaactttaggtttacatttacttgccttgtttttcattaagtttgaagcaattttagtagcttattttaaaagtatatcctactaagttctacgacatgtaagtttgcaccatttctcacaacttagatattttctctctcgtaactagttaattcttgtaacgataaaataatggtattaaatacatgtgaatcttaattatgaaataattatcaaacaaggtgcttggactagtttttgccctgccctgtttttaaacagcatatcgaaattactaaaaagagatttataaaccctcaccttatatccactccaaccctcactggtgcacatatacagcaactgctctgattcttggcaacaatgggaggggaggggaagagaaaggaggatgactttaaaggaggaaaaaacctggaaaaattaggtcctttcccagattcccctttcgcttcccatttgccttcaagccaaagtaattttgttacagtttgcaccttctactacacaatgttgatagaatcatttaaaaaaaaaaaaagtgaacctttctgaaccattgctactctccctcgcgttattccagccatctccaggagagtcccttctatataaactctttttcttctttgctactgataagagaggaggataaagaggaacggctgtaaaatgtgtgcaagcatttgactcccattatctcctcctattttcttacttctctctttaccctgtttctttatcaagtgcagtggtggctgctaccgttcgccaagcgtgcctgtcttctctctcggattggctaaagcactgacagctcggatagcgattgtaggaactgaagctccaccccctcatgatggccctgggaccattcataaactaaataactccaggaaacagcgagggagagagagaaagaaagagagagggagagagagagacagagagagttagaggaaagaagagagagcgagcacgaggaaggggggcgggggagagaagcagggggagagcggggcgagaaagaggtcggaggggagaggagggggagagacgactcagaaagtggaatctgtaaaagcaagctagaggagaagaaggaaaaccctgaatcgttataactacaccccagatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcacttaaaaaacctcatttccagatttctggacaatctcggctgcagacatctaagcctaaccttttggtatcctgagttttttccctctccttctccttcctcacgcccaccccgcttctctcgcacacggtcatctttacatatcaagagaaagcaaaaaggttccaagaggtacttttctttttagaaaatcaccttttctcccctaattcttctgcagaagaaaagaggtttcgaaagagggaaaaggaaaaaacaagccggctacggtatcagccggtcagcccaggtggaaaacgagagtgaaagtagggcttaacggggagcgcaccgcctctttcgaaagccgctgggccaccaccagtgcgtgagccttggatccctcaacgtattgcgagacgccggtgtatagcccggacctgtgccccaacatgatcgccgctcaggccaagctggtttaccagctcaataagtactacactgagcgctgtcaggcgcgcaaggcggccatcgccaaaaccatccgagaggtctgtaaggtggtctcggacgtgctcaaggaagtggaggtgcaggagcctcgcttcatcagctccttgagcgagatcgatgcccgctacgaggggctcgaggtcatttcgcccaccgaatttgaggtggtgctctacctaaaccagatgggcgtcttcaacttcgtggacgacggctcgctgcccggctgcgcagtgctcaaactgagcgatgggcggaagcggagcatgtctctctgggtcgagttcatcacggcgtcgggctatctctcagcgcgtaagatccgctcgcgtttccagacgctggtggcccaggcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactctgctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatccccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgtaattgactgtttgtggattgttcttaagtgaaggcaggtgagatcacagtttataatttccaatgtaaagatgtgacgaggaatcaaatgcaagaagcttccacttgaactgatttgcaaaattttaaatacagtacattttgtagaattgactgtataagttccgacccaaatccttagaaaatagaaaacactaattttactcaactataatatatatttgttctgtagatgttaagattaaaagtaacatctacttcacgcttgggaaaaaagtatgaaagaaaatattttgatcctaatttttaaaatagaaaaaactttttcacattaaaaattaagagatgtgctttcttatgccataatttcaaaaaatccaatctgaatccgatatacaaaggaaatatttatggatttttctgaatagttaacaaagtcagttgatacttttccttcaaccgtttgtcctcttcaagctttgagtgataaaaatttaacaattaaataaaccacaacaaaaaatacaatggttatagcaataatcctctccccaagcatatggtgatatgaaccattcagatttataaattacttccattttaaaatggcttagttgtaaattccataagtatgattattttaatcaaatttcaagaattattctgaaactgcttatatgcaattcaaacaaaaaaggttttcataccatttttataaccaaagaaaaattattattccaggatttagaaataggaaaagtaccttcctcctctttctgtttttctaaggtaacaaaccaatatactcatttcaatgtttcagctttaacaaaggtttctttttaatgcaagggaataactgattagaaaataatataattagtcaaacagaaagtatcccaaaggaattggtttgtcttgcttatgttgaaggtaactatatactccattcgctatgctaatgatgagacacaggtacagaatatatgtcagatgttaccctttaatatctaacatttattctttgtattagcccaggttttaatttattgagaaaatgcacaaatgagaggtgtagagaaaaatgtttttaaaggcaattttaaagatcagaggaagaagtttgagagggggaagggctgtatggagggatgagcagcaggatagcagaatagatgaaaaacaagaaagccactcaggggtctgaagcctagttcacttgacaaacaggcttaagttgtgtaagattccttggtaaaaacagtcctgtgttaaaaatataaactttgatcctatcagttctgaaatcatctccactctttcaactcaacctctattatatctatttttctagttgctcttcctgtattcttcacagtaatattaagtggctcaaacaaacaaattcttttaaattataaaaaccaatttattctctggggaaaatgttctgaattttaaaaacattttcaaacaaacagtaggtgcttacatttgcacaaaatgatttaaaggaatagtgtttggtttcaaagataaaaagaatatctataagtgaccatttttctcactcacaaaagtatttacagcagtagacatacatctccctccaactattccagaaaaaaagtttttaagtcttgacaaaaagaaacaaaaatatccccaattcagcatattttcttcttccttatttaatttaatgcaggtatcagttaaaaaggaaaaacactgcaggaacataaatgtcctcatttacagaacaccttaaagcattaacatctatacaaaattaaaacttctcccagtagctgactgaaaaattgtttttaatataaattggcaggagttttaacttctggaatataaggaaggttgcagtgatacagaccatttcttcattgagccaaaagatctccatatttcacaagcaacaagaaaaaaataatttaatgatgctgtacagaatcagatcagagagagacaaaacttgtaacttctctaaaaggagcaaataacttcaaagaacctaatctcacacattggcagagattctaattttcagaacaattaattagacacttttaaattaaatcaaattttaggctttgctctatatgtgtttaaaagcatgatagaatatcttgaattaaatcccagtctttcttaaattcagaagttaccagaaatcagagagtttaattttggtaaccttcctttcctaaagaaactaatgcattttcagacatttcagtcatgggacaaagtagaaaaaatttttaattgatagaatttcagaattagcaagttttctctacattggattagttaacttatcaagctcaaaacaatcagtttcatacaatctaccaagtcctgtcttaataaaggcagcaatattgaaacaaagtgctagaaatatgtgtgagacatgatttgtttgtatagttttaaacaaaattataatattttcatcaagagctactactttgaaatacttctaaatcattcagatttaaaaattcacatgattacaaaatcaaagaacctaccaaaaaactcaaaatatgtgtatgtatatacatgtacataacatatgctatcagcctgcaaaataaattattccactttttaagccacctttttctacagattgcttattttgctcatttttaaaagaaactgtttcctctcagagcaaattataccattctttttcttgaaataaacctaattttggtttttatgactgtgctacaaatgtttcttagtaaaaacaaagttgccagggtctgaaaagtaatgagaaatatattttaaaggggaaattacattttcatttaagaatagaaaattatgcagtgccttgtaaaatctactataggtaatgggaaacagaggtatctcacacacaaaacatgcttgcatgcacgacagagtagtaagtcatggggacaaagcaaggagagtgatatattggcatcatatccagaaaacataaaggctaaacaaaataattccactctcaatctcactgaattttgtatcttaattcacccttgaccctttgaggcaaaatatatttatagacaatgttctcggaggttccttcccctcctcacaaagagctaatgataaatgtcattaagtagaatttgtttttgaatctaaatgaacttcaataatctaactaactggtagggaatcataaactaaagaagataatgacattgcatataagccaaggcaacttagaagaaattcaaactaagcctgtcagatttaccaatcccaatcctatccaacagcacccaccatcccatcataagaaaaaatgaaaccccttcatcttctcaccttggggtcgatttttttgaagttaggatcctcttcatccacctcaaaatagagttcggaggaggtgacagaaagagtgccctttactacaacagagggggccacaagctgagctggtgtgctcaggctaacaggacctgccaaaaggaaaagacaagccacacaagttggaatgacatttttcaaaaaatcaaattcgaccagaaattgtatttaatcttttcattctcacgtctagtactgaactgcctgccaactacttctacagttaaatattctgtccaccccaaatcttcctctgaaaatgcaaagtcaggattctcatactacaagatctataacaggcggttaatgataacagtaaactaggatgcaattattttacagggagtctgcaaagctttggtctaatctctaggtaagaagtggctctgcctaaataagtccatccacattccatttagaaaacaggcctcaggctatctaacaacatgaacaacaaccaggagcaaagaagcctcaataggcttccaaggccagcagttagcttacagtatggtagaggcatggctacaaaaagatcactagcttattaatgaagtgggaaatgttaaaccatattttctgatagagattttatgccagcttgacacaaaacctcttccataacaactttaccccatcaatgactggtaaaaatacttcttttctaagccttcctttccactgttaagtattgttcaatgcttccaaatctaatattagtgtagttcagggactctgggagtaaacagctggagggtgggtttccaagtgaatgaatttttattggaataatcaaatctccacagggcttatcaaagagacaaatcagactgctactgaaaacaatagattcactacagacagaacagcataatgtgtattagagctaaatataaaatatgaactaaaaatgttacatatatatgtctgttatgtctgtgtgtgtatacacacacacacacacacacacacacacacacagagagagagagatcgacgtagaaagaatttgaaattccattatcaattcctcatggtataaatcctataggggaagaaaacagcataagagaagattggcacttatagttctgaattaatatagtgcctataaacaagctgtgcctattcaggtaatcaatgggtgaataagtgtttcaaaattcagatgaattgacatttccatcgattgttagaagggtgatagtgcttaatctcacatcaatcttaatgtgtgccagtaggacaatagaagggatgctctgcggagatcagagcaggttttgccctctattcccaatgtacaaatacattgtgtttgcagatgggcagcagatagctgcagaacagccatgatttcccaaagctcatccttataaatggatgaaataagaagctatgtgttcttttgctgtctccttttgccctctgtacattagcatgtaatactgagaagaaataacattttttcaatcactctcagacattcaattacagggtaagcagacagctgcaagagctagggcagcctaggtcctacagaagacccctgacaatttccacttcatttctaacccacaccactttattagtgtggattacttcttaatcctattgccattgtcaagattatataattaaactcccctttcacctctattactgtatgaatgtattactagtagcaagaatagaagcaaaataaaggaagaaatgggtaaatggatgtgaaggaaaagactacagaatagcagtatctaccttactctccactcccaccaattaattttattttactttatagagaggtttacagttatcagagaagataccatcttctctttttgcttttcattaccaagtggcatagtagcacaggttgcagatatgtcaccaaaagcaaggtttttaatgtcttttctcttaaaattatcaaaatggaatactatgtaattttcacctattgaaattatagaacctttcagactttcttccttgagggacagagccacaggtattaaagtaaaaaagccatttaatgaatgactaaaatttccggctaaacaagagaatttttcccataagggatgtaaaactgagaatctgcagagtgcaaatcaaaattcctacatcaggcaaaatacgtgaatgttgtgaaaagccatggcattctcggaattgatttgagagagttacatgcatatacagcatgttcactaagacctgtatatcaaagcaaatagcttctctccttccaagctttatttacaaaaaaaaaaaaaaaaaactggcagaattttacttatagtcttactttacagagatttggtaactcctatgggatgggtgaagtaattttgttcttttgttgctgcttttaaactttttctttttcagtgaaaattattcacaaaagaaaaaaatgaggagagtaagaagactgaatagaatagaaaaataaaggagaaactgtagaagggggggaagtatttgaaataaccaattaatgtaattgtgggtataaacttggtagtcctagtggtcacagctgaaaaagtaagtaattatatgcttattgtcccagaggtagctgaaatatctgcacaaccaccaaatttaccggcaagattctctaaatctttctcatccacggatgacagagtatcatcatcgccttccaggaggatctcgttttctgagttctgatttcctaaagcctgactcctgatggactgttttcctttagcaaggatatcttcatctgtggctgaaatgaaaaggaaacaaagctgtccatcagttctgggaagagcacttcggcagaggggtaggggcttaggtaagggtaggtggccaaagatggtcaatcttttatacacagtgtcagctacagtggagaaagtgattgggatggcacacatgcctgatctgacaaactcgatcccccaacctagtctaatgttaccctaaacaagcaccctaatcccattaaatttgacccctgcactgctcaccaaaccatttatttacttatagttagggtaggagtggttcaaaagcagtacttttattgaaaattcattaataggaacaatcaaatcccagttttggaaacaatatttaacagcaaaaaataaggactgattcattcctccaaacaatgttatactgacaaacattttggaatggttgaggagtggctgtggagaagaatccagaattaaaaagggttaaagctaagagacattcacaagccagtgaggatttaggcccagatactgaagccatatctgacactaataagactacagcagctcctcaaagctgcaatctcttctttatccaccctccctccttccttccttcacattaccctcgtccacatgttcacacatacactcactcctccgcccttttgtcctttatacaaatatccaggagcaaggcggtgtggaaactaagtggaagctcaaacactacctcctctgcatgtttaaactaaagggctaaggcaccccgggggcaaacataacagaaagcctgggatgagaggcatgtgggcaaggggcctcatgcggcctgaactggagcagcttgtggagagcagcagtaccagactcaggcactatgacaaggcagcaactgcaggcagatggaggaaaagagaacacatctagggagggaagaagcagccctgcagagcacctacactcaacaatgggatccgaaaggagagcaaagacgcaaatgaaagtggaaaaccctgaaattcaaaactctgattcaaaacccacatccttccagggctcctcctgttgttttgagcagctttctccttacgacaagcaggaaggcagatgctaacttctaaattgtgatttgtaaaacttcatatgtgtatcttttcctaatctttttttgaatggtgtcatataagggaaagttaagaatcttcacctgaccctcctggcttccagctagataaatcccagaggtaaagcacctgatctacccaggctgcggcttttgatatggaaatcggatggctagggttttttttttttttttttttttttttgctccactgcagcttctgcctaggcataaggcccaaaccccagaaagaataaagcagtcaatttgcagtaacacgactaatatatatatatctatataatttattctacatagttaacctgcacatgtgttacctgatttggcagatcaaaggttcttagggtttgataagtacgtttacggatgatgttaaaggtaaaaggttttttttttctcatatttattgcgaattcaccatgtataccatttatatacaatacttatagtgctactgaaacataggagttttctatttaataagaagtcatgggaagaagctttctatatttacctttaaatacactctatgggtaaataaaatctttcatactcacaggctgcattgtaagctacacacatatgatggtctggacatatgtttgaaaagattactttagtgtatctaattaaagtggctttatttattttttatttaatttttttgagacaggatcctgctctgtcacccaggctggagtgcaaaggcacaataacagcttactgcagcctctaggctcaagcaatcctcccagctcagcctcccaagtggctgggaccacaggtgcttgccaccatgcccagctaattttttaatttaactttttgtagagatgaggtcttcccatgttgcccaggctgatctctaactactgggctcaagcaatcctaccacctcagcctctcaaagttgctgggattacaggcgtaagtcatctcacctggcctattttttttttaaaggctaaaaagaaatatacttacaattaaccaataatttttagaaaaacagaactatgttctaaaatcacttatatttcaagtatttatagttccttactctaaaatcagaaacactgccctgaggctaaacaagatcttttgcagtttgctatcaacattattaaaaatatattggccactgagaaatgcaaatgaagcaccatcttctaaatgtttttataaagtaaattataataaattattattttccagttagattttagtacagaataagtataccacattctttttatttcttggatttataattccttcttcaaagcagaaataataataaggctaatattacatatcattttgcataagtcagggagtagtgttaaaaatactttacatagttaattcatttaattctcataaaccttctgcttagttctaattttaagataagaaagcaggctcaaagaggttacataaattgaccaagttaacatgcgtttgacaattagagtcaggatttaaaaacaggcagcacggtgccagaagctgggctcttaaccacgatgccatattagctcttagatgtaagaaacagaaagaaaacaaaacaaccactgttcaaatatgaatgtgtatataattaatttgtttactaattcttgtttttcatagtgcattttaaaaggttaaatgagaataataatcaagaacaaaaaatattcatttccaaatctaaaattgatgaacatgccaaacacatcagaaacaactaaacaccctgctcattacttcctctgattattgccatacatgtcctaaagtacaccaagcttatgtgaaaggaaaaaagaagaaacctctttaatctgcaaacatttacaaaaaaatgagagtccccagtggcaatatgtaatggtttaaaatagctcaaaaaataaattcacattcatttataaatgaccacgagaaatataattatcccttccaattgcaattaaaaaatttttaaatatgttctaatcatgctgcctatattaaaacacagtaaggtaacttctgaattaaagtttcattaaaaattttacatactataggtgtactgtatgcatacacacacccactttaatttatttatttacttatttttacaagctcagattctggaattgttcaagctccactgaaaaacctcttgtcatggaaaatatgcagcttactgatatttagaatggttttcctgtaattaactcccccttgaggattttaagttagcagcagtaaaattaccaacagtactctaatatacaccacatgcgctggtgttcaattctcagtggtctaatagctttctgctaaagaaccttaaaaaaaaattagaacaaaacttttccaagcataaaataaaggattattatcatgtttatatgtactggggaaaagtatatttttaactttcatttgccttattctcaatcaaccattataaacaagtattttgatatcttctgtgagcatattctacacacgtctaaaagttaattggatgaagtcagaatatactttgggttccattttaaagctcaattcagatatttctggctaataaaattgttactaacatgattgctgtttaaatttttcatatcattattaagaaatgccttttattctggtttaatttcaccttttattctagtttaatatttatcctaacttaatacttaaactgcaattgttacataaaattggagaaatctgtcagaaatgtcatctttaaaaatgatttgattcactgaggctaagaacaatgaaaggcctaagagagagaggctggtccccaaaatgtaaaattcaagttcttcagagctaactctggacatgagttgatttatctatccaccacaaaacaggtaagtagaattaaaatataaaaacagcaaaaacacacacaacaaaaactgttccacctttgatataaatcctttttaacatctactgagcaagtgaactggaatcatcaatagtctgtattaaagtaaaagaagtttatactttaagaattagcatttttaaaaaagactactattagaataacagagtgccttcaaacatacataaaataaaaatgggtatctacttatgtgatctgaagcacacaccataacagcattctgaacaggacacataaagaatatcttataatcaactattgttctaattgattcccctctatagtttatgccatgtccatagcattccaagtcaagaaaactgactctgtaaaaattaatgaaactacaaaggataattaggagaataagccaggtgcatctcgtaataatcatgggctaaccaaaattttagatagagaacctagtatatgttgatcctaaaaaggaagcaacagtatctggcattattgaagttatgagacaatggcacgatttaagatctttacatgatctgtcatccctagaaaaccaaatgagttacttgtatcattccatatgcttacaagatacttttaaaactatgttaaattctccttatatatttctattagcaagcacgttctctaccaaataaaaatgtcttgaattcaataggattctctgctaaactgttttagcacctgaattaaaaccaatctttctaccgtttaaaacattttttacatgtctttaatttaaatataaaattcccgttatatttaataatgaattttagaggacagcacagcacactgatatgaaaatctgggtttcagtcagttaacctgggctttagtcctttatctaccaaaaattatactggccctttgtttcctcagtttccttatctgtaaagaataaagttagactagatgttagccttaggttccttctacatctaaaatgctctgatagtaagtaacagctaaccagggctctggcattaggaaaatgttacaaatcattgctaccaatttctaataaattttaaaactataaaatggaagaaaatgccctcaagaataaaatgcccagctttgcttgagctgctaatttccataaagaatacttaatcataagaggaagtattaattttaattttaaaatatgactcagtttctgcaaagttaaagaaatctcccattacagcatgacttttataaataaccactttggagggtctctgcttgaaaaattacctaaagcttttttccccaagcaagttaatgtgaacttgggaagggcaattaaattgtcagaattaaaaaatttgtttttaactagaaggtagccagaagtagagtcatggggctggtattgatcgcccaaacagagaacatcactcttcaggtatttactctgccacctttacactagaggctttccttcaaatcaaatcaatctataaaaaagatggctcttactactaaaatacgtaactgatctccaatggcacttctatttagatgtcttcctttgataatgataatatagttcatggtgttctaagattctgcatttttaaaatgtcctatctccttagttaaataaattataaataaaagtgagaagtcataaaaatataagaatgacatactatcctcattaatatatattttaaacatttaaattcaacattgaagcacggtatttatccatgttaaaatctgtaatttcaactgctttttgatcacattaacaattttgttttgcatacttaattcttaataagtttattttgattagcttctttaatgctccaaaatttttaaacaccaaattaaaattgaatgtcaccataaaatatttaatacaccagtaaaaaattaagctctttgtttacagaatatattagcataaattttctaacatcgaacaataccataatacaatctatgtgctgaatttattccctttttatttaaaataaaataaatatgaggtaggattagaatttgtgtttttttaaaaaatgttatagtaaatattaaatatgatatatctctgaaattgtaagacaactgaagaatctcctacacatttagatttttaaacatatatttcaaacgcaagttttgtttttaacattttggagtatgacaataatcataaaattactataaaatattactcaatgcttacctttgctgttctctctcaatttaaaaatgcacactaaaacatagataattaacattggattaacctttcaattactatcgagagtaatcagagtgaaatctacttctatacaagtcaagagtcttaggatgatagtaaaaacatgttaataaattcttttttgtcaaactttaatgcagatgcttagcattaaaaaagctgacaaaacaatatgattttaagagctcaacaattaaaatttattcattaaaaatcctgtaactcttcaaaatggttaaatgtactatttttgataagaatattttaataaattctatattaaatctataccacaaattttaaattgaattattgatatctaaggataaaagattaacagcctatctatgtgcaattttagaaaacaaatcctccccttccagatataaaaggaaaatgtttttacgaaaacatattgccatgtatagatctcagaactcacaaattactgtaaatgatggtttagaagacagaaaaataattaaatttcaaattttaagtggacatggtaatacattttgttaaaaattgcaaaaaaagttcaccttctccatgtaagcatcattaaccaaaacaaaccagaaaatccaaaaaaacacacaaaaaaagaaaaaaaaaccctctgaaatctgttatcaccacctaaaaactatatgtactctaaaagcaaaagtggcctaattaattctacattttatttctctttctccacctcctgtagttgaagatgtagggccatgagactattattgcttttagatcactttgttattgactattctctgtatgatcatttattttaaaggactgatgtaacatgtggtgttatatctgatgacatattgtggacattttcttccagaaatggctctttaaggctgagtgcaagaggttaagctgcctgactgaggccaaacctaagattacagatttttaatctaaattcttaatatccttattgaatataaattaacatttattttgtatgctacatatttccatttaatcacaagctcctgcatgttaaaacaataccctgaaaaaggaaaattaaaagtacttctgactttattaaaaaccaatttatattttataaagtcaggataattttaatgtggggaggagcatttcccccttaaccaatatatcttaattgactttcaaaaatcataaaataagtgaaattttataaaaatttatagtatcaaatccaaaggaaattttcagtttttccaatttacttataagacttttacctaaactgaatcatagtcatatgcattgtatcaaaaaagcaaaaatgttttgttaagctctgataacaaaataatatagaataggaacgtatgaaaataatgtttattctctttttccatgagccatctatcataaccatcttcaaatcaaggctcagaaagtatctaggcaattggacatttattattatctttcccagttcatgatctcatgctaaaataccaggattgggcgaaaaccatgtatacacaacagaacctagaaacttatctggtttgtaaatgctgtcttcctgatattcatggatttaaggcatgcctcctggattcatttactcaaagctgaatgtgtcgcttaaaaggagacatatttaatctttgtactctgaaacaaagggtctatgttaagtaagttttgtatgtgtaacataattaataaatatacttgacaccataatttaataggactctatagtaactataaaaaaatttaacttctctttctggtatgaacaaccataaaatgtggtgttggaccattttacagtgccttgtaataatgaagttatgctcttcattaccaagtcctgtacctgctgctattggcaaggaatggtttatacactgaccatgttccacggctgtttttagtgtcgcttcaggatgtgtcgatcctagagggttacgcacaaatcgtcgccggcgccgcaagtcatcttcccagtagtcaaggcgccagaactcaagaggacgactacaatgaaacagagaagccacatatgttagcaattatcaaacagcgtggtagcactgaatttctgcataaagctctccttgtttgctctgcctttttttccctctccttccacttaattctccctccatctcacactcccctttctgcaatctttaacttaggtatgtccttgaaaataacaatatcaccttctagtctaaggaactccttttccttttcttggaaggtgaaatgagcactaaatacatcattttgaaatgaattgctgacagtgtgatcagtttccccacactctagtggcatgtgctctgatttcagcctcatttcagcctcagcagggcacctttctctgtagctgcatttataaaccagaatagggaaaaggctattataaatatggtatagcattacctatattaatcaaagtccgtcccccttcatttttcttcctaatttgtgcctttttgcacaaggtcagtaaatcataccatgaattcttggtccagaaagtgttaactttaatgaatatctcagttacatggttatgtatgtgataataaaatattactctgtttagatgtgcaggaatttaattaaaataatctcttaaaatattcattacatttagcccctgaggcttagaacaacacaagaaaatgcatttcttttccatttactgtttttaaataaaccattcctgtagagtgaaatagcaatctattttcaagcaaatcagattggatttctgttttatgtactctgtttttatatttaattaaaaactacatgctatatgatgtgcaataattgctatatcaaaagcatacttttggaaatgtattttttaaaaaaaggtttgctcatttcaaattctatatttcccctattacatacacattttatatggcaatatataaatgtcagctttctctcttgttaactaatcatgatctagcatgctggaaaaatattttataaggaaaatactaaagtgttttcagttatagtaagaaaaaagtctctgtagaatacattaattcaataaagatatacagcaggaacacctgtaagtttcaataatgaaattaaaaaattattcataatcaaaacttcttcaggaatgactaatacaaaatacaatcttacttatatttcgggagctaataaaattgtatctgtcagctttgacaaattagtagtcttcaacaactgacagtcccaaactacccaagtaaaagttacctttattttgatgttttaaagatgttctctttaaaaattcaaaataggtttataaataagtacttttatcaattaaaaactatcttgtattaataaaaagcataaacagtacgttatttaaagaaaatctttttaaaacagtagagactgatctctgaaaatgctgaagggataagaacatcaaatatttccttgggtgattttggtcaggagaaggagatataatgtaatcaaaatgtaatacaaaaaaagtataagaattgcagttctcaaaaagaaaaatttaaaaagctattattatatatttcttcattattctgtctaaatttgaataaaaacatgatgatattatttaaaaataaataaatacccacagaatatacatacaatcaaaagacaacagttgttttaactcaattaataaaatgaaattctccttaggtgagaaggaaaaaggcagtacacagatggctgtgtgtatggctttgatagtcatggagcttggataggcacttcatcattctgcctacctacatttatctgttaaaattattatcaaatatcagccaggatgcagtcgtgaatcacaggctgctcctcgccttcaggggaatgatacaatgagggtctattcatcagtgcggcaatcggcacaagtaattagttccctagactgagatctcctacaaagcctatttcagtcagcaccacaaacatatgacgatgtaaagctaatgaaagctgctcaaatttgttaaccttttctgccatctatccttctaatactctatgcttcagtattatgcaaaggtagtaaattattaatttgtcattcatccatccttctacattttgagtcaaattaaatgatgtcattcttcttgataacaattaaaattataagagatgttaagctgctatgataaaattatgactaaattaggtaacaatagattctactataatgcaccacagtgaagtcaaattcaatggctattaagcatatgcacaataacttttatcacacagcagaaaaaccagaggaattataaaattattcacaaattatcaagtaactcaaagataatatctatagcaaaaataaccaaaattaggaggaaataaaacgataatatttatttttataccttgacactaaaaaaaatggtcaaaatggtgacatttggctaaaacaaaaacaccaatgcatcagggaactgagaatttgttcacataatagaaatgaaagttgtttcatttctgctaactatatatatatatgcagacatacatactgtcttcaaatatattctatcaatttttttttctttttgagttggagtctcgctctgtcacccaggctggagtgcagtggcactatctctgctcactgcaagctccttttcctgggttcacaccattctcctgcctcagcctcccgagtacctgggactacaggcgcctgccaccatgcccggctaattttttgtgtttttagtagagacagggtttcaccatattagccaggatggtcttgatctcctgacctcatgatccgcccgcctcggcctcccaaagtgctgggattacaagtgtgagccaccgcacccggcctattctatcaataatttttttaaatacttaaacatggtccaaatagaataaacgacctgtaataccacagcatgataatatttacaatctcctgaagctatgtcacttaaggactatttttccaacacaatccagttacaacacaattaaaaacaatctgaagacaaagcaaatatcacttagttcagatcacatatctagaaagaattataaaaatcatttcaaaagaccaacaatttcaatatattttttgagagtctcttcatataaagcactgctccaggtgctacagtgtacaaagttctcatgtaatagacttataatcaaacagttagctattagtctcatttgagaaaatagcatttatcacccaatttcagattgtgtaggtaatacatgtttttggagaaaaagccacacacccacttatttgagatatatttaaagtcatttaaatatatttaataactagcatatttaaagtcatttacacagtaacaaacctgggcctaaagtacaatgttttgtttccctaagtctgctccctccaacaacacatactctcagtataacgctctaccacacacacacacaaaaatgaggccggctttgtcattttaaaacagtattataaaggagaatgtgtaggttttggtcttcaacttactttcttcactctcatttaagaaatactgttccctaccccgtcccttcctcaaaagcctcttccaggcaaaagaggatacaaaattggcaaatttattaataacatagtgatccaaccctcttcccaaaaggttataaagtaattaaaagattatacatttttgtagttatcaccatggtacgatcagcaaaatttaaaagacttcatgtgttcagaaacagactgttgaccaaatataagcatggataagatcagaaatcacttattctggcaccttataagtacatatctagatcacattatatacctatacctttatatatctgtatctatccccaaaagttatattaatactacacaacaccctttcacaaacttcactcatatccatttccactaagatcctcaaaatcttcaaagtaaagaggttagcctaagttttagatctggaaatactatttccttcagaagacataagcccttctctacaaagatgccctacttagggctcctcttaggacacaatctccaggtactaaagtctttgactggtggaacatatgtctttaaaaagttatggatggcactgaagttaaatattataatctttctaattattttttaatttagttttttcgttctttggtctaacttcagagtctgaagttaaaattaccatgtaagtctattggacttttctacatatacgtcatctaattatgtttctactttttaaaaaactttcacgttatgtgtttgtatacacacacctttaatacatcactataatctacataaaataacataaagcaatgtcatggcttttttgtggttgttgttgttttttaagatggtagagtgtcacccaggctggaatgcagtggcaacatgagggaacagaacaaagctcactgcagcctctaacttttgggctcaaaagattctcctgcctcatcctccccagtaactgagacatcctccccagtacaaaaattagtaatctggctaattttttttattttcttagagatgggatcttgctacattgcccaggctggtttcgaactcttggcctcaaatgatcctcctccttgagcctcctgagtagctgggattacagacacaagccactgagcttggctggcaatgccattttaatacatagaatatatgttttatgttctacaagaacagaatttgatagattattaaatttttagaaagaaatataactcaaacatcaatagataggctatttattctatttcctaggccctttatggttactgatttgatcaggtagaacaaatgaataagaattaaacaaatgagaatcatttggaagaggcagaagtattaaaacaaaatcaacaactaaggtacgattcacatttttcctctaatagttaaatgatacaactatacaaatttgactattatttttctcatgttaattgtaagaatttttaggctgggcactgtggctaatgcctgtaatcctagaactcagggaggctaaggaaggaaaactgcttgaggtcaggagttcaagaccagcctgggcaacatagcaagaccctggttcaaaaaaaaaaaattagacaggtgaggtggtgcatgtctgtagttctagcttcttgggaggctaaggtgggaaggtttcttgagcccataagttggaggttgctgtgagctctgatgatggcaatgaactctagcctggctgacagagggagagactatctccaaaaaaaaaaaggaattataaagtttagattttttgaaacccaattagccagttaacatggtatgaatggccaaatattctaataaaataccaatatattttctaataacaattatttattatttacctgagtcagctgtggcaatacaaggattattacaatgttgtccctgatgtcatggaaaaggcagatgcaaaaacaaataataagaattcaaaaaagtatgtgtaacagaacagagctttactacatggctattaaggtgcacaactccagggggcacttttcacatcaaaatttttgtaaataacatgccctggagttatgcaatgctcactgtacattactatatgccacagcccaagtgctaggagaatactacctttacccacacatcccccagttcccctgccccacaattcaatgctcaggctcctttctttctctggaatccaaaagttaaatctaaacttgggaacaggaaacagaacaaagcccttcagacactatcagtggcagttgcacagtcagtatttccctgctgtaggaaaaagtggacatattaggaagatgcttggttgtcaaaacacaagcaaaattcaataaaaagaatgaaataattaagtacataagagaaatattaacatttatttaaccaaaaaccattaagttcgcattgctatattaaagtagataactttctggatattgctgtattaaagcagagtagtttccagaacaatgttaattactgaaatcagtggtagctatgtaagtatcccagttattctacaacctagatgaattggcacctattatcaaatgagtcaaatgtattcatgtctatcatctcactggttttagtgtcattttaatgtaacttaaatatgtcaataaaagtatatgagttttaaaaagaaaacctgtcaaaacacaatcatattagaaaattttcccattttccatctcgcccactttgctttggcaatacctgataaatcttgataaccttaacagaagtcagtaagaaattctcctagctaaagttccaaatcctagaacattttagcacttcatattttgttcttaaattttcacattgcctgttttttaaactcctatatctgactagcttctatttccatatttttagattaaaaattcatagtagacattagttacaactgaaataaatggtaacccctaaaaagcagtaaacattttcagagcactgtcagcttgaagataaaaagcacttaagttctagaaaggtttcacattctgtataaatcttggtgaaataatgttcaggtactataggtatcatacaatataagagaatgctttacctcacaaactgaaatctatggtgccttcatgcaaataaaaagaaaattaactaaaacctctgtttaccaagtaccaactataaatcaagggcagctgatctatgcattatgctgtcttaatgaaaaggacaaacaaaaacaaaaacaaacccttcaattgtgtggattccagcagagaagacacatactaaagcagaattctttctttattgaggcctgacattgagacactggagtatcatatattttatttaattatgtaaaatcaaattttatgtaattaggaatttctgcatgtcactattcaatgtatgtctgtatttgttttttaaagccatctagatatccatcttcaattaattattagtttggacatttggcaaccaagttaattattcaagaaatgatcccaagcttttcctgtctgttgttagccagttgaccatttctttcttcacttagaatttttaccagggattgagtaaagttatgagactatcaaaatctggtgttatactaccagttaaagctctaacaaaagacatctaggaaaaaaaaccattaaaatgatgttattaagaaccagaagccttaaagctcacctcagcctcactatttagacaaatctattatactgtccccaaatatctaatttaaaaaaattcaccaaacacttgttgagtgccaactatgtaccagattgtggtacatacaaatgaatgatgctgggctcaacctacacaggacaatggggacaaggaaattattaaatataaaaaaaataagttaaaatagactatattactttaggctactctgtgctacacactgttctctgttatatacagtaccgccaagcctcaacaaccctgccatgattaaatactgctattctcattttaaaggtgacgaaagtaagttttacccattggtagtaaataataagtctgatgacgtctaagccaatgagcttttcactacatagcatttcctcttgaacatcttattcgttactattatagctatgatcaaagtactaattaaccctgcctgggaggactcaggatttcattaagatttcaatgaggatctattttgtaagttacatgaagagaagggtttatgcgtaattcactgaccaagcacagtaactgttacaaaactgccacttaataaataattgatcaaagagtaaaccgatgacttttaaacagaaacttaaatgataaacaggagtctgctgaacaaaatggaaaaggcactataagccaagaaatagcatggataaaggcatggaaatgtaaaagggctctgtaatttaaggaagttttggtaagaaatcacagctagacagccttaggatgggaaaagctaaggtaaaaaacataggtttagaaccagatttcaaaagaccttgtagagttaactaaagtaactacctgtacatcctagagtctacagagacagcatcaggctttcacaagaggtttaatatgatcaggcttgtatgctacacggcagcaacatacagaatgtctggattaaggcagtgaggatggagcctagaagtgaagggtttaaagacatatctgaggtagaatagataagacttcacatgatattcaaatatgggaggtgaggaaaaagataatgagaataaaatcaagggctgtaacaagagggaagttagaagataaagatgctatttaattaaaataaatacaggttaaacaggcctgactgggaaaaataatcgcatcctagatgcctaataacatccaggcaggtatttctaataggtaagtaatataacactggaattgaaagagaagaggcctgtgctagagatttaaaatagggagattgaccaggcatggtggttcaggcctgtaatcctagcactttgggaggctgagacaggtggatcacttgagccgtggagttcaagaccagcctggccaacatggcgaaaccctctctctacaaaagatacaaaaattaggcagacacggtggctcacacctgtaatcccagcactttgggaggctgaggcgggcggatcacgaggtcaggagtttgagaccagcctggccaacgtggtgaaaccccgtctctactaaaaatacaaaaattatccaggcatggtggcatgtgcctgtaatctcagctacttgggaggctgaggcaggagaattgcttgaacctgggaggcagaagttgcagtgagccaagatcgcgccactgcactccagcctgggtgacagagaaagactccgtctcaggaagaaaaaagaaaagatacaaaaattagccaggtgtggtggtgcacgcctgtagtcccagctacttgggaagcagaggtgggagcgtcacctgagcccaagaggttgaggttgcagtgagctgaaattgtgccactgcactccagcccaggtaacagagtgagatcctgtctcaaaaaatatataagaaaatagggagactggttagtcttgggagtcagtagatttagcattcatttaacaaaaatgtactgagtgtttattgtaagcctgggtattttgctagacccagagaagagtctattgaaagggcaggagaaagatggggatgaatattgcagaacagaaaaggatcagtaaaagaaacagggaagtaacagtgccttacagtcaataagataatgggagaaccaaaatagaacggtgccaaaaaagacaaatgagcaaaaatgtttcaaagcagtcagcgggcaccattatttaattctgcttaaacatgctcaaaaggatgaaaaatgaagagaagtctttgttcatgttttgtgtttttaacagctttatgatatataatgtatacaccataatgctcacccgtttaaaatgtacaattcaacgttttttagtatatttacagagttgtacaatcatcaccatgatctaatttaaaaacatttttatcaccccaaaatgaaactccatacccattacccgtcattccacatcttcccttcctcccagcccctggcaatgatgagcctaccttctttctcaacatatttacctattctggacattttatataaatggaatccatacaatatgtagaattgtgtgactggcttctttcactcagcataatgtttttgaggttcatctatgttgtagcacatattggtagctcattctttttattactgaatgatatttcattgtgtagatacgctgcattttgattatccattcatgtactgatgaacacttgagttgtttccattttgtggggatctttgggttttacgatgagaaaactgaagtacttggttagctatctagcattcacttctctcctctttcctaataactgaattacaattttgttcagatatctatcactttttaaatgtttctctgactcatggaaagctgaccaaattatgataaatccggtcattctcagcagcgattggttcaggaatccagctttaagaggatcactgcataaattctgcctagcaaccacttttcaccaatatgaaatggaaaccttctattcagtggttgagacaagagttctttctttttcctgatggtctgacacaatgaaacatgtagatccagttgctggcagtcataaggcatccatgagagaagccagattggaaatagtttatacatccggggacagagaactgaaagagttacaggaaaatggagccagaagcctgccccaaagcctatacatatctgtacttcttataagagatattatacttcttcataatctagtgaagtcaggaagttcacttggtgcaagatttcttattacttgcctttgaaaccacctaacagatacatggattactggtgatgctgtgagcaatttgattacagtggctggaaggaaaagtagagagtaaaacacttatgctttggtggcaatggttaatattgatctcctcttcaaaaattttgacgatgaaaggaattagagagctaggatggcggtttaaagaaggtaaagaacagacttaagcatgtttgcagaaggaaaagacaaagtccaaagaattcaaagaagctgaagatggcattgggggtaggaggtgggtagcaggagcagggtttgataaagacagaagaggtatgatcccataaaaagataacatgatgaacttggaagtaactaaggtcatctctttctttgtggcaaaatccaaggatgtaagactctgtactttaataaattcagggctgaagagaagaaaaactaaagaccagattttcacctgattgtttgttttttttctattacgtagcatatttttgactaaagaaaagaatagaggaggtaaaattagaagaggtgccttggggaatacagaagaaagctgacaaaggaaaagtttaaggatgattaaatagcttatgaaggtccagctgagtttggaaaccattgaggtagcatcgatctgcagaactgtgtgatttttcctataccctgaccctgaccatacatagtaacctgggagaaagagtaaaaagagcagctgaggccaggtgtggtggctcacgcctataatcccagcactttgggaggccgaggtgggtgaatcacgaggtcaggagttcgagaccatcctggccaacatggcgaaaactcgtctctactaaagacataaaaaattatctgggcgtggtggtgtgtgcctgtaatcccagctacacgggagactgaggcaggagaatcgcttgaacctgggaggcagaggttgcagtgagctgagattacaccactgcactccagcctgggcgacagggtgagactcccatcacaaaaaaacaaacaaacaaacaaacaaacaaaaaacaaagcagttgaccagactcattcaagatttaggactgatttggttggcagaccaaaataaggaaggttaaggaaaatgagtaggctagtaagaacgcctgggatgactatgggtgataaatccatgatctttctggactttaataaaataaataacataggctttatagacattgactcattgggaaatcaaatttatcctgcatcccaagctacttatattgatgataattaatcaatataactggcttatgatgcagtataaatttgattttccaatgaaacaatcagtaattctatttaatcaatatatccagtccccttatttactgctgctatgttttcaacttgtactaaaacacatatagaataaaagaatggaagattatactgtacttgaagactttcttcagtcttcaaaatgataggatcactagccaggagatgaggatagggaggagaaggttgttgtaaataatcatgggactgaacaatctatacgcagagaccatctgaaggcttagggaggcaggacctcactcttttaagaagtatattacattatgctcctggaaagaggatgggaactaaaatttactgactgccaataatgtattaggcatgctagtacgtattttacatgtgatctcatttaattctcaaaacaaccatataaattagagatataacacctatttaacagttgaagaattgaggcccagaaggtgagtgattcagttactaagaaatagcgctagaccctcccaactagaactacccattaccaaaaattttccaggctactttggctaagacattcatatgaggttcattaatatacttcttatgacagttcattatattggtatgagtttaaatatctctttcataaagtgacagatataactataaacaaaaaattttataaattatatgaaaacctatcaacacacatttcaataaagaataactagaaaattcataatttttccagcattagcatcactcaaaattcaaatagcaaggctattagactaagggtaaggagttacaaggctctatcgcttttcaatgtataagtataactaagtactgtgtagtgcagggtcagtatttgtaagtaagtagcctgaaagctattaatattcagaaatatgtttagtaaccacatcacttgccccaaatttggaagaactacataagcatctacatgaagcaatctcatatccaagaaccactgctttggcatacagaacctttatttctacgcgctctctctctctctttctctctctctaagacaaggcctcactctgttgctcaggctggagtgcagtggcacaatcacggttcactgcaacttcaacatcgcaggctcaggtgatcctcccacctcagcctcctgagtagctgggactacaggcacaagccaccatgccaggggaatttttgcattttttgtagagatggggtttcgcccctttgcccaggctgtatttctctcaaagtcaagtcctataccacatttgttgctgttcttcttaagatactttgtaagtaacaggaagacaagaaaagaacaaaaaaaaagtcaccctccatagcataacatttttatctttaaataattttttaaagtttacatgaagaaaaaccctgcataatccatcacttcctctttttaaaccaaaactctcaggaaaatactgagagtaaataactgattttaactaacataaaagaaaaatatatatactgtactttgcaacctggataaattaaagcgttagcaaaaggtatgtgctttttatccactggggaaaacaaggcttattatgttacacttccaggtttttaagacagttggaagccggttctctgaatagttgctgtcatctcctagatactttctagtactttcaattttgaagcaattatttacattctaaagtgatttattttcctctctttctttgctacatttcatttcttctggttctcaatgaccatctctactttggcttaattatattcatttacaaatattttctgagtacctgctaccgtgtggaaagaactggttgaggtgccttaagaaatactcatatgaagaaaacacaagtctctaatctcaaggcacttaaaatctaataaatgggataaaataagcaaacaaaaaattatatgacataaaatccacaccataagaaaagtaaaaacccagagtgatagaaaggcaaagagtaatcacatttgttttaaagggaccaagaagctttaaagagcaagagatttttgagaaatacccttaagaagaggccaattttcaattgatacacaaagaagacgatgacattttaggcttttaggagatcttaagtaaaagtatagaggtctgaaaattggaagcagtctcatttagccggtccaatagaaaatgagatatgaaagataagttagagccataacataaaaaatcaggaatgaaaaactaataagcttatatttcactcatttactcacttgttcatttaatcaaaaacacatactgaataccaacaatgagtaaagacaggagattcggtcatttggtgatagaaagtcattattctcaaggtcctcaaaatccaataagagaaacagatatatgaagagataattacaatatatgcaaaaggtaccttagggacacagttgaagggcattatccaaagtaatagaagccttcttagaagtgagtaatccacaaattgagtcaaagagttaacagatgttaaccagaataagaaaaggaaaatcattctttctgagggaacagcattagcaaagccaaacaagtaagaaacaattgggtataagctaaagttaaatgtttccagaatttttggagcggcataaagcaagaagtgcccaaacaagaggctatagagggcaggggccagatcatgaagaatcattttaggagtctggctcctggtttaaaacctatgtgtgatttttttcaggccttaccatgggtagttacaaaacctttacctggcaggcctcacagagaaaagctgtactccccacatcagacttgatgtacagcgaatgctttgcatctctggcgggagttgcagctaaggtcttaggcctctctggccagttatgctctttgcacatttacattcctagccctgatgaattgattcttgggtctgtatctgaaaccttggcctaagatcctctccaggcatctcttcctagaactccttacttggagaggaagggaaaactctgaagacagtattccctactctgattcagcctgttccaagaccaccccgctagcccttcctctgacctcgtgtccataaaactaccagagtctttagtttcaagtttcttcaacaataagatgactctcacatctgcgcagatccacactaacccttgaaaagcatgccattctatggcgggaaatggaatggggagtcaaccccttccttcggatttagactcttgctaataccatcatagttaatgattaaaggcttaccctttcatttttggcttgttactttaattggctactcctacacctgacagttcaactctcccagctcagcttaggccatggccatgtcatgttaaggagcttgggttttaccctatagcaatggggagatattgaagagttttaagtaggtattataactgcagataaatagaaaattagactatagggaagaaatatcttaaatatcactttcacaagaaagtggaaaaaaaagtaagaaagttattggaataaacaacatgtaatgagagccttcaatactaatttttaaatttctatttttcagatttatcctatcaaggttttattgaaacttgcctaaaattgtctatgatacaaggtaggcaataaatataaatgaataagggtatgaaagaaaagctcaagcatacagccattttgttcacaacaaaatagtttccaaaccatgtgatgtacaaagttaattaaatgttacatggaaaaagtagacctataattgaagtagagatcaaagtcctaaagctaagtgtagagatgaaaaaagaacataggaaaggtccaataggtgatatatcacctcagcccagaaaggacatacatgtaatctactcacattccactcatctccctaagtcatgtaacactgcaaaagcaatgtgttccctggctgggtagccatttcccagcaaaactttaaactatacaaagaggcatgaaactatggttatcagctggccatatctgtgacagatgacaataagtaccaaagacaaaacagaaaaaagggacagaaaatacaagggaggtaatagggaacatgttaacatctcaagtaagatgcttagaaataattttctgaaagcaacctttgagcaaagacttgaaggaggtgaaggtgtcagttatgcagatatcttaaagcaaaaggatttccggcagggaaaacagtaatgcaaaggccctgaggcagacacacttggtgaaatgatggaatgtaggaggccattttggatacataaagaataacagagttaagtagaaatcaaatagtttctaagagggccaaatcatttaagtcttcataggttataacaagaatttgacttttattctctgtggaatgagacattagaagattataagcaaagaattgatgagacctgacatgttttaacgtgatcactccagctcctgcaagagcctggctgtgagtggaaagagtgtccagtttataggcttttgcaataatccaggagagagagacgatgtctgggaacaaatagcagcagtggaagtagtaaaaagtcattgaattatggatatatattgaaggttgagtcaaaagaatatgctaacagatcatatatgggatgtgagagaagaggaggcactgatattacaagtactttgatctgagaaaataaaagaactgaccctgagaaaaaagagaatgtgagaggaataggttttaataaagaaagtctaaaatttggttttaaacatgttttattcagggtgcctattagaaatctggggcagaaaagggctaactatttgccaaatcccttttcatcttcttcttaggcacacaactagaccatatttcccaatctcctttgcaattaagtatggcaatatgactgagttgtagccagtgacatgcaagcagaagtgattgaggcacacttccaaacccggccaataaaactttccacatacaactggccatgctctaccaccttccactgttttgatgcagatgaatggggcactcttggaagccaagaactaaggataatggagctataagatgaaggaaattatccaccagaaacatgttataaaatttatatgaaacagaaattatgttctattatgatcggacactgactgagatttggaatctatccactaaagcagttaccactgcccaaactaacacagatatccaagctgagatattcagtaaacaactgaatataagagtgtggagttcaaaggaaagaacctgacaggatatataattcgagagacattgatgactagtgtttacataatacaggtgtggactggctcagactttcaagcaagtgaccaaagctggagaagaaaatggaaaagtaaaagtacaaagagtaaggcctgtaccagctcaacaataaagagattgaaaagacgaggaagaaccagcaaggaattttgaagagaggccagtagtaagaggaacacctgtttactcatctcatattggcagtaagaagaaaacaagaaaaatacagtgtcccagaaaccaaatgaaaaaaatgtgtcaaggagaaggtagtaatcaaccatatcaaagggtatcaaaaagtcaagtaagaagaaaactgagacttgactattggatttatttatttatttatttaaagactagtcaatgactattggatttaacaatattgatgtctctggtgaccttgaaaagaacagcttcagtatatggtgggaaaagagcttgagtgaagcaagttcaagagagaataggagaagagaaactcagcaagtagaaataaatctttcagttattcaactgtagtacagaagtcacttaaattatatactggatttagtacattataaacatttgggggggaaagcatgaatgcaaataatccaccaaatggtactttacaaatgccatagaattttacaacataaagagattctagtagaccctgacacatcgtaagaatacactagatatagagaaatataatttgaaaagataaaaagtcaaaatcacaaagcctgcaaacttctaagggcttattcatgttcagttcattaacctgcaaaggcaagtttagtacattttgtcagcaagcttgtcaactagggtttatacttcaaatactgacactcaagtatcaatattcaactttgaggagaatcaaaaagttaagagaaagattaagaaaaaatggttcctgaaaaaaaattcattgatgggagctgaaatagctctaacaagcagcaatactatctatgttaatttcaagaactaaaatatgaactatctcaaaaaacctcataaagaaacaaatatgatttaacgataaaacacttaatctagacatttaaaatgaataatctggacatttaatctagacatttaaaatctagacttttaaaatgaataacaagtagcgctggctggacactggcctcacgcctgtaatcccagcactttgggaggccaaggtgggcagatcacctgaggtcaggagtttgggaccaggctggccaacatggtgaaaccctgtctctactaaaaattcaaaaattagctgggcatggtggcaggcgcctgtaatcccagctactccagaggctgaggcaggagaatcgcttgaacccgagaggcggaggttgcagtgagcagagattgcaccattgtactccagcctgggcaacaagaatgagacttcgtctcaaaaaaaaaaaatggctctatcaattcaaacaacttaatgtctatgtgagagctttcctatattccgcctgaggtacacagaagccatataggctacgcatcaattttcttttaccagttcattgctatagccactaaacctcgtctattaatcacaaagacacattaaaatgcactgttcggctaagcacagtggctcatgactgaaatcccagcactttgggaggccaaggtgggccagactgcttgagcccaggagttcaacaccaacctgggcaacatggtgaaaccccatctctacaaaaaatacaaaaagctgagtgagatggtgcgagcctgtagtcccagccactcaggaggctgaggtgggaggatcgattgagcctggggaggttgaggctgcagtgaggcatgatcatcctactgcacatccagcctgggtgacagagcagagcaagatcctgtctcaaacaaaaaaaaaagaactcttagattctgatagtttctcttcttgcctttataatcacacagtataatcagcttctgcaaattactattgttgaaagtttacttttcattattctgcttcattcatttagttatatgtgctcggctagggatatagcatggggaaaacaaatgaagaccctgctctcatatcacttatactcttgtctatctgaaagactctctgtcccaaaaaggatcttgcatggaaaaaaagtcatcttttagtaaatgaggattatgcaggctaacaaaagcataaatgaaatgtaaaaatattccaaagggttcatgagattccctcaactttgtttatattaggaaacagaaaaattaagttatttgagttgtagctcttctctttcaactcctaatctttggaaacctggaatagttttttattttttaaagttaaaaaagtataaagccctaagtttagaaataatttatataaaaaattagttgcaccctctcaagaacaagccaatattttcagtgctaatctcttcaaacagcaataaactatattatgtcctagtcagttcattagttttactgcaaatatatgacaagtaagctttctggtctgctatagcattttctttagctacagaagtgttaaaaatgctgtttattttaattatgtagtaaattcacaataaacattatgtatacatatattatgtatatgtgtgtatgtatatatatatatatatatatatacacacatacacacacatatatatatcctaattcagcagttttaatcaaaagacaaatatgcacttaagtctactaaaagaaataatcatgttagagagagagaacaccaagaataacctctacattttaatttgctggagaaataaatgcagccatacctggaaaaaatgcattaaattttaaaagcaaagtcattatttctaagttttataagtttattatcaatgcaagtttaaaaagaaaataaaatcacagagaggtacatgtttaaataccttatggtttcattttacacttctcatatcaggatgaagtcttaaaagtaattcaaaaggaaaatgaaagtatttgcccagacgatagagtccatatgttcttcaatctggaaatccattgggaaaaaggcttgagtttttaaaaactgaattttgacaattggaagctgatgtggctttttttccctctccaggaagatttgagtcattctcagagggaatgaaatagacctttatcaagtattgcaaagcttaacacctgtttaactccaaattacttagaaaacatttagttagtcttcagaatctcaaaataagggttgttataaacacttttcctaacagtaagatgttttttaagtttagcaagaaggcgtatctacatattcaagtctgtttatatttcatattctacagatatcaaccatcttgtaacagtctatttgttattactatacagattcctatataattttgttattcctaagattataagtaggctgtaattaaataactagttgaacatccatcataccattaggctccacaactgagggcagtctggttcttccccactgtttgtatgaatcccaagcttctagcacaagaagaagcaactagtatgcacttaaataaagcccatcaaaatgataaatatgtaccctactctgatcattctttcatagatctaaaatgaagctaacatattcaaagttaaaatgagtttgctctcaaaatcaaggtagaaaatagactggagttcttacaggagcctcagttttacacaacatagcacaaattggataacttgtgctccactactaatgtataaaattcctaaatgaatgtaatttaactacaaaaaatttattgtattcctattatgtaaaaagaaatttgctaaactatactgacatattaaatacctagattaaaaacgttaatgtttcgttaatggatcaaaaattacatcagagttaaagtaactacaatagtgtatttttaaaaaaaacatttctcaaaacatatacaaatggccaacaaacatatgaaaaaatgctcaacatcactaatcatcacagaaatgcaaattaaaaccacaatgagataccaccctactcctgcaagaatggccattattaaaaagtcaaaaaacagtagatgttggcatggatgtggtgaaaagggaatgcatatactctgctggtgggaatgtaaattaatacaacctctatggaaaactgtttggaaatttcttaaagaattaaaagtaggtctaccattcaatcaagcaatcacactactgggtatctatctgaagggaaatcagtcattacatcaaaaagacatctgcaagcatatgtttattgcagcacaattcacagctgcaaagatacggaatcaacctaagtgcccatcgaacaatgaatggataaagaaaatgtggtatgtatacaccatggaatactactcagccataaaaaagaatgaaataatgtcttttgcaacaacttggatggaggtgtaggccattattctaagagaagtaactgaggaatggaaaaccaaataccacatattctcacttataagtgggagctaagctacgagtacacaagggcacacagagtgatataatggactatggggactcagaaggggtaggaccagtggagaggcaaggaataacaacctccatattgggtacaatgtacactacttgggtgactagtgcactaaaatctcagacttcacctctatacaattcatccatgtaaccacttgtactccaaaagttgttgaaatgaaaaaaaaacttagagccacatattagttttgaaatttttttggagaaatttaattgtactctgctgtttgataaaaagtgctcaccagcaatcttatgttctggctcctttgcctccaacttctttcccttcttcggaaaaaaaaaaatgcaataaaataaaggataaagagtgcaaaagattttttaataagaactctcagtaaaagcaattgcatgaaaatggaaattactggcagtaagtggtctccaaacatctgctttgaaagatattttttataatgattcaaatgctctttttatacatgatctcccttatcatttaagctaatttttttaacttttaggagttgtatttttaaaaactgtgggcttcctatttttctttattcctcaacaaatgtttgtatattgtaagttgtgctctcatacatacttgttaaaaagcttaattatgtcactacataatagtactataaaagcaacacagtgtgaaaaacagcactagagtactagttagagcactagttagaacagcactagttctgattttataattaaatacctgttggatctttagcaaactcatataacctacttgggtctcagtctccttttcaataaaataaatgagctgaattaaataatctttacctccctaacaccttaaaagtgctaccattttgatatactacttaaaaaatatatttcatttttagttatactccatacacttgcctgtatgttcaaaatcattacttccagttcctcagaaatctcaaaaaatactgctgaaggaaatggaattaatttttactttcctattatgtatttctcttgggagtaaggaggacagaatgcaataaaatacaactatttgtgcagttgtgcgatgtcttagcttgtactgagggcaatgctgtatgcacccttttgatcaatgtaaagaaggtctagcatagataaacttccctacatggaaaccaaaacagttgggttgactttttctttctccttgccacctaaaactgtgggacatactagagatgaagaagtaagggtaaattaaacttttgtaagcatacaggaaagcaagcagcagcatgtttatttttctttaccctgttgaatgtcatgggctagaaagacactgaagttgtgaaggaagggaggcaacatgtttaaaaactcaataccaagttttataatgcaatggcctgtttagaatatttaaagatatggacatgagatgtactgagcacatgaaaataagtagaccatcaaaagagcagaaattatgaggaatttctaaaagacagatcatgtgtaactccagcactttgggaggctgaggcagaaggatcacttgagcctagaaggtcaagaccagtctaggcaatatatcaagatcccatctctacaaaagttataaaaagtagccacaatggtggcacattcttgtagtcccagttacttgagaggctaaagcaggaggatcattgtgcccaagagtttcatgctgcagtgagctacaattgtgccactgcacaccagcctgagcaacagaggaagaccctgtctataaaaaagaaaagaaatctagtaggatcaactggaaggtaaaatcccagacacatggaagataagtactcttccgggggaaaatgcgggagcttcagcctaaaggcaacagatggaaacggtgggtgaagacaacagtcacctaaatcaatcttttttttttttttttttttttttttttgagacggagtcttgctctttcaccaggccggagtgcagtggcactatctcggctcactgcaagctccgcctcctgggttcaggccattctcctgcctcagcctcctgagtagctgggactacaggcgcccgccaccgcgcccagctaatttgttgtatttttagtagagatggggtttcaccgtgttagccaggatggtctcgatctcctgacctcgtgatccacccgcctcggcctcccaaagtgttgggattacaggcgtgagccaccgcgcccggccaacaatcttaaggctgatttcctctctccccttcccttacttctgctgggctgcaagcaagattgcccacccttggctaaaggcatatgtactcttggattagaagaagggcagattcctagctagctactgatgaccaaaaagaataggaagcactgctggtagaagaccattactgacaaatctttcctggcggtacattcaaaccttgccccacaagggcattctgacagtatttaacaaaatttgtattgcaaataactccttttgacttagtgacttcacttctaggtatgtatcctaatagaaatgctcacacatattcattcagaaagatgaatctgacaagattgcagcacctctaaataaagaaaaattagaagccagctaaatgtccaccagtagaaaagctaaaataaactatatattttcatactattaaatagtatatgcctgttaaaaaataatgaggtagatatacataaaatagcattgaatataagaaaaaagttagtagctaatatactatacacagcatagccacatttatatttttaaaatagtgtgtttataaatgcaaaagaggaaaccagaagactatacatcaaactatttacctcctcaccactaggagactttctgggtagggataagtactaaagagaattttcacataataattgaatattttacaatgagaatgcatttctatataccccttatacttgaaaaagaaaaaaaaatcttgccaatttgaatcgtgaactgagaagaatgttccccacctagataagaaaattttatacaatttatctaacaaaaattttaaaataatatccacagcactctattttttattttatgttattattattatactttaagttttagggtacatgtgcacaatgtgcaggttagttacatatgtatacatgtgccatgctggtgtgccacagcactctattaactttagtatgttatagataactgaactaccctctaccacaacatacacataccaaaaaggtacaaactatatgaacagattacattattgttttcatttcgtaaacatattcaagtaaaatgtttttaaaatctatttctttttaaaatttaaatgtcattcatgcaaatacttgttttgtgacaactatgaactaactgcattctcatggtttcctagcacaataacaagaaatatacatgtttgaaaccctgactgttgctcaaacaatttgaattcagaatatgaaaatgcagtcattcactgcctttcctctgtataacaatgccaaaccctacctccctatcaaaaaaaaaaaaaaaattgaaacccaggctgggcaatggagtgagagactctgtctcaaaataaaaataaaaataaaaataaaatccccacaaacacaaacactattcccttttcactcatacaagggcttatgtgtttcccttctctaagttctgctttctcctgtcagaattctattctctcccttgtcactatatgaacaggaaaaacatatcaaacctaaagttatccaaagagaagaaaaatttctaccataatcttgaacaacaaatgtgtttaaatattgtttagtagaattttatactaatgtttatacatgtttataaactacacatatttatacaactaatgcgtatataaaaataaattttaattaaaactagataaaggaattaaaaatgtcagatccacaaaaaaagcatgtgatgtaaagcatatctttactcaattttgccactccacattgtatatatatttcaaaacattatattgtacataaatatgtacaacttttgtcaattaaaagtaattaaggtttttaaaatgtcaaacacattttttaacttacaagtttttagataacaaagaatacaataataattcaaacagatgatcctgaagtgattttcagaaagaaacactcattttatattggattgtttggctttttctatctatttataagagctctttgtagtcaaggaaaataactagaaaataggtttttggaagacacaaattgaaaaatgtatgttaatactttagaacaattaccaggagtaggaaatagtgggtgagaagtgctattactttagaacaattaccaggagtaggaaatagtgggtgagaagtgctatgtcaagtatggaatgtgtcgaaatctccagaagaggttttctaactataaaggccacttgatcccccacaatcaccttttgaaatctactacaagcaaatttaccaagagatatacatcatacaagtgaccagagtggaggcagtgtggatgccaactactgcttttagactacaggtgactgataaaataaagccgtatcttcaaagctttttcaaggagcaggcagaattatattttatctcaaatgagcaaaaagtaacatttttagaatagcagaaaatctccaagttatctaaaattatttgtaaaatattatatgcagctatgctcaatatcttaatctaacttgaaaacctgctccactgttcacaaacaatcttgggtttcacagaaagagatattataatttaacacagtgcctctcaatcttgcatgagcattagatttacctgggaagctttataaaaatattcatgcccaatcagcatctcttgtggtggaatcctggtaccgagattatatatatatatatatataattattattattttttttttgagacagtttcgctctttgttgcccaggctggagtgcagtggcgcaagctcagctcactgcaacctccacctcccgggttagagtgattctcctgtctcagcctgccgagtagctgggattacaggcacccaccaccacacccggctaatttttgtatttttagtagagacagggtttcgccatgttggccaggctggtcttgaactcctgacctcagccccccaaagtgctgagattacaggtgtgagccacagtccttggccggatatattttttttttttggaagctttccatgggattctaatgtctagccaggatgaaaaaacaattggattaatcaaacgaactggcctggatgctatatattcgtctttgatttttctatgctactgagcagctgtggaaacttgggtatttaacacaatattctgcatcttaattctctcactctgtagtatgaactgacctggcttaacatgatgcccagggatccttttggctttaaagttgtttgattagacccttcaaaactggcacctacatttaacatctaaaaagtgcttcaaataaaagttaaacctcataacatatatactaaaattttacagttaaggttttccacatttgcaaatcccatgtgcagaactgtatttatcaaaataagttttaatagcttgttattaagatgttgttactatgtgtttatcaatacaacattaattcctatgaaatcctatccttcactgaaaaatatgaagtcatcttcatactctaggggtacattttcagtatcacataccattaagagttattctttgtggtaacatatatcaagaaaaaaacaaaaaagaagagactgtagtttttatgtaaagggttttcatcaaaaccaataactaatttatagaaaaaaatggcactagactttagaaattaaatacatatgtaaagaagtattcatttaaaaagccatttttaacaaattaagatttcactgccacatattagataagatttaaattgcttctgtttaaacacttggaaatgggattaccattagaagagcaagaaaaccttaattccgtatcaaaaactttaattaaagctatataacttgtgattaattacttatatttgattcaaattgaaagacaatacattcttttttaaaagataatattctttttttaaaacagtaactcacttcttctaaaatcatacatacatcaagatggcaacacttatgttaatgtaaaataatcacctttcatttatcagaacatattggcaagggcaaatttttcagtcatatagttttgtaaaacaaaatgtaagtttatgctcaacatctcatattagccttaggaaaacaaatctgaaaaaaaactaaagcacattttaaagctacatacaagtcattttgggctgctcagtattcctggtcctatttcaacaaaacacaaaatgagagcctgactgtgtgctgaaaattaataagtatgcaaataataaaacttcaatataatattctaaggtactcctgactgtgtgctgaaaattaataagtatgcaaataacaaaacttcaatataatattctaaggtactttgacaaaaaaattctacaataaatgacatataacaaggcttaacttagttctatttttatggtataaatgttaaatcattattagtataaacacaagggtagttaatcttgaaaatattttctatagaacatcacttgaattttgaattattttcaaacatgactttaaaattaaggtcaaaattagcaatctaaaatactgtaattaaaagaaagcaaattcccaaaactaaatagaaagtatattcagccctcataagacatatgaaatatttacataataatatgtaagatatatttcttgttgcaacaaattatgcaaggttggaattagtcttgatgcaaaatgatattaccaattcttttcaaatattacagttcttacattccttttacatttccaaatcataagactacttaatagatgtaaaaatataaagtactggaatgtcttttttgccctaatatttaggaagaaaagagaattctaaggaataaaacattcagttaaaaatatgtttccccttctactttgaccctctttgaagtcaacttttcaaggtccattatcagatggaatgcagtagtaaagattttatgacactatactaaatttttattatttcattgagaaaaattgtaataataaaaaggattaagatctatttcctttttcgccatgttaagcttttaagctttttttgctttcatcaattccaatataccataaatcaaaagtattcttcttttaatcccaacagttgacaaaataatgcattttacacttgaatatgctcaaggaaaaaaattaacattctttatcatttcccaacagagacagttaatactctaaggccacattaatagaatctttctgccattgtagaaagtttgatagcactcctatttcaatgtctgaatttttctcctttttttgacaaagacaaatgattgccatcaatcaagatccaatcgggtatagagagagtcaggcaaatgcatcactctttactggttttcttgttatttgagcaggctttgctccatattattttatagaatgatcaaaaaacagccataagatagatcattcacacccactgtaaaattaactttcacgaataatgagttttaaacctcagataatgtatatgttataccaacgatattactgagttcattcctggctagagattatgtaaatgataccatatgacctttatcattacaacaggacatgcaaaacacatattatttcatacatcattttaaagcaagtcagtttctaaaggaaaaatcatcatttataatctgcatggtgaagtgttaaagttttgaaagaaagaagtatctctgaaccatgagtccttcttttaacctgttacttccattgaacataaggcaataaaacctactagttcaaaaagatgtacttgatttctgtatttctttgttgagctactgttaatgtcatttcaaaaactcatatcatgttggctaatcaacactaagttttaaatggataacaagtattaatatacacttctaagtcattcctctcaaaatttttgctgttgtttttgagaaagggtctctgtcacccaagcttgactgtagtggcttgatgatagctcagtgtagcctcaaactcttgggctcaaatgatcctcctgcctcatcccccaggcaactgggactacagctcaatgtcaccacagctgttttgtttttgtttttgttcttttgtagagaccagatctcactatattgcccaggctggtctcaaacttctggtctcaagcaatcctcctgcctcagcctcactacgtgctgagattacagttgtggtccactgcatccagcctcaaaatgtcaatgtaatgggttaaggaagtaaaggaaaacattccaatactgtttctttagaactatattctgccaatcttaaaatactaaaaatgtaagtataaactacaacggcccaccaattataaaatagctcctttttttaaaggtataggccaggaacagtggctcatgcctgtaatcccagcactctgggaggccaaagcaggtggatcacttgaggtcaggagttcgagaccagcctggccaacatggtgaaaccccacctctactaaaaatacaaaaattagcagggcatggtggcacatgcctgtagtcccagctacttgggaggctgaggcaggaagatcacttgaacccaggaggcgaaggttgcagtgagccaaggtcacactactgtactacagcctgggtggtgacagagcaagaccctgtgtaaacaaaataaaacaataaaaaggtatataaagaaatacatattgcaagccaggcatggtggctcacgcctgtaatcccagcactttgggaggccgagctgcatggattgcctgaagtcaggagttccagaccagcctggccaacatgatgaaactccatctctactaaaaatacaaaaaattagctacgcatggtggtgggcacctgtaatcccagctacttgtgaggctgaggcaagagaatcacttgaaccctggaggcggaggttgcagtagccaaggccacgacattgcactccagccagggcaacaagagcaaaactcagtatcaaaaaacaacaacaacaacaaaaacatattgcaaacccagctcccttctgttgtaattccacccccatcatgttgacacagttatccacagaatcacccaagcacaaagcctgtatatcatctttgaaccctccctctccttaagcttcttacaatgaactttcaattgttttttcctaaataattttcaatccatgcccactaccacagttctgccatatctcatgcctagtctactgttattataacacctatgatttcactattggcagtgtttttcttcttcaaatctataatcaaaaagaactaccagaatgatctatcctaaaaagatgtgttgacatcaatagtttactccacaaatttcaatagcactacatcccttacagcagcgatgcccaaaggggatacataacataattcatctggatgttggaagataattgcagagaaaaaagtcagaaattgagctttattaatatttaatatatagtttaattctggcatccttattcagtctgaatatcagtaatcatgtcatatgtgatatgcaattttctcatattaacacatactgtagtttatgtctacttaaacaggtttacagattacactgttttaaacaaatacagtatttagaatactttgcaataagataaaaagtgaccagaaattacctaataatggttgaatagtatgataatactcaattatcttaaaaagccaattattccaaatttgctaaacttttctgtggcagtgcactgcaacaagctctgaaacagctatttgaaaataaacacataaaatatatacctttaacataaaggtagcattttaactctaaggtaactaccttagaaaaacatactatggaaagagatgtttagaaatatttccatcattatgtgatttttgttgcctaaaactatcttaaccacctataaaaactcttaaatttgtattttaattaaaacaaattagaaacagtgtcataacctagtgtgtcaatgggttttgtacaaacataatgtctgtaaaaacattaaaatattaatacaaatatttgaagagaaccaagagttttgtaaagttagatagtccttaaaatattttctttggctttattttatcctttaatttctcctagaaatagtggcaatattcaacacttgctttaaagatttcagagtttagactattcttgatctttaaaaaaaaaaaagtaaatgcagagaggataatattatctatcttataaggtaatttaacaagatatatggacttagtaaagggatctctaactagtaacattaagttgctgctgctactactaccattcctaacatttttattagtatgtagtacaccaaaaaagggacttgtttctcggaatgagagtataaaacattaggagtaatttatgagaaaattggagtggaaggcatccaatttaggaacatgttaagttatataggaaaaattgatttatcattttgaagcaaaccacaagaccctctgcatgaatggcatatatgaaaatgttttaagatgagaataaattgtcttaaatttcgatatgtattacataatcaccttccaaaaatgtaccagcaatatactcttccatatgagaatgtgtatatcccaaatgtcattaacactgagttaatactggccttattaatctttaccaaacttacaggtgagggatatgaaagagaggagactgttgaatatgaatccaaggttttaagttagattccaatactgatgccattaataaaaacagaaaacaccggaaggaggagagacttgcaaacagagatgaatttagttgggacatgttgagtttgaggggccagaagtacatccacatggaaaaatcaaaaaggttctgaaaacagagatgtggaactaagaagagaggtaaagatcagagtgttgatttgagattcctgtatagaagtgatggttgggctgggcgtggtggctcaagcctataatcccagcactttgggaggccaaggcgggtagatcatttgaggtcgggagtgtgaaaccagcctggccaacatgttgaaaccccttctctactaaaaatacaaaaattagccaggcatggtggcaggcacctgtaatcccagctacttgggaggctgaggcaggagaattgcttgagcccaggaggcagaggttgcagtgagcagagatcatgccattgcactccagcctgggagacagagtgagactctgtctcaaggaaaaaaaaaaaaaaaagtgatggctgaggtgctagcagagattaggatcacaaaagaactaatttagaaaaagaaaaataccagcaacagaatttttctgggacaactctaaatagcagaattaggcaaaagcaagctccaaggacacaatgctcatcttgctaatccctgttacagtgatgcctggcaaagagccttgctcagagtaggtattcaataaaaacttgttgcatgcactatttaataattaataagagacagagtcatcagaacaaaagagaactagaagcaaacaagtcaaataagatttttttaaaaattagacaccattaggcttggtgctcccaaaaacattattcaaccacaatgaactactttccatcccatgggcttatcctagctctcctcctatctctctctcatgtgtactctctcatgttgcccctgtcctgtggcatcttccccaccaaccatgtttcaccctatctgcctgctaccaattatcatccaacaactaagtctcagcttagatgtcagctcctacaggtaattttgatctcagcaatttatacttgctgcatcatagcagttattcaactactttatcattgcctgtttatatttttccccctccaagtctataagctctgtagtttttatacctaatcatcttagccactaagttagagtttctttctaggccattccttttctcaccctatattctctcatcctatgatctcatccaaacttttggctataattacccacatgtatgtgaactccaaaatttatatacccagcgaaaatctccttttgagttctagagccatatatctaaatgtttacttgctatatagtttagcagttaagaacatgaaatcaaacacagtatttttaaattctgggtttgccagttattagctatgttattagctgtgtgaacaagacatttaacatctctgtacttcaactgccttacctataaaatgagaataacaataaaaagagaacctaattcataaggttgttgggcagattatataaaacaatatttaaagtgcttacaatagtgctttgcatataagaaatacttcttgagtgctaaatattgtaataatgttaattcagtgaaggcagtgattttcatttcttttgttcactgtctaatccccaaatctttagacaatggctgacacactactgaatagttgttgaataaatgaatgaataaatccatctcaatttcaacacagtcaaaaccaaattaatgaccttccccacaattagtccccttcaatgtgaaaggcatcgtagttcatccagttgtgcaagtctacacaatctttgttctacacactgcagtcagggggttctcagagcataacactaatcatgttccccatcctttccatcataaaatctttatggctccttattcctctttagaaaagcacccaatatggccataaggcctcgtgtaatctggctactatcaatatctccacagtacacacatccactcactatccacgttccagctatataacctttcttctggtccttgtactcaggcttcttgtttaaatacctctgctggtcggatgcggtggctcacacctgtaatcccagcactttgggaggccgaggtgggtggatcacctgaggtcaggagttcgagactagcctggccaacatagtgaaaccccatctctactaaaaatacaaaaattagttgggcgtggtggcgggtgcctgtaattccagttactcggatggctgagccaggaaaatcacctgaaaccaggaggcagaggttgcagtgaaccaagatcgcaccattgcactccagcctgggtgacaagagcaaaactccatctctgaatggagttttcccgtcttcatctagctacctcctactaactcttcaaattccaattgaattgttacttcaaagataacttaccagagctctttaactagatatcaattgaaggcattcatcattcagttttgtcattcttcatagcattttcacaacagtaaatttgtatctgttttataatattaatagctgtctctccttctggataatgaaatctatgtaaactgggaacatgtccacttctgtttattatgggagctctgaggcatagcatagtgactggcacataacaggtgaatattcactgactattcaatcaataagataaaagccaattaaatttttttatcttattcaatgaacaagataaaattcaagtaaccataggatttaaggaagcagtatgaatagggatgaagaaggtaactataaattcaattcatgacgtccatttgaacagtaataagctatcccacacaatactattgtgaaggatctgacactacctgttcatatatttcttctttgcattcttttttcagattccagaatatagtctcacctgtttttctccctcattttcctttctgaatcttggcttctgttctgcagtggacaggcatttgcaaacatacccctaaaggtggaggaagctaactgaccaaacaaagaggctgataaatacagtttctcagaaagaaacatttaatagggacttaaaacagaagccgtagtcttaagcagtcataagactctagagggtggatccctgcaccactgccccctagacccagggcgtatataccatagagaaagaatgtgtaggacaattgaagttgacctctcagggaaaggcaagcatgctatgtgaatctgcctaagcgggggatttatgatcaaggttgtttggacctggggcaggatttatggtaacaatagataaaagtagaaatcttagaggcatttccagaacagaggttaatcagaagtcaacatggcagattagcatccgagacggagtttctttagcctccacagcttctctacttttcctttcaaattctgctcctagattctaccataaggctgtttttcttacaaaccaggaatatcagcatgactcctgcaactaaaaccatcacctatgtgacaatggtaccaaatctcaactctttactccagatttttctcataagactgcgttttcaaactgtttaataacatttccattttgcttacccaaatatatgttaatgtgtcccaatattaaaaacagtatcctatttctaacttgttccttcttctatatttccataccactatcattattctctccaccattttccctctctgcctctaacacataacacccccaaccatctctcttcttcctaccagggtttgtctttcatctccacaggttttaaggcttgttgtatatgaacttgttaaattcttatggagagggcaaaccttatttctttttttattttgaaaatgtttcaaatttgtagaaaagtggaaaatggtaacatgatgccccattgacaacagatactttctataaacaaggactttgttctacataataataatataactgaaagtcaggaaactaaaactgatacattattaccttccgattttaagcaccactcaaattttactaattaccccagtaatccttatagcaagatgacacagctgagaatcatgtctggcattgagttattatgtctctttattctctaacaatctggcagaatagttctatagtctttcctgaaattttaagacactgacatttagatgattacaggtcaattattttgtagaatgtccctcaatttgggtttaactcatatttcttctacatttcttctacatgattagactcagactaggcactctgggcatatcacagagtgatactatgatcttcttaatagatatagcctaaaaggaagcacatggtttcagtttctctaattactaatgatgtccattttgatcacttgatgacatggtacctaccaagcttttttttttttttttttttacgtgaattactctttctccctttgtaattaatgaatattttttgaggaggtactttggaactatgcaaattttctgatcttcatcaaactttccatttgttcatttatttatattagtatgatcttctattttattcaacggattataatttattgctatctattagataatattatctattttgacgtttgactgttcactgatttggccagtgggattcttttcaagctgattctttttccttcttacatgtctccatcattctttgagcacttctttacattctagcacaaaaaggtgctatgagctcatcttatagtttccctgccacagtcctggaagtagccattgctccacagagccctggtttcaatggagaagatcaaggctttaggtgcattcattgctaccaggatgtcactattcccaggccccctcagtggacaaagctaggaaatatatccagctgggcacgatggctcatgcccgtaatcccagtactttattgcccagctggagtgcagtgacacaatcacgattcactgcagcctcagcctcctaggctcaagcgatccttctgcctcagcctcccaagtaattggcaccacagacatgcactactacacctggctaatttttaaattttgtataaagatgaagtattacttttgttgctcaggctggtctcaaacttctgaattcaagcaatcctccacctctgcctcccaaaatgctgggattacaggcgtgaactatcacacctggcttaagtttattttttgatgccaataatatgtctagaagggactagactaaaacattaacagtggcttggaaaggatggtgtgattaaaggtaattttttgttcttcttttcatcttacgtgtatttatattttctacagtaaaaatatattattctcataattatataataaatacctgtaggaagcatatggatctctgacattagtaatgaagttgaattattccttctaaaaaaaaaatctaagctttccacatcgtgttacagtggtacattggcaagtatcagtttgccacaaaaaactggggtttattttgggattatctgttctgttccattgatctatacagctatcctatactaatagcatggtgtcttaattactgtatctttaagttttggaattaggtagtgtatatactgaattttgttgtgctttttcaacattgtttcggctgttgtgacagacagctccaacatagcccgtaaatgctccctgcctcctagtgttcatggtcttgacaatccctccttgagtaatttgcttctaaccaatgaaatatggcaacatcaaggggatgtcactccaaaaattaggttacaaatgactgtgatgtccattttgctagatgactcctctctcttgatggctttgatgaagcaagtaagccaccatactggagaagtccctgtggcaaagaactcagggccttagtccaagagccctcaaaggattaaattctgacaacttcataagtgaacttgaaagtggatacttcccagttgagccttcagatgagaacccagcctgcggacaccttgactaaagccatatcagagatggtgggccagaggaaacagctaaatagtgcctggattcttgacccattgcactatgaaataataagtgcatgacgtgttaagctgttaagctttagagtgatttgtaacaaagcaacagattactaatgcagctcttctgggacctttgtatttccatttatcttttgggttccgactaccaatttctattaaaaaaattctgaaacttacataggggattatattgaatctatagatcagtttggggcatactagcatcctacattatactgcataatattctatttgtttacaatttctttaattattttttttttttgcaacctctgcctcctgggttcaagcaattctcctgcctcagcctcccgaaaagctgggattacaggcaagcaccgctatgcctggctaatgttatctttagtagagacaggttttcaccatgttggccaggctggtcttgaactcctgacctcgtgatccacccgcctcagcctaccaaagcgctgggattacaggcgtaagccaccacgcccggccaacttctttaattattatcaatttctctttaatttctctcagtaaagctttatagttttcagtgtaccaacattatacttcctggtattttattctttttgttggcttaaagatttctcacctatatttatgagggacctcatttacttttaacaataaaatgctattttcaagaacacaaaactggggttcagagaatacttaagaacacataaggacatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacgatgagatcacacggacacaggaaggggaatatcacactctggggactgtggtggggtaggggaaggggggaggggggagggatagcattgggagataaacctaatgctagatgacgagttagtgggtgcagtgcaccagcatggcacatgtatacatatgtaactaacctgcacaatgtgcacatgtaccctaaaacttaaagtataataaaaaaaaaaaagaaaaaaaaaaacaaagaaaaaaaagaacacataagcaaaacgtgggaataatgagatctaaattaatctatctaaaaataatgcactttctaccccacccgtggtactcaacagattcagaactgttccctagagtgaataatagaaatctgcaaggaaagttttggttgtcacaaatgactgagtgctacaatgatttagtgggcagaaggagcaaaaaaaaaaaaaaaaaaaattctagacattccacaagaagaatagttcaataataataatggtcctagatcctacattactttagaatgttctactgtatatcagtgaaagtgacaaactagaagataatctgagcctatgccccaaatatatatatatatatatatatatatatatatatatatatatatatgtgtgtgtgtatatatatatatatgtgtgtgtgtgtgtatatatatatatatatatatatatatatatatatatatatatatatatatatttagatggagtttcgctcttgctgcccaggctggagtgtaatggtatgatctctgctcactgcaacctccccctcccgggttcaagcgattcttttgcctcagcctcccaagtagctgggattacaggtgcctgccaccatgcccaactaattttttgtatttttagtagagatgggatttcactatgttagccaggctggtcttgaactcctgacctaggcaatcgacccgccttggcctcccaaaatgctgggaatacaggcatgagccaccacgcccggccccaatttatttttaatttcaaaaaatgcaatcattgtgtaaagtaaggtaaaaatgaatgttgtctgcttagtactacaccagtatctattcaccacttagaaaaatcacattatagacaatcacacatcccttgtagcaggacaaatcatacatcatacctctatcagtctgatttgtacctgtcacattcacagtgacctatatataaatacaagcatccaattatgtcttttagcatagttatgttcgtacttatggaacaatgaaatgcatactacatatatttttaaatattttatttctcttgttatggtatagagcactgttgattaatattatttatctagaaaaggtctatttactattcaaaaataaaactcatagataaggaataattgcaaactacctgtgatataaagagcatgttaaatttcagagggtgaagaactatagcattacattatgctacctcctaaatatatctcctgctcaccataatttctggcactgccatagttaatactccttttatctctggtctagtgtcttttgacagcctcctatctagtctccatcacttgaacttcccatccaatataatttacttattgtcgaaatgttactgcttttcctttaaaaaaaattattatccaggatataaaataggatcaagatacttaagttcctactatcctacagaaaaattccaaattctccaccatggcatttaggatcgcttatgacctgcttttatctgtttctagatttgtctacaaccactctctatcacatattatatgtctaaaccatgctttctggactttctcaaaattttcatattttctcatggcaatgccttgcatcacctactccctattctaccatgacttcccatcatcattcctgtccccatcttttgtccgtctggaattcacatactgtgtgacatcctactctagaccctcctcaaatctatgtcctatttcacagagatccaaaagcttacattcagactttttaccatacacatttcgcagtaatataattaattatatgcttaacattcccatgaatcctcaatatcctcaaaatgtaataagaaatttttatattccctaacaatttttatcattggtttttcatatttgttgattcaatgaatatttaactaattttccactctcttcatattctaactttcttttctgaaattctagacattaattacatatatctaaatacataatggcatcaaattctaatttactccacaaaaacacaggaatcacaactcttctaaatatgtcatgatggaaataatgtagtcagtcttgacattcatttctttattaagcagaatctcagcatctttcacacagttaaaataggagaataaatttgcaaataaggtttcatttgcctattttcttttttttctttgcagcaaaaagattaaaaacattttagcccttcaatgtttaagttcaagtggaactatctaaacatcacatcaatcaatacctttatatgttcttctttatatgcacaagggcaagaattagtttaggggtataggagttggttacagtcattatgctctaatgtggcaaacattagtgtcaatttaagtaaactctaaagggttatgaggtcaaaatgcaagactgcataatttatcagatcaagcaaatcactttgaaagtacagaaataagtgaagcatgaggctattactgcctctcatgaataaaggttaataccaatgtttatttattacacactggatggtatttgctatctaaactttatttattaaaataagtattttgctacactgtcatattttaaactactgagtcaaatttaatttacagcactgtcttatactaatacaattaatacagtattctaagttttaaacaaaaaattgaaattgctttggacattttgattagtaaaatatgttacctgtaaaatatgaaatctcacttttgcatcaagacacaccaatgagcaattcaaaagcacaagaatacattcatatgtaaattctgcatgtatttcaaagttgtggtttattatttgttcttgttgtttggtatttctacatagtattttcttatgcacaaaaaatagaaagttgcgggagaatggtataacatactaggccatcaaaaaaagaaagataaagataagcttttaaaattagttgttactctttcttttatgaaagaaaagaatggtattttggttttccataaattaatactaaaatattcatattccattttctaaggtaaacagtaacatgtgaaatgatgtaatagacataatagctgtgaagagtacaggaaaatatattaataggaaagaaatgttacttttccagaacaaatcttaaatgaaatggtgtaattagatgaagggttatgtgaaacatggcaatatacacaagcaaaatcacaatgcagatcaattctgttacttttacattttactctgcatataatatattgaaaaatattatttaatctaaattcaataagatatcaagatttcctcaaaatcaatgttttgtagtcaaatcaactcaaataaaacttcacagttataagacagataattaaactgtattgaagtagatgttttatatagcaaatgttgtttattatggttacaaacacacacataaggaggcaaaagaattactctcaaagaaaaaatgttcaaattctaaagcattggaatagaaaaatgtaatgttatattcgcatcattattgaaatgtagctttaacatgacacttaaaaaaattaatattctagtgatttgtgcaggacctgtatctttcatttaacccacataaaaattttgtacatagactctcttgaagggaaatttaaagttccccctattttatccatttcaaccaacataaagatttcaaataacaacttcaacgcacaagtagtccaattccaggctgggcatatctaaatgaagaaaaaaattgatctgtcatgaataaccattccattttaggaaaatgcagaccattagagttcatttatttattccacaaatatgtactgaatatctaccatatgccaagcactaaggagacaccagtaaacagaagaaattagcaatcaaagaaaaaattaatttataataaaatgtcataaaaagtattatgaaaaaataactttaccatgttaatgcaggctaagagatagtgatggaggcacatagatgataagaaaaggctgacataggaaagtaggtggaagaagaatgggcaaagatgacatgtgagtaaataacctgtatgaagaggatatgtaagctatattgacatttggacaaaaatgctgcatgcatgaagaacatgtgcagaagttctaatacaggagcatggtatgtttactcaagtaatagcaagcagtccagtgttgtcagagcaaaatgatctagtgctcatctaagatcagatcatccagggctttgtacatttcaaaaagatagtttagctgtaatataggataaagagataaaagtggcattaggaaagtaagaatcagcaaactgttgctgcatagcctatgagctaagaatggattgtaaattcataaataattggaaaaaaagatatttcatgatgtgaaaattatataaaattcatatctaagcttccatgaataaatttttattggaacagagccatactcatttgtctaggtactatctgctggttttgcactacaaaagcagagtacgtggtgctctcatcacttagcactgatgctcagcacatttcagatcatactaatgtagctatagatgaccgtgtttcaaatgtcacacatatagccataccacattttatttttattttcttattaccagtgtgtacccatggtattaaaacataaaaaagagaaacgtagactttaaataacatgtttttaaaggcatagtggagtctgaattattttgttttagaattaaatgttaaagcatttttgtttagtatgcagtaacacgatagctagtgattttaaaatataatacacatcaatattaccaaacaaagcactcattataatattgctaatgcataggaatgcagcagtgaaaaacttagaaaatttaaaacaaattatctcatcaaaacagaatctcttcagaaaaattaaaaatgaaaataaggctgcaattaaagcaagcttctgagtgattcttttgttagtcaagcaaaaaaagtcatttacagatggtaagttaattaaactgagtttcatttgacagccaaagaactgtatccagagaaaacaaaattgtttaagaatattatagcctttcagtgaaaacagttgcttaaggagttgaggacattgaagcaaaatcaatagacaattaaaaataaataaataaagcaaatgattccaaatggttttccttggctcttgatgagatcacagatgttacctacataatgttccattgttgtttattcaaggagtaaatgactattttgaagtgattgaaaaacgagcctctgaataatctgcatggaataactatacggatgattttttcaaagttgagaaaacaaaaatttagtaccatctgaagtggaatctgctaggatgtcttataacaaatggtgttaaaagtatgtatgggggagaaaattgaacaacttacaaagtttgtgaaaatatacggtatttaaagcataagcttagtcactgtatcactcagtactctgtattactcaggtaccctgcaaaaaatattggaatttatcatgttttatcgaaccaggagtgtcatggtgaacttcattcacttttttttcatggtcttaaccaatgtcatttccatgcatttttctcagaaatacaagtggaatatactaacttgctcttccacacagcaattcaaaaaaaagtttttttttcttgagatcctgtctcaagaaaaaaaaaaatcttaacagtggtaaggttttattatgattttccgctaagggcatagactgatttttttttttttctgagaaaaaaataactactattatcacacactaaatggttttagaaattagcttttactgaagacataataatgtttcttaataaattccatctaaattacaaggcaaaacagcccatatatgggaaatttacactgcagtaaagtcatttagatgacaacactgtttgaatcacaagtaatatgaagttactttatatacttttctgtgctattaaaagttaaaaagaagtgagattgtcattgtcatacaaatttgcagctaatacattttccagctcaaacttcaatcccagaagtatttttcagatactgatgcaagggcaaaggaaattcccatatttcaaaatccatttaaatgtggtactgcggagcttctactcaaatatcaattgcaactaattaacctataatgtaacggtatgctaaaaggcaaaatcaagagaaaaatctaacaattatataaatgccttccaagagataaacatgctcaattaacatcccatgtccatagatggacattaataattgacaatatttatctgtgtgaaaacatattttaaaagatgaaatccataaaatattatagatcatattaacaggtgaatatttgccatctattttgatgacaggcaacagtaactatgaaccccaattaagtaaaatgttacccgcccccctcccaagaaaaagaaattcttctcattagaaaacccattacagaaaattgtactcaatagatatattttaaattttatcaataaaaatatattaaaatttgctttctgtcttgttacacaggtatttatataatatcctttatcttgccttttgacccaaaaatctaaaatatttactatctggcccattatagaaaaagttttacaatctctgatataagaaaataatgatttttctctagaccaggcaaagcagatgatgggaaatgtccagattctggctatatttttatggtagaaccaataaaatttcctgacatattgtggggtatataagaaagagtgaagacaaagatgacttcagggttttagcatgagcaacgagaaggataaataacagttattgccatgaactgaaactggaaaggctatggatgaataggctggagagtggttcagtattgacatgttaagtttaataaatctaccaaacagaagtggtttaggccaattagatacagaaatctggaattcaggagaggttatcttagcataagatacaaatttgggagtcactggccaataggcggtttttgaaacgttggaaatgaatgagatcacaagggatacttggtaaataaataaatgtcctgagaactgagtatcagggcactaaaacattcaccatttgggaaggtaaggttgatcaggcgaagtcaacagggtgtggaacaatgtctaatcaggtaggacattatgctatcttgaagcaagataaccaaagtgttagcagaaggagaaaatgatcaactgtgtcatatgtcaatagataagcatactcactataggttgcacataccaaattcaaaaatctggaatttgaaatgctaaaaaatccaaaatttttgagcacagacataacatgcaaaagaaatgctcattggagcatttcggacttttggattaggaatgtttgagcggtaagtataatacaaatattccaaaatatgaaaaaaatatgaaatctgaaacacttctggttccaagcatttcagaaaagagatattcagtgtgtatgtgtttatataaagcatagacagtagtgattaacagaacgaagaacatggtcctgaagcaccagaaatgtttctcctttaatctactaatcagtaaaactaatattttagtaaaaatcaggattttagtagtggtgctcctgttcatatttttccatcacatataataaggacagttctggaaaccttgtcaaatgccttgcagaatatgtcaatatgtgtatatcaagaattaaatgttcatattttttaacttagtcattctatttctgggactatagcctgaaaaaaaaataagctaaagtaggaaaatgctttatgactaaagataaaaacctttttccagattatatctgtaaaaagtaaaatgattactttttctttttttttttttttttttttttgagacagggtctcatgctgttgcctagactagagtgtgcaaggcataattattgctcactgtaacctcaacctcctgggctcaaataatcctcctacctcagcctctgtagtagcagggaccacaggtgcataccaacacacctagtagcagggaccacaggtgcataccaacatacccagctaatttttttaaattatgtgttgtagagacagggtctccctatgttgcccaggctggtcttgaactcctgggctcaagcaattttcccacctccttaaatgctgggattacaggcatgagccaccacactcagctcttactttatgctttacactgaacaactcaaagttccttaaagatgtgatgctgaattgttttcctggcaccacactctcagcctaactaaaaagttagtcattactttcaaagacccctccataatcgagatatttatctacatctattattgtggtttatcatattatatcagacatattattaatacgtctttctcatctattgtaagtatccttcctgagagcagggccctgtgcctagcagagtgtgaggttcaataaatgtttactatattcaattatccagtgagtaacttgtaattcaatgttctgagaatagcaggtatttttgctttgtttaggacataaggcaaatgtagagaagtaatagaaaataaagagatacccaagcagcatcaacatttatgagctaggagaaagaaggaggcagtgaggacatcagaagagaaaggaacacaagtagcaaaaaaaaaaaaaaaaaaactagaaaagagcgagatgtgccagaaaccagtggaacaaaataacttgacaaggaagtggtctacacaaacaaatatcataaataaacaaaaattgtaatacagtggttttgacaaagaagagctcacaagacctctgccagagcagtttctggcagacagcaagaggctgacggatgaacaggttgaggccgcagaaagttcaagatctaagaaacctgactgaaggagaaaaaaagagagactatgcagcagactactgttatttagtggttgtacaggaactctacttaaatatcacaggatatttaactacctggattccaacaataaaagtctgcaagctttccagtcattgtgacaatcaaaaacatgcccccccaccccacatttctaaattaccccagaaaggatagagtactgcctctgattgagaacccttaaatgccaactcatgctaaaacaggagtctctttcccatgagattgtttttatggtttaagatgaagcttattagcattttagaaaacgttggcaatacagttacaggggacagtaagtttggggacaatgccaagtagttgagggagctgaaacagagccacgaggcctctattttttcagagatgagttctgctgagagtatccatcacactatagtttcaagtacaacttcctactttcctccacataatcaaatttcttaaaagagatcttctctcttactcctctttagtaatcactcactcattccctaaacctttataatctggcccccactttctccatgctaccaaaacagttctatgataaccagtaccttcttggttccaaatctaaggcccttttcttagacaattttgcttctgatcaccttatagcattggtcactgctccttcttaagaccacttcttctcccaccactgtcctagtttgggcacttgttatctcttaaactataaaatacctctggcctctgccttcccttcagtttctcctaacatttacccattttacaaatgacaagatcttcctgaaacatagttcttaaactgttcctggctcagtaattttaaaatggttgagagaacagaccaaatatcttggccccaatatttaagatccttgacaatcaggtccctgcctatccttctcattttatttctcaccaatctggtttacataccactcgttctagatgagcaattagaactgctgagtgttctctgtacatgctcttctatctgctttctacgctttcacttatcttccttcaacctgaagtaacgcttttgcatcgcatggtcatatatccagttcttcttcacactttgatctataactcctatgtcaaggattccctgacctcatagctacaagcaatagccctacccttcctaaacttccaaagtactttatttgtaccttttttatgtcacctttaaacctgcattatacatttcatataaacatcctgcctctccaataaagttcactaggaactattacttactaagcattaatatcaggtacttacatatatcacactgtatcctctcaatataattgagttaccccaatttaataaatataaaaaacagaggaataggaaatctgtataaactagcaaatactcaatacatattttttaatgaataaattattattccaagatgaagtatcattcaaaatgtttacaaatatgcgggtgtgtttcactttaagtgaaccaaaggtagagctccaagaataaaaaatatttaagaaaagagccaataatagataagaggttgcgttcaaatctaatattaacagttactacttaacttgagcatatatgatttttcaggcacacactttctatatgctaatttattttattctcataacaatcctttagaatagatattgttttcactggccaatacttggtgaggttaagtgactcgttcaaagttgcaaagccaggatacacataaagccagcctttctggctttaaattctttgctctagagtagttagtgagaaggcccaaacagcttaagcttgaaagaaatacaaatttgggcaagtgcttctttttgctttattaatattaacatgtggacatctacaaaacgtaataaggcatttaaaaactgagaaaattttctacttttcccaatttctataaaatgtaatatgttatttaataaccaagaaaacattctattttttcctaatatctctaagcagacattaaaacttgttatttggaatgaatatttgtttccaaatgaacaatgaaagtagtatataataagtaacaaagcaccaaatagagtaaggaatctcaaaactcaaaactgaaaagcattgtaaacatcttcttattttaaaaaacactcacagagtcagcaaaaggatacaacaaaatgtataaattgtaccaacccactcatgctaggactttcctataaaagtttctggtcagatagtaaactgttaatatttgaattgaagtttatgttaaaatgctataaaaaataaaatttatgttggtaaaactgaaattaactgccatgaatgtcagtactacttaccatgatgttttacttcattagacaaaaagaccaaaaaaaaaagtctacttctatttacaataaataaaactaatccatattataatccttccacatgaatcattagaacttggggagagaactaaagaggagaaaccatcatgtctattattactgtgactaaatgggattaactaatcctcatgaggtaaagttatgaattaagtggtgctcagaacactaagaaaatttgtggggagagaatgcaaatagctccctaattatctacagcctattaacaagcaaaccttattacttgcaattaaaatcctcttaaattttatggcaaaagttcattgaaacgttgaaaattatatgctaattattatactgtaaagcacatgtttagtgtatacttttactatgggctcaataaataataaaatatcaaattcaaggtgatacagtaactaaatattttactagatggaaaacaccttggtatgaagccagtatgggctcctgttacaatttcacagcactatagcaccagaatatccccaataacaactaagttctatgtgcacggtgacacggctatcctgttaaccactgaatggaaccccaacaccatcacagtacctggcatagataagtacttaagtattaattgaagaaataatgttgacggatgaaaatatatatttggtgataatatcatctactttcaggttctgaatctttaagcgctaccacagagttcattcattcattggtttctgtaccaattcccacacaataaatctataatatttatgaaattatttatgtctaaaagctcccatggcaacctagaccaagtttgtcttgttcctaactgtatcagagcacccagcacaaataaagccatcaataaatatttgtgaaataaatgaatgaataaatacaagaaaaaaaaaggatgttactacagtttgcaactgcctgggacacaatattcttcagtaggcaatgtattatgttctaagaacaataagcccatgctacaaatggtgtgagtcatgaaacagtgcccacagatgggtcttttaactgaggactcccccagctcccacctgattgatgattgattgattgatttagagacagggtttgctctgttgcccaagctagagtgcactggtgccttgatctcctgggctcaagtgattctcccacttcagcctccgaagtagctggaaccacaggtgcatactaccacactcagataatttttgtattttttgtagagatggggttttgccatgttgcccaagctggtcgcaaactcaagcaatccagctgactcggcctcccaaagtgctgagattacaggtgtgagccactacgcggggcaccaatatcattttcacacctatacaagttaggggaaaataccttaatacataaaggaaacaaccaatattcagtttccctcaatgtttctctctctccctctcctcttcccctttcccccacctcttaacagctagtttgttcaaatcaggatccaaggtccataaaatgtgcctgttgaggtatttcataagccttatcatatacattcctcttttatttttatatttttgacatctatttgttgcagaaactaagctgtttctgcatgcatccagcttttttgcattctgaatttttctaattatgctcttgttcttgtaacatgttccccctttccttttgtttcccataaactggttattagatttaaaacagcaatttctattagaaatacaatgcaaatcacatatacattttaaagttttctaacagtcacataaaaaaggaaagaaacagataaaattaattctaataatatatttttaacaatatattcaaaatatcatttcagcacacaatcaatataaaaataaaatatttagattctttcatcatttgaatattaatccaaatccagtgagcattttacaacttatggcacatctcagttgagactaaccacatttgaagtgctcaacagccacatgtggcaaccatactagactgcacagtaatcgagacttgatcaaattgaggttagacacctaacgcctgcttgtttcctttttggtgatgttaatattggtctgtgaatctaggtactgtcagctttgtctattcattaggaaaatccatatcagcttctttcctaatgattttagtagctattaatgattatgcccagatatcaatttttttttgctattctaattctattattccttctgcatttattagctgcaattcttcaattaaaaagaactggccaggcatggtggctcacagctgtaattccagcactttgggaggacaaggcaggaggatcgcttgaggccaggaattcaagaccagcctcggcaacatagcgagaacctgtctctacaaaaaataaactttctctcatcaatgtggttatataagttacagtacatatagaaaaatgagataaacatatgattctcaaaatattaggtttttgacattaaaacctgcctccccagaatactctgaaggtaatccataaagattttgtaatgagtatcattatgaacacatggatttaaacataatttgccatgctttaatctattatactttcattcttttacttttagactgtctcatcttctggatagtaaaagctacttcattttacctcctgcaaccctttttacctcaccccaggaccctctggcctctgacatagcaggttggtccaggctgaccttgcccaatcaagccaattattttcactggcaaatgatatttagagacaacaatctaggtgtgagagggcccgctgctaccagattgtttgtcatttctaggccattccagtaggcaaagcaagaaaaaatactgtttaactttaaaaaatgagttttacagatatttccaacagaaatttaagataaaaggggttttcgcttctcgatttttaatacatgttcccattttctcttgctctgaaaaatcttagtttccaataccattaacataattacttatttgctttacactatagggtcataactgtatttcagcatgtatcaggaattcattccgtattttttcataaatacattgaaagactgtcattttgggaaaattattagaattaagttcagagtaacaatagcaatactactactaagaataatcaataatactccttctctggagagaaagaaggccccactgggaatcttcagattactgagttctaaagttacctgaaataatttgcctctatgtagtatataatagcaaattaatttatttcctttggcttccaattcagccattgatttaaaaatttttaattctattttataattatatattaaaagtaaaatctagaaaacaaggtttattgagaaaagtctgttgtcattgttttttgttgttgagacagagtcttactctgtcacccagaatggagtgcagtggtgcaatcttggctcattgcaacctctgcctcccgggttcaagcaattctcctgcctcaacctcccaagtagctgggattacaagtgcctgccaccatgcctggctaatttttatatttttttagtagagatggggcttcaccacattggccaggcttgtctcgaactcatgacctcacgcgatccacccatcttggcctcccaaagtgctgggattgcaggcacgaggcactgtgcccagtcaagaagtctattttcaattcctatctctctaccttgtctcttctatcgccttaaagtcattttttttattatactttaagttttagggtacatgggcacaacgtgcaggtttgttacatatgtatacatgtgccatgttggtgtgctgcacctattaactcgtcatttaacattaggtatatctcctaatgctatccctaccccctccccctacccaacaacaggccccagtgcgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacattaactcatccttttttatggctgcatagtattccatggtgtaaatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccaatactgggatggctgagtcaaatggtatttctagtcctagatccctgaggaattgccacactgacttccacaatggttgagtcagttaaactagtaaagtcatttttattagttttaggttaaactttccattttaaaaatataagcaaatataattacatttgcccctccccattccttaaaggattatatattattacatatatccttttctaccttgttttgttcatttatcctggtgatcacttccaaagcagtgtatattcttcattgtgtaaatgtaaaacagattattcagcttccaacactggatggacatttttatcctttttagacttttgctattatagatagtgctgtgataaatagccttatcatttttgccaccaaatctttaagacagattcctagaactggggttgctgggtgaaggaataaataagtgcatatgtaattttggtagatactgctaaattgctttcactacaagcttgtgttttctccagcaatgtacacctttttagcaagagcaatccactcaatgggcattgactgaaaaactgacacttggcaaaccaaaagtttgctgtcaagatatacaaatggccagtgctgtttctgtcttttcacaccactgacaagagcaatgcttatcaatttatttcactcaggacagaaacaaatagcaatggaaatgaaaaataattatcatttaggattgtctaatgataaagttttcatatgattttaaaataccaaattctatttaataaaaatcatggtgacatggaacctcaagggtcttccaaatagctactttccaaaggttctatattactgtattgtgttggggggtatttatcgccaactgcccctcctaaaacatctttttgtattctctcccatcgcaaacctagtctaacttgtaggatcttcacatttgtggggaggaggttagagggtagggtagaagatgtgtgatcagattctgggttttggaagggttttttgcttctatttgttcacttctctattttcaaaacgtctgccatttgcactccataccactcatcctaattgtagctgccattgctgctaaaatccactacacttccaacttctatgtttgcttgtttttggtgttgctttcattttgttaggcttctcagcccccaagtgaaaggtctaattttcatatcaagagcatcagccaaacctttgattttaatccagtagcaaaatgatgaactgaatgtaatacccttctcaggaatgctcatttctggctgggtactcaggagttgcttttatattgttagagaaggcttattttgtttgtgttgttgtgggttttgttttctttcttttctttttctaaatccagaggttagataaaaccagtcttcaaagtttactactttgccatactaacacagttggcgtaaactgtctgatctctgcctgcacaacaaagctaccttttatcagactgtgaaaccacctttcatggctgccacagaactactcagaacaacacagtctacaaaaatattcctaagacatttactatgataaaattcccttgattgcagaagtagtcattcagacaactgtaagtattactaaataaatgtttattgggcactataatattatactaaaatgtaagacccatgaaggcaggaaattttgtctgttttattcactactagatattcagtgcttagaacaatgttgcaaacagtgaaactcaatacctattacaaatatttattgaatgaataaataaatgagcattattcataaggcaccatgaaagtattatgagtagaaacagtatctgccttaagaagctgctaatttgattagactaggttaaacatataaaaaggcaaatatgtaacatatataagccaaatgaatggagttgacatcaatgttgtaagagcccatagaatgggaatatcatcacccagtggaggaatctctactcacatttggcttgtcataaaaagtagtactcagcttagcacagaagggggaagtacaagtgtatgaactaatgtgagcaaatatacaaaatcaggaaatgatgaacagcaatccataagacagacttcccttacgaaggagacatgtttttgtttttctagttttgtttttaaagcaaagaacattttacgcttaaagtgtattttttaaaaaaacaaaatataatttttctttataattaataattatgctaaaatgcttctatatcatataagcaaacaaaagatgtttttagtaataacctctaggggttaccattttaatatcaacatgacttgtttcttacatgtgtaagcatttaacattgtgttcacaggtaaagaacaatatttattccatttattctgaagatttacacctcaaattatagggaaaaatgattaatttccatagaaacatgggttaaaaaacaaattttttatcctttcaaaatttctgagatgtggaagcatttaccattgtatttatatataaagttttaaaaaaatacaagaattcatagtacagtttccccaaaactaagattattaatattttaaaagggggttttaagattcttaaagatataatagagtagaacaaagtactttaatgtttcgtttcccaaaaatattaaaaaactgagattttttaacttaatagtaataacacatgtatgtttactatgtgcctgacactactcttaagtgtttaacatacatttttaacagtattaataatataagatttaacagtttgctttttttaagttattttcttaataattttaaggtgcttagttcttacatttaatgttttatgtgccattattttgcttttactgcaaaagaaagatctggctcccaaagataaaggagatttttggtaaatggtgaaggtaaagaaataaatgacccacttgcctagtgtgtaattacactgcctgagattgtaacaatctatcacatgaaggaggatgacaccacgctaaggggtgagtcaaaggagatagcctttgactaactacgggaccctgacgatcgatactccacagatattgtgctctcaaaaacaattgaattctaaaaaagtttgaaaatagattcccccccttcttttgatactgatcagagacctatcttgaccttattctggaagagtaatactttcttaaaaaggtatatgaaatacataaatcgtttctatctctggactgttctttcaaatggatatttaacacattcctattaaaataacagtctgcaagccaaaaaaaaaaaaaactgctgaaatctttccttattagataaatatgccttcctgattggctgttatcaagttatcataatacttagcacatgacaggtaagtactccaaaggctcaaaacttgaaaaacctatcagaaaataaaagtctccctctccctctccctctccctctccctctccctctccctctccctctccctctccctctccctctccctctccctctccctctccctctccctctccctctccctctccctctccctctgcctctccctctccctctccctctccctctccctctccctctccctctccctctccctctccctctccctctccctctccctctccctctccctctccctctccctctccctctccctctccctctccctctccctctccctctccccacggtctccctctcatgcggagccaaagctggactgtaccgctgccatctcggctcactgcatcctccctgcctgattctcctgcctcagtctgccgagcgccgccacgcctgactggttttggtggagacagggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacccacacctcccagccgcctgccttggcctcccaaagtgccgagattgcagcctctgcccggccgccaccccgtctgggaagggaggagtgtctctgcctggccgcccatcgtctgggatgtgaggagcccctctgcctggctgcccagtctggaaagtgaggagcgtctccgcccggccgccatcccatctaggaagtgaggagcacctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcatctccgcccagcagccaccccgtccgggagggaggtgggggggggtcagcccaccccggccagccgccccatccgggagggaggtggggggtcagcccccccgcccggccagccgtgccatccgggagggaggtgggggggtcagcccccacgcccggccagccgccccgtccgggaggtgaggggcgcctctgcccggccgcccctactgggaagtgaggagcccctcagcccggccagccaccccgtccgggagggaggtgggggggtcagcccccccacccggccagccgccccgtccgggagggaggtgggggggtcagccccccgcccggccagccgccccgtccgggagggaggtgggggggtcagccccccgcccggccagccgccccgtttgggaggtgaagggcgcctctgcccggccgcccctactgggaagtgaggagcccctctgccaggccagccgccccgtccgggagggaggtgggggggtcagccccccgcccggccagccgccctgtccgggagggaggtgggggggtcagccctccgcccggccagccgccccatctgggaggtgaggggcgcctctgcccggccgcccctactgggaagtgaggagcccctctgcccggccagccgccccgtccgggagggaggtgggggtgtcagccccacgcccgccagccgcctcgtccgggagggaggtggggggtcagccccccgcccggccagccgccccgtccgggagggaggtggggggggtcagcccccctgcccggccagtggccccgtccgggaggtgaggggcgcctctgcccggctgcccctactgggaagtgaggagcccctctgcccggccagccgccccgtccgggagggaggtggggggggtcagccccccccgcccggccagccgccctgtccgggaggtgaggggcgcctctgcccagccaccacccggtctgggaggtgtgcccaacagctcattgagaacgggccaggatgacaatggcggccttgtggaatagaaaggcgggaaaggcggggaaaagattgagaaatcggatggttgccgtgtctgtgtagaaagaagtagacatgggagacttttcattttgttctgcactaagaaaaattcctctgtcttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaaaaaagtttccaaatgagggttacagtgtataccctgaacctgatacagtacttaataaatagcatgatttgactatgtaaaaagcaaacagaggccaggcatggtggctcacacctgtaatcccagcaatttgggaggctgaggcgggtcaatcacctgaggtcaggagttcatgaccagcccgggcaacatggtaagaccccatctctacaaaattggcctggtgtggcggcaggcacctataatcccagctattcaggaggctgaggcggaagaattgcttgaagctgggaaagccaggaggcggaggttgctgtgagccgagatcgtgccactgccctccagcctgggcaacacagcgagactctgtctcaaaaaaaaaaaaaaaaaagaagaaagaaagaaagaacttttacaaataaaaaaaacttttatgtccattaaatattttacaaaataattctacaggataaataatcacattagaattgtcttaaaacagtgcatcatgttttattttatttttatttttgagactgagtctcactctatcgcccaggctggagtgcagtggcacaatctcagctcattgcaacctctgccttgagggttcatgtgattctcatgactcagcttcctgtgtagctgggattacaggagcccaccatcacacctagttaatttatttttttatttttttatttttagtagagatagggtttcaccacgttggccaggctggtctcgaactgacctcaagtgatccacgagcatcggcctcccaaactgctgggattacaggcatgaggcaccacgcccagcctcatgttttatttttaaatacttgaactgtatctccacatgattcctattaccatagttataattaaattcattaagctatatcaaaaatttttcaaattatattttacataatttctgggatgtttgtatacagcattttaagtatctgtaactacaagagcaagtgtctaaaatacactttaaagtctgaaagagattaagtggaaagtaaaatctcatctaaatcccaataattattttcttttcacagaggctaatattaacaaatataatgtaatccatgaaaaatcatgattattataatatgaaagattataaaattaaactttttagaaagttcagaattttgtattgatactatagcatttgctattcgcagaggatgacaggtatttcgcaaaaatgtcagtacgagaaggatattacatgaaactgcaagatgtcacctctattctagagggttgtagcaacccactccctcccaaagcacacccttgttaggataaaagaagaattaccagataaataggctgtgcctcaaaccaattaaatccctgggggtgcaatccaggcaacggaaattttttaaaagcttcctacattccaatatgtagacaaggttaagaactactgctgtatggtatagatctgtttgcaaaggtgaagaagtttgaaagaagtaggcaaaaagagtgaaagtgtaagataagaacactattggataacaaagatgagtatatttcactccaaaatctacaaaggatttgtgaggccagtacctcaggcctgtaatcccagcatttaggaggctgaggcaagaggcctgcttcaggcctggagtttgagaccagtctgggcaacacagcgagattctgtctctacaaaaaaattaaaaaattagccatgggtggtagcagtcttagtactcaggaggctgaggcaagagaatcatttgaccccaggaggtcaagactgctgtgagccaagattgtggcactgcactccaacctgggtgagagagtgagaccctatctcttaaaacaaaacaaaacaaacaaacaaaaaaaaacagataaaatctacagaagataaaaggggttagatcagtagaaagccctcacaaactttacaaactagcaatttaattacattaacaaattattctgttaaaatacaaatacaacttgaggaaatttattgaattgctcacattcagaccttgatataaaatttatttaacaaaatgtaacctagctaaaataagtcacggttaatgagaattctgattgtctatagggaactaccgtttcagagaataaagggatctagggtgtagatcttgaatttccagaaaaaactttgaagtcactgtatatatatgaaggcaaaggagtctacagaagaccaggctcaagtaagatggcaaaaattatatcaagtaagatgtcaaattgatgacagaaggtgcacaaaagagtatcatttccattactgtctaccaaaatttggtaggatgtcatatgatataaaaataccagacttattttgaatataaaaaatttcataaactcagtttattcctgtgttttcaattgaacttaggacagttctactcaccccacttatgctgaaaaaaaaaaaagaagagaaaaaataaaagtacaaaagacatccatggaatctcatatcaatgttccttcttttattcagtatcaaatatttaagaccctggtagtatatatcaggtattggaccagggatgaaaacatcaaaattaatgttacgggcttctactctacaagtactttatagtatactgggaaaaaataaaatgtgtaccagactataagtgctttaatacttgtatttatcaaacgctatgagaacacatataagcaaagaaatatctaccaagtaatgcttctgagagaaagaagaggcaatggctgataaagtacttggacacagtcacatttcggaaggattctgaaagacaaatgggaactcaccaagaagataacatgggaacagaactgaaaacacaaagaagagcatgagaaaatataaagaaaaaataaaaggtatgtctggatcgcaagttgcttggtgtggttagagatgcacgaaaaagatgaatggcaaggaagatttaaggaatggcactaacaagccttgaatgtcatgtcttaggtttttcaatgaagtggttttaataatggtactaggaaggctgcaatagcattgaaagagagtaaagacaaggaaacccactggtagactacttgcagacttctataaccaagggtttttcaatgaatctaggttgtaatcataaccgattgttataatggggtatagatatagatcatataaacaatggaaagctgttctgatctcagaatagacccttgagttttctcttttcaatgaatacctaattatggcttgacatattatcgaaaacagaccaggaaatgtataatggcattacctaatacaagtgtatcataaagcataatagcctgtcactgacatttcacttctttatttctccatttatatatcctctaatcacatgcagtgtggatttcatgccaccggttcacaggatgtgttccctcaaagtatatataatccaaaaactcctaaatccttagcccctaagcttttccctaacatttcacatatgacacaggaattaacattgccatttaagattgagtaaactgaggtttagtgcacattatataattccaaggccaaaaaactactaattaaaagtgcttattttcaaaaacccagaactgtatgaggccaaaaccgatgatcattcttctatgccaaacttacctcatgagataattttcttctactcatgaatagattacaaccttaagaagcctagcaacttcaagttcattttcttttataaaataaaacattacataagttgagaactttttgagacataactcacatataattttatgagttttgacaaacacatacaattatgtcaggacccctaagataccatcagattcaattattcacaaggaatcacaggattgagtcatcttcatggctatgacttcctgaatcttgtcttagtacaaacaaaatcaacaaagggagtgccatggtacaagatctagagaaaccaggtacaagcttccaagagtcctttccttacgcaatcacacaggatgtgtctaattcctccaggaatttcacacatatcacaatgtgtgaaatgtttgtcaaaggaaccttatttagagactcagctcccaaggttttcatttgggactggttgcttagggaccctctgtctagtacatgctgtaattctagactcccagaaagaaaactgatgtttacaatcaactacatcgtttggacaaacagtctaagcacagtgagccactcatcatttatgtaaagttctatatcagtgtagggacctgtttactattcaaattcccagatgccagccaagggtccaccttgtaactgaccctttgtaaaggatgagacgctacgttaacacttttctgcaaagttatataatcaccaacacaatcacgatacagaacagctccatcatgccaagaaaaaaaaaatctttgcacccctttttaatcaacctctacaaccactggtctaatttctattcttataatgtgcctattccagaatgtcatacaaatggaatcaatcacatttgcacatagccttttgagtctggcttctttcacttattgtaatgcacttcagattcatccatgttgttatatgcaccagtaatttgttcctttttattgctaaataatagtctactatggatataccacagatattttcatctgccacaattcaatatggttttctccggtaaactgtatttctacttcacttgagtaaacatctaagaactatatgaggccaaaacctacgatcattcttctatgccaaacttccctcatcaaaacacgcagtagaatggaggaacctcaaattactatgctgagtgaaagaagacaaaaaagaagtacaaattgcataaaaccatttatataaaattctagataatgtaagcttatctagagtgacagaagatcaatgactgcctaggggcagggagggtgggagagagtaatcacgaaagggtaggaaaaaatctctagattatgatgatggtttcatggatagacataagcagagtcaacactcggtatcctcaggttctgcatctgcagattcaatcaaccacagactgaaaatattcatataagaaaacaataaaaaatagcaataaaataaaaaataggtcgggtgccatggctcacacctgtaatctcagcactttgggaggctgaggcaggcggttcacttgaggtcagggattctagaccagcagtctctactaaaaatacaaaaatcagtcaggcatggtggtgtgtgcctgtaatcccagctactcaggaggctgaagcaggagatttgcttgaacctgggaggtggaggttgcagtgagttgagattgtgccactgtgtactccagcctgggcaacagagtgagacaccatctccaaaaaagaaaaaaaaatgcaaaatttaaaatatagtaaaacaaccatttacatagcatgaacattgtattcagtattatatgtaatctagagatgatacagcagaaggatatatgtaagctatatgcaaatactataccattttatacaaggaacttgagcatctgtggattttggtattcatgcgggccctgcaaccaattctctgtggatactaagggattacatgtcaaactgtacattttaaatatgtacagtttattgtatgtcaattgtaccacaaaaaataaacaaagccttagtcacatccattaagttttcattctatttttttatattattgatgtcattttttctgtacccaggactatgtaatacatttcctatttcacatttgatattaaaccatgtgaagaatcatccttatttaactaatgaaaggaaaatatttaaggaagctgaaacccagagagactaagtggtactgaaaacacccaaaaaccaagtgctctgccagtgtcacgtatctgttaagtaaagagattcaaacccatgtctgctttacttaaaagctaacggtcttaatcactataccatacaatattaatatatcatcttaaaggaaggattcagaggatagacactgtgctaggctgaataacagcctcccaaatatgtctaaatactaatccccacaacctgtatgttactttacagggactttgtggatgtgattacattaaggatatagatatgagggcattatccaggattaacttcgttgggcatgtaatcataagcatccttataagagggaggaaggaaggttagagtgagagaaggcattgtgatgatggaagcagaggaaaaggagactgacaacagagaagcagagtcagagagaaatttggagatgctatgctgctagttttgaagatggaggaagaagccatgaaccaaggaatgaaggcagcctgtagaagatagaaaagtcaaggaattttcccccaaaaacctgcaattgattgaatgtttgtgttctctataaattcatatgttgaaattttaacccccaatgtgacaatattaggaggtagggtcccttagtcagtaattagattgtgagggtaggaccctcaggaatagaattagtgcccttagaaaagaggccccagagaactctctagctctccttccaccatgttaggatacaatgagaagtcagtagtcttcaacctgggagagggctctcaccagaatccaaccatgctgactggcaccagatcacagacttccagcctccagaagtctgacaaataaatgtttgtactttaagccactcagtgtacggcaatttattataacaacctgaatagactaagacaagcctccagaggaaacacagccctgccaacccatttcagacttctgaacttccagaacaactgtgttattcaagccagtaaatttgtggtaatttattacacagcaataagaaactaatacaggctctatagtcaatgtagtttctttcttccctatcataaatgttctatgcatttggcctacagtaaaagttcctgataatgatggaggtaaaaatggcctctggaagtttgggtatgggagaaaatataaaaggcagtacactaagcaattattcttgtggactctagatatctatgagtcttagtaaagtccaaaacccagtatgtgccaatagctttaggtcttcctttgcaaattttaaaaactcaaatgatgccaaagtaaactattccctaggctgacttaagacaatacaaattcattagtgggtctggagggaaagagtggtatcagagatctcacagtcagtctgagaatgatgtggtgttaccaaatcatactaaacacagactaggaccaaacaagctataggcagtgtgtaaaaagcaattcactctagactttattttattttgtttttaattatccatgtggcctaaatcccacaaaagagaatgttaaaacaaatttcaaacctgagacttgatttttcagttcatttctatcatctatagttaccatctttaaagcttggaacctgtaattctttcattcattcaacaagcatttattgtgtacaattcacagcacatcataatgaacaaaaataaatatcaccctttccctaatggcatttataagttagaagggaaagattatttcaaaaacaattaataaacagcttaacaagtaccataacatgggaagtagaagttgatgtgaggggcatggcgggaaacctaagttagtgagggaaatagaatatgaaaatgcttggagactagagatggaaaagagcataaagaaagagtgtgagagtatgtaagtggctgtgtattagaggggaagtgtcaaagggagggataaggagagataaggcctgataggtgagtaaaagccagccatgaagagactgcgccctggtcttaaatcccagtggtacatatagagatagcaaaaccagtcattgtgatgattctcaatcctggctgcaaatctaaggtcgtccagtagagtgcttctcttctactgtggcctggcaaacacagtttataaaatctgtgaaaagtgagagtaactgaaaactctaagaactgagactaatagtttcatgcatatgcaataataatagctattaatttttaaaatttgacaattttataagttacaaatattagagttcctgtatacccttcactcagcttcctctaatgttataatcttatataaccacactacaattatctaaatgaaaaagtttacagtgatacaatactattaactaatcttcagagtacatttgatttttgcaaattttcccattaattttcttttcttgaccaataactaatacagaatcccaaactgcagttagttatcatgtcttcttagtctcttcaaatctggaacaattcctccatttctccttgtttttcatgaactttatatttttggagactactgaccatttgttttgtgaaacatccctgagatttgagcttgtctaatattttctctttttttttttccctctggctctgtcacccaggctggagtgcaatgacacgatttcagctcactgcaatctccacctcctgggttcaagcgattctcctgcctcagcctcccgagtagctgagattacagtcatgcaccaccacgcccagataattgttgtatttttagtagatacagggtttcaccaagttggccaagctggtatcgaactcctgacctcaggtgatccactcacctcagcctcccgaagtgctaggattataagcataagcaactgtgtccggccaatattttcacttaattaaatggaagatttgtatttttggcaagaagaccatggaagtgctcttgtgcacttctcagtgcatcacatcaggtggtatatgatgtcaagaagtcttcttactgatggtattaagttgatcatttggtgaatatgatgtctgccacgtttctacatattaactatgaagttaatatgtttcctgcttgtaattaataactatcttgttgggagatactttgaaacaatggaattatcttttttctcattattccatcgccttaagtttcagtattcactgattattgcctaaactgtattgtattgtacagtactgtggtgtctgccaaaagatgatttttctacatctattaatctttttacttttaaaaattgacattctactgtaaagaagagctgtctcttacctcccatttataaattattgacttcacgataaactaaaaaatatttattctatgggtttttaatctattactgtcaatattataatgttgctcaaattgtcacagatttagctatttaaagatctttgggatttatgtccttttgacatgctgctacccatttttgagtacttccttaccttctggcaccacaagataatcttatagttgccctttcctagctctgaaatcagccatttatccaaaaagatctagttttttaagttaacaaatggcatacagaaactaagatttgggaactaggtttgcattttatcattggttgtcactgcttctatgtcttctcaggagacagggctaggtgatataagtatgtatgctaattgtgcatactaacacatgtatatgtaattgtttatatcatctttctatgtgtgtacacataacaataaattcacattgatatttcattccaatcaatcaccacaggattcattctagagtttcctctccttatttgtaactcctttctccaaaagaaagaaatcttgcttttactatccaaaatatatttacttatttgctctaatcctaggatacatataaaggaattttagattcattatctttctcccccacaattattggagcaattatgctgttcatttgtaatgctgttagattttcactttgtcccacaacatagctgatgtgtgtgtgtgtgtgtgtgtgtgtgtgtgtgtgtgtgtgtgagagagagagagagagagagacagagagagagattaggttctaagagtccaaagcatacaaaaggtatagtcagagaactgtcactcccctttcattgcttgtactctgttcccattccccagtcctttccagcacattctcacctacctgctgcagataatcaatattattagtctatgattcaacccttcctgtatctctttttgtacaaatcaacagctaacagttattaagcatttacatggtatatgtcagacactgttctatatgcctttctacatattagctccttcacctttcacaagcacctaagcttcaagagtgtagatgctctgaaacatcgttttcatctaggaatcttttccttttcgtaggtgttcttgattgcctcagatatacccaagagatattcattatagaattagagaactaaatagtacattgccaagtactagattttgttctgatgataatgatttaacatgtgataacaatttttatttcctcaggtagttaattcattacaaatcagtcactaagtacccataaaagtacatacaatttctcatttgtcacatttattctcacaatagcacaaggagacctgcatgtaggacaaatagcatccttactttacatgagaaaactgaagaacctataaacataaaaaggacttctgtgctcccactaaaaccctggtaagtaagttcatagaaggcttgagtcttcaggaagaagagagagacagagacaagggcagccagcaagaaagggaggagagtgaatcaacacagggaaagcaaggtctgaaatgaatgcctgagtacagacaactgacaatagacaactattgcaaattgttgattagcaaggcaatatgaaggaactgtttaaggaaattagcagtgtgtaaaatgcagcagaggatagagacaacaaggtgtaacatttctgggaaatctgaatgtataatataaagcattaaagtacctttctaacatcaatttctaggaatgctcattttgttagtcaaaagcaattacaggaaaatccaatctttgactatttaaacacagtgatttttaccattgaccatattaggataaaatggggagcttcttaaaaatactaactaccaagccattttccagaccaattaaatcagaatcctgggaaaggtgtacaggcgtcagtactttttttaataatcccatggtgattctaatagacagctatagttcagaaccaacacatcagtagtaaacattgacaagaagatgcccatatgtaataaagtttcgattttttcttttttttttttagaagatactctctgttgacagtgaacattctgcttttgcagaagtatatacttactaaggtaccataaacttcagaaatgtaaaagtaaaactaagaaaatgtacatctacaatttcctaatgcatttttataaataattgtagaaaagcaatttttcatatatcaatcctttagtattctaaagttattataatttattttttttaattttttgataataaatactccgtattaaaaataccctctctggaaattttccaaattatcatctggatcagagatataagtaacaacattctaaacacacaatgctataggactggtttagcatgataccaggggaagcagaaaataaaaggaaatctaaactacactcaaagcaacaatctgttaaattctaagctacgtgaggacagtatccaagtctgtctattctactgttatatactcagtaatttgcataaagcctggcacataataggtgtccagtaattcttagttccataacaaatctattttgaaaacttatttagaaatgcatcaacggaaggaagaatgaaaggaaagtagtaaggagaagggaaggaaaagacccttggaatgacgaacaaatgactgactgatttagtcagtcattctcaaaatggtgaagtgggagtcaggagagtaggattctgagtcttggctttgccagaaaaccagttgtatactcttaagcaaatcatttaagttctccacaataacttgctcatccataaaacaaggagaggcataaatgacttctctcatgacctacagtgttgaaaatctctatatatcactgtatcagatattttgaaggaaagtatacattaatctaagtattattttttaagacagaaaaaaattgacaagaatttactaaaccgaaaattttaagtaaaagaatttctaattcggcatatacaaccaaaatttctaattacatatttggtgaaaaaagataagtcattgtatatccagctatttcatatttaactccaagttttaattctcagttatccacagatagaggaataaaacataaggaaaactcataacaggaattctctcagtattttctcagatgtatttttcccagcaaaagttaaaaactaaaggaaaagttgcaagaacacttaaaaaaataaatcctacatctaaatttcccaccttgcttacatttcagtacatttgctttatcatgctacctcttagtctctcttggcatatgtgtgatagacattattttttttctgaatcaaatgagagttagttacaaatatcatgacacttcaacctttatctatatttattgactaagaacaaagatgttttcttatataatcacaacacaattattacacttcataaacttagtattaacaattcatgtggttggtttttaatccgggtccaatcatgtatcactttcatactaatatttgaataatattgtgttatttactaaaaattaattatacttttaaacaagataattcaatacaagacaatgagagttatagggaggctggacaatgccagaaagagtcatatattatgatttaagaggttaggttccacttcccttttattataacaagctgccattggaacctatctccttaatgggctggggagtgattttcatattgtgagatgccttgagcagcagtgagtaagaaacccatgagctttcgatgtcagctaggatggttcctttttatccattttatatattggggttctaactaagaacagtatttacaaaaaaaagtaatttttgtggtgttttggttttggggttttttttttgcataaaaatgaatttgaaaacaggctaaagaagtaaaggtaaaaatcattaggtaaaagagtagggaaaggaaagagaaatcaaattctcaacagaataagaatgatcctgacccaagtatttcagaatacaaaaagtcaaacagtcacagccttttattgttcaccacagttgaagtagcaaacagtaaagtctaaaaaaaaaaaagctttattacttgaaaaaccaagaatgcttctgaaccttcatttattccactgcaaaacagaaataataatatacacttcacagggttgttgtgaggatttaatgaaataatgtttgtaaagggctcagtaaatccctggcaaattgtaaacactcaaaaataaaaattaaaaaacatcctaatactgttgggtgaagtggctcatgcctgtaattcccagcactttggcaggctgaggcaggaggatcacttgaggccagcagtttaagaccagcctgggcaacacagtaagaccccatctcgacaaaaaaacttaattagtcgggcatggtgtcatgtgcctgtggtcccagctacttgggaggctgaaggaggagggctgcttgagccctggaggtcagggcttcagtgagccatgtttatgccactgcactccatcctgggcaaaagagcaagacccagtctcaaaacgaaaaaaccacaagaacaaaaaccaaactaataccaactactaatattaagaagttgactgggtgtaatggctcacgcctataatcctagcactttggaagccaaggtaggtagattgcttgagcccaggggttcaagaccagcctgggcaacatagtgagactttgttgcccagaaagaaaaaaaaaatagccagatgtggcatgagcctcagggaggctgagttaaaaggactgcttcagcccaggaggttgatgctacagtgagctgtgatctgcactccagtctgggtggcagagcaagaccctagctcaaaacaaaaaaacaaaaaaacaaaacagaagttgcatgatagttatgagtacaggctctagagtcagaatgcctgggttcaaatgttaactactcaatatactagcctttggatcttggtcaagtaacaaacttttaaagctctagtttcttcatttgtaaacttgggacaattaatactacctatctcattgctctgtttttaagatacgatgagataatccttataaaaatacttggcacagggctgggcgcggtggctcatgcctgtaatctcagcactttgagaggccgagacaggtggatcatgaggtcaggagttcgagaccagcctggcgaacatggtgaaaccccgtctctactacaaatacaaaaaatcagccaggtgtggtggcacgtgcctgtagtcccagctactcatgaggctgaggcaggagaactgcctgaacccgggaagtggagcttgcagtgagctgagatcccaccactgcactccaacctgggcgacaaagcgaggctccgtctcaaaaaataaataaattaattaaataattaattaaataaaaatacttggcacagtgtctggctcaaaattaattgctcagtaagtatcacctattattcacatcactattattataattatttaaaatactagcatatctagcctagatattaacatataaagctctaaattttattttctaattcttgaataaacttttagaatcacacaatcttagaggtgaagaggaccttactatccaatgaacttattttaatagtaagattgcccatatatttgcagtaagttatttgtgttaacatctcccctctttaaacctcaagctctatgcaaacagactattactttcttctcacttgcaatttgtctataatgaatgtatatgaaaattatgatcttatttttttttagcttattcattgtcacataaccagttaatgacaacggctgagaatacaaaggcatcaaactgcacagtgctctttccataaaatcacactaatcttgtattagagaaagacaacattttaaaaaagcccttttataacctccaaatatatccttgtttatgaccatttacagtgaaaaattataatcattgctttttaagctatttatttatagtttttcacttttctatttcccctattagagaaaaagttacatgaaggcaagcgatatatttgtcttattcatattgatttctacagtgccaaaatgtgcatagtaagtggtatacagccagtactaaataaatacgaaaagaagaattgttccaataggcaggagaaacaaaatttgaaacgtcaaatatcagctattataacagcctacagggtcctgaagtagaagcagccctgtcaacaaacttcaaggctgggctaaattattgctgtggttctcaagtgattctcatattgggattttttttttaagactgtttggtttcactctagacccatataaaaccataatattttctcaaattccttaaataattttatttgctcccaaccctttggaatacttctgaaaatttctggttatagcaaaaattactacagagacttaaaagttcaagcacccccaaactacaacttctagttatctgctgaatctcaaaattttctcatctactcagaacttaattgtcaaagaaaagtgttctttacaaacagaaaccaaaattcccaagtctgtattatctatagtacatctcttttcagacatactctacttctattacactcctcttaatctctgaatcaatcttatccttcatagtttacaactagttatgataaaatattttgaattttatttttcaaaatttattactgctttggttgaaacaaatatttctcagttcatacagcataatgaaaattttaagactaatagtttacctgaccccccaacccccaaaaatgatttctttatgacatactgtaggttcagtactatgctaagaactacagaaataacataaggctaaaatcttataatctacacacaaaacaaagaaatagaacttactgtcaagtactaaattctgcaatataaattgattataaatgccacagaagataggaggaaagaatatcaagaaaaactggagacttgaagaaaaactgcataatgagacttgcaggatattccaaaaatgctacaaattttttaatgtttcaatgagcatatgtgcaacaacttgaatttatttttcaatttgtttttatttacttttgtaatatattgactaatgctgacacttggatgccataagtttattttattccttatgtctttgaaattatacaaaaatattttactcagaattataaaaagcacatattcaattttgaatatggcaaaacatgttacttgccaatgaaattatgtggttttttgctttatattcattctttgaaaatgtagttaacctggcatggtggttcccatttgtagtcctagctactcaggagaggctgaagtgggaggattacttgagcccaggagttcaaagttgcagtaagctataatcacgccactgcatccagcctaggtaacacgacaagatcccatgtcttaaaaaaaaaaagaaaaagaaaaagaaaaaagaaaagagaaaagtgtatagttctctgattcccatatgttcagtatcaggcctgtaattagtacatcacaaatatacaaaagataatattcatacatttttctagccattaaaagtagaaataggccaggcatggcggctcacacccataatcctagcactttgggaggccgaggtgggcagataatttgaggtcaggagttcgagaccagcctggccaacatggtgaagccccatctctactaaaaatacaaaaaaatcagcttagcatggggcacacacctgtaatcccagctacttcaaaggctgagacaggataactgcttgaacccaggatggggaggttgcagtgagctgagatcctgccactgcactccggcctgggtgacagagtgagactctgtctccaagaaaaaaaaaaaaaaagaaagaaaagtacaaataaggtttgactaataataaaaattcaaatctagtgccataagtatgtataattatatgacacaactatactgtgaccatataatacatactacacaagaaaaaaatggctcctcagtatcagtactgcaatatgcctctgtggtagagacagatcccagaaatatcaacttactagaaaaatgagcatataggtgagtctcattatgtatctggccacaggcatttaaagtacatagtgtttaaaactaaacactaagtcatgcaaagactttcaaaaatatacctgttttctttaactaacatctccattgattcttccatttgttttgttagctattgattttttccctctccttcttatgaaaggggaacaaggaggggatacatggggaaaatgttacctttattaagccatcttacaatgttattgtcaggaatggctataaagaatttctagcatcgtcaaagtcccagagagagcaatgagtggtgcctgcactgatgtcaagtactagctcctaggcatggcttaggaataaaaataaacgcattagaaagaataagaatgggtgtatattgcacttatgagtacccatttgcttgattatccacatagcgtaacggaatcaaatgcctaagatgaactcttagtaagtaaggtatattagcattttagtatactaatttcactacaaattcattgatattacttatttagtaaaaaaaaaattagaggtaaaggatttttttaaagataggacatgatatacttcttttggaaaagaaaatacgtcaagatgagttcaatattgaatttcaccaatgagtatatattaaaacatcagaaattattttcaaaacaatctttccttaggcttaaaaggagaacctgatttaaaatcaacaccaccctagccatagcttttaacgggtcaagtacattagctactcctttctgcaaacaatggtacataaaaacaaagtgggatatttcctacaaagaagattaaaaattctttaggcctgcctttccttggactctggattttaaaatgacatactacaagataaaatagtaatgctaatattgatagtttgtccattacaggtcagctaactgtccactggaacagttacaaagctgttagtttcgatttcacaaggccaatcaatacagaggcatactgtttcaattttgtctgcattgatttttttttataacactccaaccttacagcattcatctttctgaaagaaggaagatttgatttactgaagaaaaattggagagagcatcacaaagattttaccggcaagcctgtgacacagaaaaaagatgaatgtctttcaggaagagacgcctctagcttgagggcatccattagaacacactcaagcaatctgaaaaggagtttcttaaagcagcagaaatctaaacctaaacagtctcctaaactaatcaaaagcattcaagaattttgatatgaggttccgttaaaaattcctaaaccttattacttctaaaataatttatgtctctagctctacctatgcattttttagagatgagaaccacctctttcccagactaataccaagagtgaatttccatggtacattagtcagcctattagaatgcaatgaaggacgatatgagaaaagggtagtatgtcctctgagacttccatccagtattctccatcatctctcctcatccttcttacattcagccactttaccaggtgtcatctacatgaaagatgatttgtctcctgacccaaataaacacaatgcctgctccatgcaccggaaaaaaattacttctgccactctgttcatttgtggcttctttcttgcttattccactattcttatcaagctctctcagttttcacctgagcctcactccaggtgacagtaatgtatggatgaacaggtacttgtctgtcccattatttcctgaaatctctaagcatttgaaaaaatgcaatgacagtaaagggcacagttatcagagctccaagggaggaatactttcctttacttaccaatgcaatagtctaggcatcaaagaaaaaagagagagagagaaagaactctcatggcaaaagctggtgtaagcgagatattaagacacaaattgcattcaggcaggtcactaggtgtcaaaagatattagatgcctgctgtgaggaaacaacaattcccatctgcctctgagaaaataatattttcattttcagtttttattgaatggaaacttttgggaatatgtctttataaagggtattaagtctaccaactataacatgttcaaaatggctataatcatcattgtgttatccataaagcagcagatttcatttggtctctttagatgggataaattggattcttttttccccggcttgcagttttgtcgcaggaccagatgtttctcaaatgccacatgctgaggctcctatactgaatgtagcacctgaccttctctataattgactaaaaatattgatgtaatggcatgggtctgattgtgatttattaaaaccactgccgatcccaggccagctgccagcattgcagcccactgatcgtgtggcattagaaaagccatcaatagtgaaacaaaataaatgacattaatgggaaagtatcaggcctacataaccatggctacaagcaaattacgtggattccaaaggagggtcaaaataaaaaaaatgccacaaatgaaatttctaaatattctaatatgattgagttaaaagacaaaatgctactataattctttagataaaatgcaaagaaattatacttaatttaatcctcttcactagaattttgctcattgtgcatatttcttttagcaggcttagcatagttaaatgcattacagctacagtatgactctgatttctctctaatgccatttatgttttctagaattatgctaagtgaagaacaaagtacactgtgttattcccatttattacaaccatgtccataatttacaagctgattatgcaagcctcatacaagggaaatcagagaatagttaaccactgtcaaagtatggtgagccagcatacatttttgtcagctacattttcttacatggaccttaaaaggaacattaagatccacacttcacattattgggaattaatattgaaaaggactatttaaagataatttttaaaaatgcattagggagaaaccaggtattctaaataagtaacagttgaatatgatacagaactaaatataatgacaaagaaatatgaacatacaggcaatgtgctttgttacatattgttttttaatgtaagatgagatttatagagaggaaaatattaatttaatcatgtccattttgtgatggtacatcctttcttgttgttctgaatttaaaatgtacacattagaaagctaataatttgacagctattttcatttgagaggaaaaagtaagagatattttgttctgtggacttgcagaaatattaaaatttcaaaatttatttcagttgtttctggcttaatgaataatagagttgataccttagaacaactctattactgaaacactaattatttctagataaatacatttcatggtccatttagctctccaagatattttattacaccaaaatcacttcaggaaaactatgttttccttttgataccacatgtatatactatgctatacaaaggtacagctatcaacagaaagaattttgatcccatcaaaataacccatgaaacgcttgacataagttatctaaatgtgtttattttaaaactgcaaaaccttttgggtgaaaagaataactttttaaaaagattcaacaaatgcacattgggttcctactgtgtgtcaggcactatgcatcagagtaatatcctaattcattcagtatctgatgtcaaaatgatatcaaatctgtaataataaagcactttgaaactctaaaaccctcaatacaacactcctccattctcctcgccatgggcttttagatgttgcaagataaggcaccagagatcactgacccatgaatagatgttatttccataaccactcttgcacctgcagatcaactgaaataacattaaaacaaacaaacaaacatggttcctgttggctgtccttttgatctcaagaccttgacttgcctttctttctctgaatatcaaaaattaggtacccagaaatataattcattatatgcaaatattctttgtaataaatatcacacgctacatttattctatattagtgaatactttatacaaatagctttcaatgcaaatttttgaagtttacttttctaaaagttaaaatttttttctttatactggaaaatttctaacactggattttgatgtctgatagacacataagttgattaaaacacaaatggaagcaaattacactcttatataatatacaagtaatttactatttttgtttttgttgtcttctagaaaaagttggtcaaaaattagaaattaaaatataatgttttctaatagcaaaataaaaactttctgtcattaactttacttaaaagagtcaacacatgttcctgaaatttgtagcataaaatatttcatggaggatatataatttgtccaagttccttagtcttaaaggcaatttaattaatttctataaagtaaaatcaacaacagcatgtccagtttggctatcttaaaagaaggtagatatattgagtaaaactttaaagaaggcatttaaccaagtttatcatcacagtcctgaaatttgcaacataagaaaaaaaatcattttattgtattttcaaaattatactttgaaaatatggttactttcaaataactaaaaaatataaaaagagcatagttttttaaaataaaatgttatatacgtaaaaatttggctataagtgtagatagtaagatagtttaactgcttcccttaagaattcatttcaaaaggagtaagtagataaagcaaatatgattttggaagtagttgaggaaactgatctacaaagatccataattgtacacatactgattggataaatatggatctataaagatccataattgtacccatactgattttctccttccctttggctttaaattcatagagatgatgaaagacaaaattaaattactctcttcttcatctggctttgatcatatccaaagtcatttatctaaacctaagccatctacagaaaatcagtggccaaatcctaaaggtatccctttacctcactgcagaatttccccaggctccatgcttgtctgtgagaatgttgataattttctggattagttgagttgctgtcacgtggtcacgatattttgctgctcttatcaaatgatcacacatcttctcatcttctcgtttgtctgcagaatactgggcacacagtgacttggagagaaaaaaaaataatactataaaaaatgtgaaaaaaacctttaaaatccattatgaaataatctttaccctaaatcaaaacaaccaaaattttaaatctacttttacattcctcattcacctaactgagatttagtgatctgctgtctcaataaaacatcccacaagaatttacttctgtgaagtcaatcatgagatacactcagaagtggtaaacattcaagtagagacctgaacaatgagacaaagacagtcttgtaagaagcaggggcccagcacgacaaacagcatgaagtgaagttgcaaaggacttgagacatagtgaataaggagaataatggttaagaaataattttcaaaaggcaggccagggctacatcatttgtattatggtaaggagtttagattttattcaaatgtaatggaatcccagaggaaagttttacgcagtgaagtgataaatttacatattaaaatgatcatatagctgctatttagagaatggattgtagtgggacaagagaagtgaagttggcagttatgaggccactgcacagggccagaaaagagacaatagcagcttacaatagtaaattgagctagttctaaatacctttagaacatgaaactgtttggtcttttaagtcctagcaaaatgtaccaagagctctgggattgcctgggatcttatttcaaatgcagagtctcaggccccaccccaaatctattcattttgtgtttgaattttaattcccaggcaatttatatacatcaaagtctgaaaagtactgtcttagatatcatcaattttaccaaaaaacaccttagaattatttgtcagtaatcagatacactataattgctagtctccaaaatgcttatttctcttcttttggaattcggatacttgtggtgtcatgtttatgatactgtagttaaggcattgtttaaaataagaaaacaaagatggatgtagacttggtcctttgttctattcagtgtctactggagtcctctcccccacccccacacacatatcctttgatagataagtaacataaacttgatgttgggataaatatttctagtttacatacggaatatgcattgtggatgcttgcctctcctacagtataccagtttcgatagattgctgccacgcactactcccaccaccaccccagcaacaaataggagtcctgattgtcctgaaccaatcgtaataatcacacccacactggcaaactggattagggaaggacacttgatgtaactggtacaggtagggcaaagttcaagatttagttggacagttggttccctccttcctctcaaggtgtaaaagaagcagcaaattctaggagtattggaagctctctgtaccatgagggaagctggcctgaagatatggccaaaatgagagcagaactatgaaaattgtagaaaaacagagctcactccagaatcatgaacttccagatcaatcaaattctcaagaccagccaacccctatgagactttttaaagatttttttttaagagccaataaactcctgctcattgtaaaccagtaaaaacatccaaaaaaattggttttttttgttccttacaccaaaagcaattcatcctttgcatggtgtatatgtacatgcataaggaatcaaatatatatatatatatatatatatatatatatattttttttttttttttttttttttttttttgagacagtcttgctctgtcgcccaggctggagtgcagtggcgtgatcttcttggctcactgcaacctccgcctcctgggttcaagcaattctcctgcctcgacctcccgagtagctgggactacaggtgcacgccaccacacccagctaatttttttgtattttagtagagatggggtttcactgtgttgcccaggctggtcttgaattcctgagctctggcaatccacctgcctcggcctccaaaagtgctgcgattacaggcgtgagccaccgcgcctggccaagaatcaaatatcttagtctgtgcaaaacactatgctagggagatgaaaagctgaattgtataaagaggaattttagaagttagtcttgggtgggaataaaggaaacctttaaagcaaaggcaaggcagaaaaacgttaatcaatttcagggagggacaaagcaagagagtttgacccaagtacaaaatacaggtagaacgagtaatagtctgaagaaactctggaatgcagaatgagtatagaaaaaagtcacaggaatcatagtatacttatatgaatgactacaagattgggaagcaaaataaaaaccaggttacggtatcacccttgctaatatctcctgtcagtcttgatcaattcactcatttacctctttaggtctaaatgtcctcatctgcaaaattagcaggttatattagatctaagattgggtcaatccgaagattctgggcaacctctgtgagggtacttgagagtacctgagttcaacctctgagagatgttcactggtaaaggcaaactgtttatttaatctaaacactgatgtggagaaaataaatcctactaagaactagaataactcatgagaaattaaaagcaaatttcatacgctatatttttaaaaaagattgacccaaaccacagaagagttcactttgtcaaaaatatgatttgagcaaataaaagaaaatgattaagaaatgtatgaaagggcagcagtttaagtgaagataactaggaaattatttcattgtaacaaaaatgtcaactgatatgtcattttttatatattcattcaagaactgagaagcattctataggttatttcatatctaacccaaccatacactaaaacaaatagtacgaaatgacagacattcacagaactgtaaactttcaacattctctactatatccatatctgtccttgtctaacttcacctaagaggaaattcaaatctactgatgagatttagaaaatcaccggtttctgaaatgctatgaaccaccacataccttcatattaaacagcattaaaagtaaccaaaaacacattattaaatagcttgtcatttctatctcttattaatatattaatttaaaatcaaattatattttgtaaacatttgataagctattaaagtttgttctaaaaggcataattctaaaaacaagggctcaaggtaagctaaacggtaaaatggtttaaagtgttctttaatggatccttctttacaatttgaacagcaacttttcatatctgacataaaatctatagatataaatcacattaaagggctattctttcctgattatcaatctctgtctctttgtggaaccttagggtcacatctgacctaaaaacatgataaaagaaaaccaaacaagaatgtttcataaagatataatgaacttgtaatattttttaaatgtccttataatgtaatttgaagatgttcttatttaaaaaccaataataaatcctatgtatgaaatattgttcaaagtcatgtggagataagaaatatttactctagaatcaaatacatattatttatttgtagtatacatatttgtgtatgtatgtatacctgtatttggaggttgagtggaggtacaagagaccttaacaaatattgctatttatcggtaacataaacggtcaaatctaaaactttcattcaactttaaggcagaattttttatgttttatatcaacttttctgtgttcctatttgtaagcactatataaactagataatataacatcacaacatggccacaaaatatttgactataaaaagaaaaaaataagcatttggggaacaattctattttatgtgattattgctaaagaaacctaagatttataaccaaagaatgaagaaactcaatataggataaataaacctccacagaagaaattcagtcactcacagtaaatagacaaagcgaccattttagctctttaaatgtaaatgaatagagacaatatttaatttttccttccagatgtcatagctctacctaattttactattcatcctttgcatgaaagtaagagaggacacaaacaaatggaaaaacattccatgctcatggataggaagaatcaatatcatgaaaatggccatactatccaaattaatttatagattcaacactatccccaccaacctaccaatgactttcttcacagaattagaaaaaactactttaaatttcatatggaaccaaaaaagagcccatatagccaagacaatcctaagcaaaaagaacaaagctggaggcatcacactacctgacttcaagctatactataaggctacagtaaccaaaacagcatggtactggtaccaaaacagatatataaaacaaatggaacagaacagaggcctcagaaataacaccacacatctacaaccatctcatctttgacaaatctgacaaaaacaagaaatggggaaaggattcgctatttaataaatggtgttgggaaaactggctagccatatgcagaaaactgaaactggaccccttccttacaccttatacaaaaatcaatccaagatggattaaagatttaaacgtaagacctaaaaccataaaaaccctagaagaaaacctaggcaatgccattcaggacataggcatgggcaaagacttcatgactaaaacaccaaaagcaatggcaacataagtcaaaattgacaaatgggatctaattaaactaaagagctcctacacagcaaaagaaactatcatcagggtaaacagacaacctacagaatgaaagaaaatttttccaatctatccatctgacaaagggctaatttccagaatctacaaggaacttaaactaatttacaagaaagaaacaatcccatcaaaaagtgggtgaaggatatgaacagacacttttcaaaagaagacatttatgcggccaacaaacatatgaaaaaaagctcatcatcactggtcattagagaaatccaaatcaaaaccacaatgagataccatctcatgccagttagaatggcgatcattaaaaaatcaggaaacaacagatgctggaaaggatgtggagaaataggaacgcttttacactgttggagggagtataaattagttcaagtattcaagtattgtggaagacagtgtggcaatttctcaaggatctagaactagaaataccatttgacccagcaatcccattactgggtatacacccaaaggattataaatcattctactataaagacacatacacaggtatgtttactgcggcactatacacaacagcaaagacttggaaccaacccaaatgtccatcaatgttagactggataaagaaaatgtgacacatatactccacggaatactgtgcagccataaaaaagaatgagttcatgtccttttcagggacgtggatgaagctggaaaccatcattctcagcaaactaacaccagaacagaaaaccaaacaccgcatgttctcactcataagtgggagctgaacaataagaacatatgggcacggagaggggaacatcatacaccggggcctgtatggggatggagggcaaggggagggatagcattaagagaaatacctaatgcagatgacaggttgatgggtgcagcaaaccacaatggaacatgtataactatgtaacaaacctgcacattctgcacatgtatcccagaacttaaagtataataaataaataaataaatatttttaaaaagtcctaaaagatttaaaaaaaaaacagaaatggaaaatgttaatagatatattctctattaaagaaattgaactcaactactttaccataaagaaatctcaggcccacatgtttatatcggtgaattccaccaaacatttaagaggaaataatactgaggccgggcaagatggctcacatctgtaatctcagcacttagggaggctgtgacaggaggatcgcttgagcataggagttgaagaccagcatgggcaacatggtgaaaccccatagctacaaaaatacaaaaattagcccggtgtggtggcatgcacctttagtcctagctacttgggaggctgaggtgggaggatggcttgagccctggaggcagaggctgcagcaagccgagattgtgccactgcactccagcctgggtgacagagccaaaaagaagaagaaataataatgaaaaaaaaatttacaacagcatgaaaaatatgaaatacttagctatattttaaaatttatacagatcttataaaaaataaaaccataaaatagttaagagaaattaagaagctagataaatgaagaaatatataatttatgtatacaaaatatacagtttatagatttaaagattcaacattttaaaaattgattttatatattcaacacaatcttaataaaaatttttagcaatttttataaaactgaaaagctgattctaaaacacatataaaaacagaaggtaggccgggcgctgtggctcatgcctctaatcccagcactttgggaggccgaggcaggtagatcacaaggtcaggagatcgagaccaccctagaaaacaaggtgaaaccccatctctactaaaatacaaaaaaagtagtttggcatggtggcacacgcctgtaatcccaggtactcaggaggctgaggcaggagaaacgtttgaaccagggagttggaggttgcagtgagccgagatcacgccactgcactccagcctggcaatagagcaagactccatctcaaaaaaaaaaaaaaaaggtaataacagcaaagtaactttagaaaacaaagttgtaagacttcacacccttcccaccatattataaaactagaaatgaagagcactggttattagatgaagaaagagatgacaaaatgaagaaacaactggtactgaaacacctggctatccacatgagaaaaaaaaaaagacgaatcttttctttcacctaatatcatacaaaaaatacttaattcaaactggatcaaggatataaatctagaagttaaaactataacatttccaaaacacaacagcagattttttttataactttgggataggcaatgttgttagactggacagcataacagaaagcatagaagaaaatcacaagaatttaaaaactgacaaaataaactttatcaaaatttaaaacacctggtctttttttttttttttttttttagacagagtctcgctctgtcgcccaggctggagtgcagtggctcaatctcagctcactgtaagctccgcctcccaggttcacgccattctcctgcctcagcctcccgagtagctaggaccacaggcgcctgccaccatgcccagctaattttttgtattttttagtagaggcggggtttcaccatgttagccaggatggtctcaatctcttgacctcatgatctgcccgccttggcctcccaaagtgctgggattacaggcttgagccaccatgcctggcccaacacctgctctttaaaagaaccatttataaaataaaaggtaagccacaaattgtgaaaaaaaatttaacatacatctaaatgacaaatgaattctttacagaatatataaagaattcatacaattcaataagacaaacaacctaattaaaaataattagcacaggatttgaacaggcatttcacaaaagatatacaaatggctaataaagcacatgagaagatgcttagtcagtagagaaatacaaataaaaatcacaataagctatcactatacacccactagaccggctgaaatttaaaagagctacaataccaagcactgacaaggacatggaacaactggaactctcatacctaccttggtggttgaattgtaaagtcgtcaactactttggaaaatagtttgtcaatttcttgtaagcttaaacatatacttacagtagcatgtagcaatcctactcctaggtatttcctcaaaaggaataagaacatatttctacaaaaataacttgtatgaaaatgcccatggtgcatttagtcataaaagtcagacactgaaaacaacccaatgtctgcctatagctgaatggataaacaaaataattcaacttagtatttaaaaaaacaaaccaataatacacacaacaatgtgaacgaatatcaaaaagtttatgctgaccaaaataatccagagtacctactatttgattccatgtatataaaattttatagcagataaaactatctataataacagaaatcagatcactggttgtctgggattggatatgagtatatggagaggaattgaccacagtggatcacaggggaattctctaggatgacaaaatttcctatatctttattataatggtaaaatcacagatatacacctttatcaaaactcctcaaattgtatacttaaaattttattacatgcaaactatacttcaataaagtttatttaagaagtgtttgtttgtttgtttgtttgtttgttttttcaggcaggatttcactctattgtctaggctggagtgcagtggtgtgatcttggctcactgaaacctcaatctcttgggctcaagtgatcctgccacttcagtcccccaagtagctgggactagaggcatgcaccaccatgcccaactaattttttcgatttattgtagagatgaggtctcactatgttgcccacgctggtctcaaactcctgagcgcaagcaatccactcacctcggcctcccaaagtgctgggattacaggcatgagccaccatgcccagcaagaagtttttaaaaagtggatggacaaggtatagatggaggaagcagttaaaatgctcataccaaaaaataggctcatatagcaaataggtaaataccttctacaaatcaatgaggaagagacagataaccaataagaaactgggtaagagagcaacatgtacttcacaaaagtaaaaaatagataatatataacaagcaggagaatagactcaattcttttaaaaattcaaaataaaagtacatcagaatgccaaaataaaaatcaccagtcaactgttgatgagaatgctgaataataaagaacaattctacactgaggctgggagtggtatatacttttgcaagatagtgtgacaatatctattaaaagtgaaaatatgaacattttgtaatcaagtaattccaccatacagaaatgcacaaggatgtacgccagacatataaaatattcaaagtgcattattcataatagctaaacactgaaaacaaccaaacaaacagaagagattatttaaaaactaatggtctacatattcggaatagctaaaaattggaaataatccaattacctatcaacagtagaaagaggtaatgaacagctagcagtctatacataatggaatactatgtagtaatgaaagagaagttgaaaaatgtaagaaaataattaaatgttggaaacataatgttgaaataaaatttccagaataaaatacatgttttataattccatttatataagggtcaaaaattgggcaagggccgggcgcggtggctcacgcctgtaatcccagcactttgggaggccgaggtgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaattgggcaagaaattacagtgctaaaagaaacatacttaagttttgaaagaataaaacaaaagcaaatgtcaaccataaaattcagaacagtggttaccttaacagggcagaaaggggttgtgattggaaggctagaaaacttctcacaaactcttcgtttcagtatcacaaaaaaattaaattaatgatgttaaacatacattgtttctaaagttaggttttcagagtaataagttttttaagaaataggttataaaaagcaaatttttattaagtttgcaattaagttcttgttaagttttgaaataaaaataaactacacacaattttaatgctaaaatagcaagcccttttcctaaattaataatgtttaatgctaattaaacaatttgttttggtctcacaagttttgtatttaaaacctcttttaaagacttttaaaagaaacatatacttgcttttaaaaacaaatcaaagaacgacataaaaaagaaaaagaaatttctctcttctacctcctccctgtttggtcagctgctttctacagaggtagtcactgtttagagtaagatgtcattcctatataatggaatcaaactgtacatcattccatgtcaggaccttctttcttttacatggctacaaacagatgattacatttttagttaaccaagcattgcttctgctaaacacgtttaagtgtagtactttccttctcaatttgtctcaaaatcacttacactataaattacttgtctcactgaaaacaatttaaaagtgaaatcacttcagggacaataaatgaagaagtttctcagtatttcacttttggaggtctttgtacttgatcccttaccttaaagtgtgatctttaacaaaaaaaaaaaaaagctatctacagaaactcagaaagactcatagaaaagacagaaaaatgaaagcttagaaaatctcaacagcaaacaaaagtcaaccaatgacaatgtgtgacagccacctttaattctgtagtgattcctctgtcatgcaacgactcaaagtattgatttctctcagcatgaaaaagcctaagccaatgaaacagacagagcagcaaccccctcctcccttccccccataacagcattcaaggttaaaacaggcagaacacttatcaaagtatctcttccatttcttcttgttttaatagactggatacaacatgttgggttcttatcgttacaaactatagtcctcagacaatatttttaaataatttgaagattaatataggttattctatttttttgcttcacacttttggtaataaaaaacttgtttcaaatgctttttttttctgtgaactcttaacagaagtatatataatatttgtaaaaacaagccgacactaataagaaggctatagtttctacttgtgtgccaattccacacataatattttgttttcattatttctttagagtacttattaacaataaaacccacaaatacctaagcatcttccaaaaagacaaagtgaatccttcaacaatgcaaacacacatcatacatctgtttggaaaataaagtaaactatggctgctatctgtgttcaagaaaatagtaataacataaaatgtaagcaaaggatagggttgaaaccacagaattatattttaaaactatagtatgagacaaaaataacaatcagctctctgtatccccaggttctacatctacagattcgaccaaattttttgttttgttttgtttttgagtcagaatctcactctgacacctaggctggagtgcagtgacatgatcacaactcactgcagcctccatctcccaggttcacgcaaccctcccatttcagcctcatgagtaactgggactacatgcacacatcaccatgcccagctaatatttttctgtagagacagggtctctcagtgttggccaggctggtctcaaactcctggcctcaagtgatcctcctgcctcagcctcccaaagtgcttggattacaagtgtgagccactgcaccaggccttgaccaatttttgatctgcagttagtcctggaaccaattccgcatggatccagagggatgactgtgtatcttcacaaaatatgtataaatggttacacacagagaggtaaaattaagaagctttaatttcttaaactttactttctgctaatctgcaaaagagttagatgatcttaagcaaatcctatcatcttttaactctacctaaccaatggatttttaaaagcataaaaaactagggtcttttagttgtattagcaaggtctcctacttatgaataaatatatttgctactacaaataggtaaatcttacacttaaatatcaaggccagacatggtggctcacacctctaattccagcacttagggaggtcgaggccagcaaatcccttgaggccaggagagttcaaagccagcctgggcaacatggcaaagtcctatctttacaaaaaatagaaaaatcagctgggcatggtggcatgcacctgtagtcctagctacttgggaggatgaggcgggaggattgcttgagcccaggaggttatgctgcagtgagccataatcaggccactgcattcctgcctgtgtgagagagtgagaccctgtctcaaaaacaaaaataaatttcaaataaaagcagttcaagaacaagcatgaaaaccagaaagaaaataagcaattatgtataaaaatcataattaacaatgtagttaagagcaccaactctagagctagatgacttgagttttaactcttggttttgacacattcatgcttaagcaagttatttgaaaccctgtgcctcggtttcctcatataaaagaggagatgatgtggtatgcttttcaggaggatcaagaatagacataaaatgattagaacattgccagtcatataaaggtaacacctaacatttattgtaggcttaattgtgatgttatcaaaatacgtaacaaatagtccctgtcttccagcatctcactgtagtttagtaaaataaatacaatatgagaaagaaataaactatgagataactgctcaaagagttatagacagtatgtttggaaagagagaaaaagaaggaactattaggaatcagggagaggctgggcacagtggctcatgtctgtaatcccagcactttgggaggcgaggcaggcaaatgaataccttgcactcaggagttccagaccagcctgtagagatggcaaagtcccatctccacaaaaaaaaaaaatacaaaaattagccgggcatggtggcacacatctgtagtcccagctacttgggaagctgtggtgggaggattccttgagcccaggaagttgaggctgtactgagccgagactgcagcactctactccagcctgggtgacagaagagaccctgcctcaaaaaagtaaaaagaaaaaagaaaaaaaaaaaggccgggcgcagtggctcacacctgtaattccaacactttgagaggccaaggcgggtggatcatgaggtcaggagttcaagaccagcctggtcaagatggtgaaaccccatctctactaaaaatacaaaaattagcctggcatggtggcaggagtctgtaatcccagctactcagaaggctgaggcagagaagtgcttgaacccagcaggtggaggttgcagtgagccaagatcacaccactgcacaccagcctgggtgacagagtgagactttgtctcagaaaaaaaaaaaaaaaaaaaaaaaaaacagggagagtttcacagaggaattaaaggctaagtacctgttcaccaagaagaaagggatagaaaaaataaaatgtagaaaataaaagaggtcaaaaactaagagaacaagctcaaataaatgcatttttttaagcaaagataggaataacagaatgagacatgtaataaagagccttctctttttaaatatcctgatacatgtttatatttttcttgggtaactaatacattttttttaccaattaccttcataaaggaattattcctcaaaggtttatataaatcatttaacatacaaaatattaactagatttgtatttctcagctgatgattgttataatgttataatttctttaattcatattcaaatgtattgccaacacagaccatttcaaaacaacacacctgaatattaactgggttataaatactgtttctcaaactacctgtagggaagggccagttttgttttttttttaacctttttaaacacctttagcactgatgcctttgatgacattgccagacattcaagctataaaactttttaaatattcaatttctgtactcagctctttgtggattactaagaagtaatttagtcagcagaccatacttaaacagcactaatataaaaaggtaagtagaaggaaactatttttatcaactcaagtatttccattttgctttgtatggtaaaatacttgctttgcaaaataaaatactttgtattataaaatgcttggtcttatattcagtgctttaatttttattaataaaccagaaacaacaatagccaatattctaagtgcacatgagaaaagtctaaattataaacaaatgttgtataaaatacactgtaaagatttttaattagcttagtttcttattaatctttattttaaaatccattaagaaaaggaaggctttacattagtacataatttggtctatggttaagataaccagaagataccataaactgaaagcttaagtaaaggcttgatatatctatgagggatatattcagacattttctttgaagagattttcaatgcattaaaaggtctggttttcaaaatatattttacaagaacatactgagaagataatgaaaaaacactcttccagtttggatttaatttgatcaacaatgcctgcaacagttttacctacatataaaccttttgctttttctagcttgctagctttaatagaaatatagtaatagtaagcatccgagtaaaatagctgtttttttaacctggtgcagcatcacttaacaatttgcaaacaaaatctcatcgattcacttttaagtggtcttcctttatcccaccaatgatagttcctttagtttcacaaacagctcaaaaattattatttcttgttatatgtatgtatatacctgtcctttatacaggtaagaatatgatgttcaaaagatacctacagaagagtaacagcagaaaatattgaggcctttcttttaacctggtcattttcaaaaagctaaagttgagagtatgacaagtaaaacacatcatggaagaacctctaaaaatagtgtgttccagactaaatacacaagactttggatatgaaaactgaaaaatattattactgcatagtccaggtctatagacgctacaacatatatgataaattggggtaagagtttccttaaaaaaatttgatggtgccgttgtcactcaacctgaggcaggaaaaaagggtaacactggactgaggaaaaagcaagattcttctctaagagaggaagcaggtgatcctgaactcgagaaagaatctggtcaaaagagctctcactgttggagagctaaactggcttctgcagcatggcaaagggagacgacctggggaaagagggagacagagtcaagaaaaactgcctgttcaagagtgtggcctatgaatcctaggagatgcaatatctagtattgttttgttttcctcttctgcactgtgatgcccttctatcattgcaaggcccacaaaagagaaaaggagaggtctatgtccacgctttgggcaacaggataaagaaaaacagctactgcctggaaaagttgtttgtaagatgggaagaggtattctccagagctctgatacaactctatccagcaatagtgtagataggaacctgatggcagagataagagtcctagattcactgtggcacatataagcattcaatttccagagattacttgaagaaaaaaatagctgttattaaacacttaatatggattcagagtaatgggtacattaggtttatcaaatcccatttattcctgacaacatagctacaggtaaacatcattattatcctgatgtaaaggtgcagcagtggtgtcttacttcacatggtttagtgaatgacaatgccaagactagtcaacaattttatctgatgaggtagtcagagctaaggtcaactgctgcagagtaatcatgtctcactggttgggtattcaaaccctagcaatttggacattaaaaagaacttgaatacttgtcagttggttatactggtagaggttgagtatcccttatccaaaaattcaaaattcaaaatgctccaaaatctgaagctttttgagcaccaacatgaccctcaaagaaaatgctcattggagcattctgatttccaggttttcagattagagatattcaaccagtaatataatacaaatattccaaaatctttaaaaacctgaaatttgaaacacttctggtcccaagcattctggatacgggatactcaaccggcattttatctttcatatttattgatattatttttatcaaaggtgaagaaaataacaatgatagaaaacagaaaagccacaatttatatttgtatatatagtcatgcatggcttaatgacgagggcatacatcatactgtttatagcctaggagccatacaaatatgtacagtatgttactgtattaaatgttgtaggcaactataccacaatggtaagtatttgtatacctaaacacagaaaaggtatggtaaaaatgggtataaaacaaacaaaaaaaatggtacagggcacataccatgaatggagtttgcagcacttgaagttgcgttgggtcagtcagtgtacaagtagtgggtgaatgtgaaggtctaggatattactgtatactactgtagactttataaaccctgcacagttaggctatgctaagttaattagaaattattttcttcaataataaattatccttgctcactgtaacatttttacttcataaacttaaaattttttaaaattgtttaactcttttttaataacacagtttaaaatgcacattgtacagctgtgccaaaatgttttctttctttatatccttattctataatttccttttttttttttttgagacagagtcttgctctggtgagacagaggctagagtgcagtggcacgatcacagctaactacagcctcaactcactgggctcgagtgattctcccacttcagctttctgagtagctaggactacaggggtgtaccaccacacccctggctaacttttttattttttgtagagacaaggtctccctatgttgcccaagctggtctcaaactcctggactcaagcaatcctcccaccttgaccaaagtgctgggattacactgtgcctgatctataaaccttattctagtttcaaatttcattttttcaatttttaaattttgttaaaaagtgagacacaaacacacacattaggctaggcctatccagggtcaagataatgaatatcactgccttccacctctacatcttgtctcactggagggtctttggggcagtaacatgcatggagctctcatctcctatgatgacaatgccttcttctggaatacctcttgaaagacctgactgaggctgttctacagttaacatttttttttaataagtaaaaggaatacactctaaaataacaagcatagtatagtaaatacataaaccagttacacagtcgtttaatatcattaccaagtattatataattgtgctgcactttcatacgaatggaaacacaagtttgcttctgccagccttaccacaaacacgtgagtaatgagttacactatgacattacaatggctacaatgtcagtaggcaacaggagtttttcagctccattaaaatctcataggaccaccactgtacatgtggtgcgtcatttaccaaaacatcattatgtggtgcatgactgtgtatatataaagcaaatattgtcaagcttagcatttcgtggttcctatgctagagatgcagaaatataaataaagacattaactaaaatgtccaaaaccgccatggtagtagatatcaaaactggaatgagaattgacattctaatactttgctatcaagctatgatgacacaaaatctatcaatccatcatctcttcactaaatgacaaaagtgatcaacacaaagtgtatatcaagggaggaatgtgggaagagaaaggggtacattaatcactgaggcagaaccatcctgggccaaagaatggtattcttagttttaaaaaagttgtccttgactttgaccatccttcttctcactaagggtttttaagataaggtggccaactagaaacagaaaactataggggaaaaagttaggagaaaatcaagcgggagaataaagaagaaaagacaaacaggaaagcataaatagcaggttcacataaaattacttttgcactatttcctaattatgagtttactttaaaagctagtaagaaaaaatagtattataagatttcgtttgcactgtattttaaccactaaatgagaaacaaaatggggagttcaattcagtaatggtaaaaatgagataatggacaaaggtgggaaaaaagtttgtcatttaactaatctttacacagctcaagacattttgcactctaccaatttcacatgcacataggaaaaaacatataaagtcattagaaaagagcaaggtaaacagaaataacaaatattcaaggtgtagtttcaatcatcgacaaaagtgaatgaaaaggaaataccaagataattacataggtgagactccaaataactaatactgccattttacaacctatgttttagaataaaaatattacaagctacagatttgagactacactaatgagctttaaggaacctcatattattacaaagaaattaagtatcctatccaacactacatagttaattagtggcagaacaatgcctaaatcctagttcttacaaatcccaaatctgtgctttctatcatacactacagactgcaaaaacgattttacaacttacgtgtaattaaatattttaaattcatgctcttaagcatgaatttaaacatgctttaacaaaccaactcaacccttaaaaaaaatccaagtattatacaaagtccatatttcaaccatcaaattgttaagttcagaaataattttcatagagatttaaattccggccgggcatggtggctcacacctgtaatcccaacactttgggaggccaaggcagggggatcacctgagatcacaagttcgagaccaggctggccaacatagtgaagcccccatctctactaaaaatacaaaaattagccaggcgtcatagtggacgcctgtgatcccagctactcgggaggctgaggcgtaagaatcgcttgaaccctggagacagagattgcagtgagccaagatcgcaccactacactccaacctaggcgacagtgcgagacttcgtctccaaaagaaaaaaaaagtatttgcctttatacatcattaaatgctcattaagaaaaacagcgacaatccagtaagcaatgctagggaacaaagtgattactttcttacttgctgtatctactaggatacaaacagaaggtaatttttaatgaaacattatcttaatattaaagaatctaggatctcaaatgaaaaaactgattcctcaaatttatgttagctggatatggaaatcttctttaatcctaacatatgtcttctattactgacaatttcattcattcagcaattctttgggagcttcctatgttccaagcctataccagatgttgaaattaaaataaaacagaaccttttataaagaagtcaatatgtaatatttgtttccctcagtagtcaccaataatttcaaaacatttttaatggttaaaagtaattctcacaagttgtccaagaagaatataatccagaaattgctaatgtaacgtccataacaaaacaaaaggtagtaaaggtcagcctttaacgatttctcctacatgattgtaataagagaagtgatacatacaaaccatacagacccttacataagaaaatctcaagacagaatccataaacatgtaaaaattacatgtaaaatgtgttatatttgtatgaatttatcaaggttagattctcaaagagtccattagcccaaaaaaaaaaaagaactattaactcaaaatataaagaacagaacatttcacctaatatcccatttttgagccagactaagtggctcatgcctgtaatcccagcaattggagaggccaaggtgggaagatcacttgagtccaggagtttggaactctcctgcacaatatatagcaagaccccatctctacaaaaaaaaatttttttaatgttagccaggaatggtgaggcacacctgtagtcccagctaaccttggaggctgaggtgagagggtcacttgggcccaggggtttgaggctgcaatgcaccatgatcccaccactggacttcagcctaaaccacagagccagacgccgactcaaaacaattatgtgtgtattttatatttgttttatattatgaaatagatacacaaataaacactcataataaaaagcctaaaatgctatgtgccaaaacattgtcttgcctcttggtggggcaaagatactggagaaggttctctttttattattatcattattattattattatttactgttatatttttcttcttttctttgctacagtattctccagctcaaaaattaatgaattaaaacacaaaaagagccactgatctaaatcaaatttttcttaggtcagggtatttcaggttaaccttctgggaagtacctgaattctatttttaaaagaatttttgatttcatttatataatagtgccaataacaatagatttgggcatatctacattatacatatatagaagcatttcatatgcttatagttcttatacaaacacaatgaaataaattacaaaataagttgaagcagcagcacagaatttatattttttgtgattgtgtaaaatgaaatataatttgtaataaattgataatcactagattggactatcatgtaaaaatagcatcaaccaagccatgaaaattgttaaattcagtctatttaacaatgataattgataatgacaattaatgacaaaatttcttttgcataataagaatatgtgactcaaagtcatttttatagactaagatttcagtatttacttaacacatacagcagattctatactacggaaatggcttgttgtaccgagtaatgtaataattgtaatattgctggttacataaaaaaatgaattcacatgaagtgatgtatcatgtactacatgaataaaaatttgacagaagtttaaaaatagaaaagtaaaggcagattatggcacagacttcaagttatttgcccaaatcctcttcccccttcaatagtaccaggggctcctgattcttaagagccggtaaccgtctagaatgaagtgtatatttcccaatttcataccattttgcttttattaataaagctaatgaaaatctgggaaggaaaaacaatgaatttaagttttagacaaagtgaatataaacgggtaagaagacacctaggtaaagaaatatggcagatttttgaaaatgtgaaactggaaatgaggtctgcattatagtcagtaacattaaaggtgaatcccaccaaacctttaaaagagggtaattccaatgctacccaccctgtctctgggcatgaaaaaagaatggaaattgtaaagttattcacaagaggcaagtataacactgaagctaaaacctcacaaatgactaagattgcatagaaagttaaaacaaccacaacccaatttaagaatagaacatgacaattacaaacaaaacattagcagatacaatctggcaagattaaagaaaaaactaagaccaaaatatattggcataatattgacatatgtaacatcaaaaaaagtatactatgaatatcaactccactgctccacttaaggatgacaaaattgaacattcttcatttacagaaaaactccataaaaagtactaaataaatatttcattaaaatgataaagcatatatatatacttcagatcaaaggctatgtcatacttagtagggaaacactgaaacacctctgctaaagtcaggaacaagaaaaagatgctattattttttaacatcacactggtgatagaagtcaattcaattagacaaggaaacgtaattacaagaattaaagttggtaagttgataccaataaaagttggtaaaactatcaatatctgcagaagatgtgagtgcatgcctgaaaagcccaagagcatcaaatgaaaacactcttttgaatcagacgagctgaatctaatgttagattaacaagccaaagaattttgaaaaaagaaattcaaaagggcaataagaaggaggaagaggaggagaagcaagaggaacatagacctattagtatcaaaacacattgtaaagactcaataattaaattgattaatatgctagcttgacactagtatatgaaatcacacacagactaatgggaaaaaaatcaaactcgaaattgaccccaaacatacaggcatttagtatataacagtagcatcttaaatgaaaacttagactaccgggtaggtggcatagggaaaactaggtaggcatataaaataaattgaattaataacacaatctgtactaagataaattccaaataaattaaatatttaaatttaaagcaataaaactatagaaatattagaagaaacatatgggaattcctttataatctatgtgtttctacccttccaactaccaaacagaaattgagatccatgagagaaaatatccacacatttaacaaaaaaaaaaaatttaacttctgtaaggcaacaaaaaataccatcataactaaacaaacaaacaaattggtaaaaagaaagaaaaaattctaacatatatcacagagttgattccttaatacatgcagagcttctaaaacaaaatcaataagaaaagagacacaatcaatggaacagctgcaaaggacatgctcacagaaagggaaatactaaggttcagagatcatcaaactcactcataaaaaaccaaaaatgtagtttaaaacaacactgagaaatacaaattaaaactctacactaccatatataacctatgcaagtgacaaaagtccaaatatgcttcataacacattctataaggaaacattcacactttgttgatcaaagtataaaaattcttcagaaaataatattaagtttaaaaagcaaaatacagaacattatttataatatgctagcattcatacaaagaaagataggaatatgtatctctatttgagtgcatatgcataaagaaaccctgaaaaattcatctaacagtggttttctgtaaggataaggggtggaaggcatcctggaagagattagaaggagatttttcactgtgtgctttcttataattttttattttaaattacctatagaaaaaactaaatgaatagattgaaaaattttaaatacttaatatcttctatataaaagtttcagataaggtagacatgagattgttaaaacagcacagaaaagttaaaactacaaagaaagtattcctgtgaaagacctatacttttaaaaaagcaaaagaaattggatgaaactaataaaagattcatgagaaataaaaaaccaatcagaaaaacatcaagaaagtcaagcaaaaaaggagtttaaaaatggaagggtctgtcatcagtgtcaaaaactgcagagaccaaggaagataagaaataaaaaaggaccactgtatatataattagtagatcagtaatgatattgaaaacaacaagtttaatccatttgtcctagaattggggatgaaaaggagaggagagaagccaaactatgacactgaacagtggaagggggtgagacaataaagaccattctagcaaaaaagtctggtagaatcaaaaagcaagagagaaaatggaagcttgagaattccagcagcatttaaacaaggttatcaagctctagcatatgataattagacagaggcatgaatatataaatagtgagaagctgcaacatacttccagaaaggtcatttaaaataaaaaaattttcagtgtattaaataataacttcattcaaaataatacacaatttgctaaagaaaaccagacattagtcaataaatacaaaaattacctatgacatcaagtaaaagaaaataagtcctttcaatcaaaactactcttaacaataagcagcctatttcatacttaatgagggcctgcaactgatagttcataatattctggaaacaggtatcaaggcaaatctcacaagtaacaggcgcatcatctaaggatctttttcacattaagaatcctattagaaagaaaacactaaaaggtaattgaatttccctcagttatcttcatctctgtcagctcctgctacaataacttactctccagagcagagataactcaattctgttcagcaagcatatgttatgaatctccaaagcaaacttgtctaaatcattctggtcttctatcaaggttgcctgtggatatgaactctgacagaaagcaaacaaatttatttttatcttttcaataattcacttctttatgccttgatagaagaaatcatgagataaatatatggtctacagttatgttataaagtcgggctgaaatggtttccatgacttaaataaaagacttaatgaataatccttcttaaacacaaagaaaatggtatcaaaaaatagaattggtaaattacctgaagtttcaatttgtttatactgttgccagatccttattatgatctcacaaatgctagtttgactatttcatttttgaagctttatagtaaaacatgttttataaaatgctagaaaattgaatttttaaaaaagataccaacaaaataaataatagttcatatgagaaaatgcatttcttatcggtattttaagccagctggcattttataacagaaaagaattaaaaaggctatataatagagacaaaaattctatgagtgtgagtttcttaagttggggtatacatagatcattgctattcagaacaaaaaacaatccaaattcaaattgttaatgaatacaaccctttcagtcataatccctttcctttaacacaggttaaatttctcaaagattctggcttggctattcatgacctttaaattctacactagtggtcacaataatagcaacaatgataatcactaacacacttcataatgtgttttaacctacattatataattttactctccacaataaaccttttattaacgtttcattatatccatttcatagaagggaaattaagactcagagaggttcaatgaattttatccaatattctccagctaataaattgtgaagcctagaacccgaacatgtttttggaaaccatgttccttctatcacattgtaacacactgtttcaaaattaagttacccttaaacagcagagaaaatgtcaaaaaatgtagccaacaatgcgccttgaaattttgatgtaaagtgtgctaacttgtatttcataaatcaaatggcttatttcttcatttcaagcacaatcagtatgtttttggattgaagacctaaagcaacccattgcagtaatttgagacgctattattaacctataactcctgctaataataggctgaaaataattctaccttggcctttctcatgcataatccatttgtttccatagagaaccatccttactacttttaatcaggtaaaaaagaaatcaaatgtgtggactgtaattagtactcatttattgaataattatttactgagcacctactatgtataggcaatgtacaagtctctatggatatgttatgaatagacatagagttcttaccttcatgaagcacacaaaagaacgaggcaggaaataatcagggaataaaatatataattacaaacaattattaagtgctatgagatattataacagaaagatcttagttagatttacattgggtgattggtgggggtaaaggatgagaggcagagaaggcttctgtgtaaaagtgacacttgaaggaaaatctaaaagatgagtagaagatgaataaaagggtattgtgactaggagcaaaggtaaatggagaatgaggttttgtggttgatattaaggattgtaggtttaacctaagagcaatgggaaggaactggatgtttctatgcatgaacaacatatactaaatttcagaatgactacactggctattctgcgtaaaagaaagaaaatataggtggggaagaaaaataagacaagagattactccaaatgttttgaactatagatgtgatggttaagataacaaaacacagtattgataacaaatgtttttggaggcaaaataaacagaacttgatggtggacagacattaagtgtgtagtaagggaaaaaatgggtaatgggtgatttatgtaagcaagtaagtaaatggaagtgatatttctcagatgggaaaaaatggaggagtagttaacaggggaatatacagttttagaaagtctctccccaaaagtggggcttcttataagaaatttcaagtggcaattacaagtatacagtggtatcacacaggtttgaagctcggaaaagaagtcacaaagacaaaaatcagaaagttttagataataaacaaatgctaacaaaaatagggggaagaggtcctcagaaatattgggtcaaagtgaaaaaaaaatactatatttaattaccttaagataattttccattcacagaaaaaggatatattctggcccagctcttgattacaggtagtaaacatgagccaaagagacgtaccaaattccctatttttcttctttttcagataattagctaatctttatatattacttacatgtgaattactttgaccctaaacaaggcagtgaagaatgagtgctttacctcctacagctatctatcttcatgtaccaataacgtgaggaaagatgtagactcattaattagaagaaaaagaggcccttgtttattagaactacactttacgtctctgcttgcaaactcaacatatcagttcggttggctaaaggatactattattcaggctaagtttacagttctatctctgactgagagctaaatgtcccccaaaaagcaagttcatgaccacagattgcaccactaattcccaggagctatctcataaataagtaacagacgtataaaagaaagctacatcaaaaaaaatttgaaagtttcagtatgaaccccaatgaaaaaaaattgccttacctgaatatcttattaactagagggcagtgatatttgtatgcacagagagacccttttgtggttaaaaatcacaggtttcaggtataacataggaaacatagtgacacaaagaagtcaaatctaagaagttaattttttttttttttttgagaaagagtctcactgtgtcacccaggatggagtacagtggcaaaatctcagctcactacaacttccacctcccaggttcaaacaattctcctgccccagcatcttgagtagctggaactacaggtgtgcaccaccacacccagctaatttttttgtatttttagtagagaaggggtttcaccatgttggccaggctggtctcgaactcctgatctcaagtgatccacccacctcagcctcccaaaatgctgggattacaggtgtgagccaccacacccagctggaagttaaatttgcaaccacaatataatttcaagagttgtatttttaaaatagcattgtcaggtatgtcaaagcaaagtgccaagtttatttagtaagattcactaccttctagagaatatgtaagaaaccatcaataactataaataactattaaaaaacccatcaataactataaaggtacttatgtccagcagttgtaaaaattacttttaaacacatttctgtgtaacttctcctaccagagtaatgataattgggacacaaagtgccaaagtaaaaattatttgtgcaatgtaaaaaatacaggaacagaggcaataatatcaataaaagaccttttaaaatgctcagtatcatcaatgggtctcttctgaattcaaaagtttactcactgatgtttccaaggtttatgaaggtactcatttagaagagctcatcattatataatgacaccctatctagtccatttcttatcattaaggaagagaaatcattttttactcaattcttctggtgcaactcaaggacaggcagtatactgtagcgattaaaagagcagaacataaagttttgagttgaaatcactgagcaatttattaatcagtctttgtcttttcttcatctgtaaaacagagataataaataatgcccacctggctcatgggttatttattgtaaggattaaatgaatcaatgtatacctgacccataaaatgtatgcaataaatcatagctactattaatgttattagtatccccatcctcaacgtttgagtatccagttagggccaggccttgtaagtaatccttaaagatttaatgactacaaattccctaagttctaagatagtccagatacattaacatgttgatgactatattataggaataaaaaaataatgtgctcacaattgtttgaactaataaaaaaccctttagctgtctaaaggaatgccaatgtcctaatcaaaacataaagtgaggtaaaagtttacaattttttctccagaagtaatattttcatgtcatgttctctcctcagaaaattccttaacttgtcacctgacaaccaaatttcacatttactggcaagaacgaagcaccaaaaaagttcctgaatatagcaaaatatttactgccaaaaaattacgctacgattacaattctactggacaagacatgtaaaggagagaaaacagcaacatccctaaaaagcctttatcaaagaatactaccaagctacaaaacggcaaaacccaaagagattcctacttaataagcaaaataaggagtggttcttttccaatatatcacacacacatttaggaggaaacacaaaaacacacagaaacattatgtttcgaaaagccacaaagaaaaccagttttttggttttttggattttgtgtgttttgagatagggctttgctctgtcacctgggccatggtacagtggcccgattacagtgcactgcagcctcaaccacctggactcaagcaatctgcccacctcagcctcccaagcagccaagactacaggcatgtgccaccaagcccagctaatttttaaatttttgaagagatggggtcttgctatattactcatgctggtctcaaactgctggggtcatgcaatcctcctgctttgacctcctaaaaggctaggattataggcatgagccactgcatccagccacagttctttataattcaatcacaaaatgttgttggtatgatcatctgtaccataaagaaatataatcaatgacatctcagttcatcagccattgtcatacaaggcactgtttgctacacataggtagagaaggaaagttggcatattacattattctgtcctatgttcaggaggcaacattccttacaatttttcctgtgaagaggatttcaggaactcggaaaaatcactcaacaaaaggaaatgacaagcaaaaagtccaggagattgattttcaaacttttggttttggcagtactctttttgcctatgtaactgtaacgtggcaaagtataatgaaacctattcttttaaatttgtgttttaacaatatttgtctaataagtgaagtaaatttttatgcaagcccaagaatgtaatacagataaaatcatgtggcctatccctgttcacagtattgcctgagataccgtaagtgatgatctaaagcaatgagttttgaacatatcacttctagtttgatgaaattagggaggagttaaagggatttacaatgctaacagtgaaatagagacacttttattaaatcgacaaatacaattatcacattttccccatataaaaccaaagacatgaggaacagaaggatctctgggtaaatatgaaataaactttgaccatttgtggctgctgatggagatcagatgagtgtgctcctaacaaaaatattcaattagtttgtgagccagtctgatagtttagaggtgtgctattcaagaatggtcgatcaacgtttctgatgcaagtctaagtaccacttctttacactccacaatgagataagtatagaaattgagggaatttagaaaggtttatagcaagtagacatggccacagcatccaaccacataatcagtggactcatctcaataaagtttatgtcttactgaattccctttatgtggatactagttatgtacagtacaaatacattatgtctaatatttcaagaacagtttataatttgtaactcaaatgtacttgtttatataacatttttacaattattttaatgaaagctattattttaaatttatgttttaacagtatttgattaatatgggaagtaaattttttattatctagttttaacgatgtttacaattagcaaaacaaacttcactagacttatttgacaaaaaagacatgccttttcataatgtatcaatagtagcaaacaaatcataactgaagtaattacaagaaaagattccaatctaactaaaattttatatcctaaatttcaactaataggaggaatgagttcaagaaatctattgtacaacatggtgactctagttaataccaatgtattgtattcttaaaaattgctgagagtagatttcagtgttctcaacacagaaaaatgatatgtgaggtaatgcatatgttaattagctatgtttagccataatgtatacacacttcagaacatgttggtataatatttaatttttgctcattaaaatatatttttttccaatagaatttataccagttttagtctaaattaagattgctaatatagtgagttcagttttgagaaacaaggccatccacattcacctaacaagcagggttaaaaactgagacaccagagtcaatattatttcaccatttgtttcaggaaatcctaccccaggaagataagattgcaaagaacaaataacttcactgtttgcttcaggaacaccaatgtatttgaataataaactgcttatttagacaaacagtctcattttcagaacaataagttactcaggaaaaaatttcacttaccaactgtttactaatcaacacctacatcagaaccgttgcctcactttctcccaatcctaaaatcttctatgataaatttatacccaaccacaatcagacctcgtattgaaagacctaagatgtaaaccatttgagttcatacctagaaactctataaatacccaccccaacctctcaccctgagatccttctaagatactgtcaaggttgcattctcatttagtgcagtatataatcaacttagctttgccaggctattctggtggtggtcctgaacagttgagagatggcagtagttttgtagccataaataattaagaattaaaaagaaagtgtggctatgtgcaaagatgtaataaataaaataataaaaacaaacagtttaaataaaaactgcaaagaaaaatgttcaaagtcaaatgaaatattgaaaagaatactgaataagccaacaaaagcagacatttaatatttcacataaaaactacattgtttggtgtacttataaaataccacatcaggttgccaaaatttaaatatgtatattttatttgtatgttttgtgtgtgcacaattgccaagtgttagtgaaagactacatcataagcattttcttcaaaatgttggtgagttacagacacttgccaatgagaccagaactgaatgtattcaggaactgattaatgaacaattactaatagaacccaaaaactagctaagtacttttcattacaacttaaagactgcattgatattgctaagagaacattttgtttttaagaataagtgatatttgaacatgataatatgaaggaaaaatccttatgttttttagatgcactagtgacaaacacaactacattgctctgaagaccatccatacacccaagaagaattatactgtgagcaaatatgatttggagtctgactttcgtttaggaaatgttctgatgatatagctcgaaacaaacatcgtgtggtggttaagatttaagaagtggaaccagtttccttcatcaacaaagccttgataacaacaaaaaaaaaaatcacttacagtgtattagtgacaacataaaaattgctaattgggctgggcgcagtggctcatgcctgtaatcccagcactttgggaggccaaggcagatggatcacgagctcaggagttcaagaccaacctggccaagatggtgaaaccccgtctctactaaaaatacaaaatctagctgggcgtggttgtgggcacctgtaatcccagccactagtgaggctgaggcagagaattgcttgaaccaggcaggcggaggtttcagtgcataaaaaaaagaaaatagggtaaaaaataggtatgacctttgcattaccttcgcaacttgttttacatctatagttatttcaaattagtcaaaaacaaaaagcaaaatccaacgaagataaacagatgttcaagctaaacaataaatgactttcactctttacattttttattttctaaattttctatattaaaaaatacttcatttttataattagaaaaataaacacgtttaaatttaaaaatcgatcaatgaggagaaaagcagctacttaagaggaaaattgaataatttctcatgattagctctaaaattggtatatacagtaccctaaaatacataacactaaaatatgtaattgttaaaatgtttcacattcctttagaactgtcaagaatatgttcaataatagaatatattattacaatagcaaaacactgccatgaagtcgacagaggctatggggacagactgtactgggttattgttatgaaacctgggttctaattcagaatcatggatttaattgttctgtgatcaaagctaaatcacattctctcaatctaccttgcatacatacatcaaagatgtgttgtggtactgaaatgagacaatgtgtactaaatcacttaatagatgacgttaggccacatagcaaagagatcaccagtttatactgggtatcagactaccctggttcaagtccaagcttcatcatatactagctatatgacctaaaacaaaccactgagcctcgctgtagttttcttatctgtaaaattgggctgaagataataacatttacctcagaggactgttatgataatttattttatatttgttaagaattcagaaaaacaagtggtactatagaagtgtttatttttaaaaatttataagtactcacaaaaatgttcactattttaataaaaatattttgcttgctaattggaaaaaaatctttgaattcttcacctaaaaaatatatagattgctatatttgccagacatagtggctcatatatgtaatcccaccactttgggaggcttgagctcaggagcttgagaccagcctgggcaatatgacaaaaccgatctctacaaaaaacaaaacaaaaattagccaggtgtggtggtgtgcacatgtagtgccagctactcgggaggctgaggtgggaagatcacttgaatccaggaagctcagtttgcagtgagccaaaatcgcaccactacattccagcctgggtgacatagtgagactctgtctcaaaataacaataatagtaataataataataataataataataatcagtgctttcatggtctttatttaataaaaaaaaatactccatttttattacttcaaaaaaaccgagagaccacctggtttgcagttccactgaagctagcaacaagtgagttctacagtatgttagataaaattcaaagcaacattggcccaaagaccttttgaaaattcttactgaagttgattttaactcacatagattcctaaaagaaaaatcattaagtgataatcatcagtacatatgttttacagatatatcacattagtttaaagaaactaaaattctaaaagacaaccttctttacaaaaatgattgccaggaaacttgtatattcacacatgcacaatgtttacaaggtatgatgtttctgcatgacataatttttttcataaatattctgtttataaccataagattaagaaacaaagttaagatgtacagctcatcaatgatgtcatgacattcatggaacctctctgtaaaccaaaagcataaaatgtcaaggatatcccactccaatgataagcatgcaatgaactaaatagatgcacattgcagatctacactgtcatcaatcctctgataataaatgaaacaagtcagctactttacacacaaatcgtacattaaatagatgacaacatctttttttgcagaagaaggtaattagcagtagataaaattcagttatattatttaagaatgtacagcttgaattcaaggctgaatacagataacctctaagatataagctgtctcaaaaaaaaaatgcctcatcctgcagagtattgtttaagagcaatacagttagaacatgagcatacttcaaccaattgaagtttgttgaaaaagggtaaagactagcagacataagaaaaaatatacgtttgctctcttaaaattgactctgatgtagaagagatgaacaaatatattttctctgctaaaattttaagtaacaacaatatttatttggaaatatttcttgttttatttagaaattttattataacaccttaaaatactacacaatattgcaaatctcatagcacaatgattaaaatgaaaaactatattagacaaaacataaaattaaatagcttagaataaagctgcaatgtattcgaggattagatcctattcacacggtctttagaaatctaataaaatttgaaccaaattcatagattagtaattgggaaacagattacctggatctggatccaagttgtaactctaggttatttctacttcatgctattttcaaacttataaaatgagggataatatcagtactatctcagaggtttgttgtaagaattagttgctacttatatatacctctaatagctactgaaatagcataaggattcatgaaatattagctactgttggcaccatcattcctcaccgaaactgaaaatatatatacttttcagatcaaatcaatttaatctctttcacaacagagttttagaaacatttcttcaattttcaattccacatttccaccttcctcgttctctctcattcatacaccaattccacgtttactccatcattctctctcattcacacacaaaagaacacacactacccaccaccacaatcactaaatttcaaatttaaaaaaagtgcaatcttaacccatagttacaacaaagaaagcatctccataattaattagaaagtacactaagaaatagattccaggttaggatggtaggctgatattgcaattacatattttttccttcctcatttcctaaaaacaaattagcaaaaaataaataaataacaaaaaataatttttaaaaataatgaaacaatgtaaggaatgtaccataaatcaccaaacattaaaaaattggttgccaaggggaacaaaaacaaactggttctagaactgagggagcaacaaagcttagttcttaatcatgtccccatgcccccaaagcaatattggtaagttgacaaaattctgataattttcttaacgccttcaaatacagagagaaacaaactgagtaggtaacgttacctctttcctcttctacctggagatgccagaaaaacttacagaacaaatactggtgaagcaagaaattgaaaaatgcggctgattcactaaaacagaagtaaactcgactctactctcttaaatgactgagggaaatgattcaaagcctaagcacatcttcccatgagaactgtctatagtctaatgagatagaatgaacttggtagaaaatatttaacaaaatcttagaaaaaaatgaggatttctaagaaagactcctcacctatttcaaataagctcttcctcttcatgataggccataggatattctacaaaaatcaaactgtagctcaggagagggaaatattagctttacacagagaatggagagggaaataagtcactaagatatcctgttgtctaagccaacagaatatctgcacagagcattctaagaatgaacacaatggaacaaaaaagtatggtagttatacaaacatatagcaccaatcaatcaacaaataagttaatacataaatttaaaataaaacgttaatatagaaaagacaaaacatctgatgaaaaagtatctcaaggagtaaaagaaaattattcatgattattttttctaatgaacaacataacaaaaacataatgcaaataagataaaactcaaaataaagtgactaaggaaagaggctgaagtcctaaataaacaaaattaggaacaaaacataagctttatagacataataaataaattacaaataaatatcccggacaaaataaaacattaaaaatgtacttactggtggaaaaataaggctaaggatcaaagaaagtcaagcaactaaggaataactaatagatgtgaaagacaaacatatatctaacatattattaagtgttactaagcaagaaaaaacaaaataaagtgaaagtggtatttcaaagtataatctaaaaaattttctaagaactgaaggaaaaatcagaatctgctgattataacaagaaactatgtcccaggataatttgataaataatgttcaatactgaaccatattcctcttaaagaattttttggacaaagaaatcacaggcagaagacacaaaaagcaaatcagaaattaagggaaaatatcagactgtcctctgaaagcaacattcaaagtcagaagataacaaagcaatgtctgcaaagttctaagggaatttaagtgttacccaacaatattaagtcaagcaaggcagtcatggcacagaaagagggagatgttagagattacaatttgactgaggaacagaaggcgatcaaggccaactatcctccagttaataggaattatgagtatttggatcatacagcagatgtccagttacacacatggggagatactctggaggaagcatttgagcaatgtgcaatggccatatttggttacatgatagataccaggactgtggagcctctccaaacaatagaagtagaaacccaagaagtttctacttttctttttcactttttagatgagtggctttataagtccaatgctgatgaattcttcataccctgggaagtgaaagtactttgtattgatcaaagacatttccaattacaatcaattgggtggagagaagaattttcattgtccaatcaccctcagggaaccgaagtcaaagttataacatattcagcaatgcaggtctataataaagaaaacccagaagtttttgtgatcattgacatttaagaccaaaaaagaaaagactcctaagaagaactgggttttttttttttcctcttccttttgggaagacaatgtgaattaaattctatagtatcttatgaaatacagaaattgtagaacaaaaacttataactttatttatttacttatttttcctgagacagagtattgctctgtcccccaggctggagtgcagtggcacgatcttggctcactgcagcctctgccttccagattcaagcgattcccattactcagcctcccgagtagctgggactacaggcatgtgctacctcacgcctggctaattttcgtatttttggtagagatggggtttcatcttgttggccaggctggtcgcgaactcctgacctcaagtgatccgcccaccttggcctcccaaagtgctggaattataggtgtgagccaccacgaccagccagaaatttacaacttgaactgtgactttccaaaatggaaaattagggcatgtccttggtctgtgttccccaaatagtcaatctttaaagaattcttcaattcctacggggcagttatggtccttcatttgttgatcatctgctgtggcagcaagtgcctcatgcccttccattgcaatgcaagccttccaccctcccctcagaacagaatgctgatgtcagcagcagcctggtgctaaatccaatttggaaaaaaaaataatttgagaaaatatatttccacacccagaaaaaaatatataaagttaagcagaatgccattcaaatataaagatagcaggcaaatattcttaaacatggaagaactttaagtttacaacacatataagccccttgtggaaaaagaataaccatgaaatgcagccaattaagaactgagtcaaaagaaagaatctggaaattaagttccaactaataaagttggggaaaatgaagagtgagtattgaattcacttaaataaagaacaaatactcaagtactataagaaatgtgattataaacatgaatgttataaatttagacaatatgaaaattaaaatataactaaaaattaggaggtgaggggagagaaaataaaaggaacatacaagtgactaatatcctcagcctccataagagagtgtgaattgacatatgtaacataaaaatcaacatcagaggagggcagagcacgatggcagaatagaggcctatcccgtttgtccaccctgctgcaacaccaaattttaacaactatctgcacatagcaaagcaccatcactagaaccaaaaatcaggtgagcgatcacagtacttgtttttaacttcatatcatggaaagaggcattgaggggggcaggagagacagacttgaatcactgatgccacctctgccccatcgcccagcagtggccatgcactgcagacagaaactgcactttggggaaggagagctcaacgactggagaactttacattggtctcagtgctgccctgtcagagcaaagaataaagctatgctgggctccttccatagagggagcatgaggaccagccctagccagaggggaatgacatatcccaggggacagaacatgagtttcttggcaagcctcgccacgcaggctaaagtacactgggttcctagataaacttgaaaggaagtctaggacacaaggacggcaatttctaggctcctcctagtgctgggttgggctcagggccagtgaactagggtggcacatgacctagagacacaccagcttgcgtggctaaggaagtgcttgcattagccgtgccctaaccccagggagtgaagctcatagcaatgaaagttactccttgcttctgcttaatgagaggagagcaaagagtaaagaggactttgacttgcattttggataccagctcagccacagtaggatagggcaccaggcagagtcatgaggccccgttccaggccttagctctcagatgatatttcatttctagacacaacctggaccaaaagtgaacccagtgccttgaaggtaaggatccagtcctggtaggattcatcacctgcagattaaagaactcttgggccctgaataaccagcagtgataacgaagggaatataccatgtgtcttgggctttgagacttactagcttcaggggtgacccagcatattcccagctatggtgcctacagtgaaatactactaatgtttcagaaaagcagagggaaaaataaagggaactttgtcttgcatcctatgtaccagctcggctacatgggggtagagcaataagctggctcttggggtcccaaagtccaggcttaggctcttggacagcatttccagatgtgctttgggacagaggggagctcactgacctaaagagcgagtctcaggcctggcagcattcatcacaagctgacagaagagcccctaggctctcagtaaacatcagtggtggcctgaaggaatcccctgtggaccggtggtgggggtggccacagggaaaggcagctctgcctgtggaaagtgaagagtaggaaagactttgtattgtggtttgagtgcaggcataatgacagtagaatagaatatcaggaaaattgctaagctgtttaactccagtccctggctcccagacagcactttggacattcccggagcctgtgggaactcacggccctgaagggaagaaactggggcaagacctagtgctgtgcaggtttcaggtctaacccagtgcagccctagtggtggtggccacagacttacttgcatcaccacacccccagttgcaggtggctcagcaaagagagacagaccctgtttgtatgggagaaagggaaaagaacaagagcctctggctggtaatccagataattcttccacatcttatctaagaccaccaaaatggtacctctacgagtcagcaaaaaacacagccttattggggttggggtccaagtcctttcaaatacctggaaagccttcccaaggacaacagtcacaaacaagcccagactgtgaagactacaataaatacctaactcttcaatgctcatacactgaagaacattagcaagtataaacatcatccatgaaaacatgacctcaccaatgaactaaataaggcaccaggaaccaattctgacgaaacagagacatatgacaactaagatagttaattcaaaatagctgttttgaggcaactcaaagaaattcaagataacacagagaagaaattcagaattttatcagataaatttaacaaaaggattaaattttttttttaaatcaagcagaatgagtagggaggtggagtttacagtgagttgatatcccaccactgcactgcagcctgggtgatagagccagaccctgtctcaaaaaataaaataaaataaatttaaatatatgtatatatatacatatatatatgtatatatatacacacacacacacacacatacatatagcagaaattctataattgaaaaatgcaataacatgctgaagaatgcatcagagtcatcagagtctcttaatagcagaactgatcaagaaggaagtagtgagcttgaagacaggctatttgaaaatacatagaggagagaaaaaggaataagaaaaaatgaagcatgcctacaaaatcagaaaacagcttcaaaggggcaaatctaagagttaatagctttaaagaagaggtagataaaaagagaggggtagaaagtctattcaaaagaataatcagagaactttcccaaccttgagaaagatatcaaattcaagtaaaagaagcttatagaacagcaagcagaaagaagattacctctgggcatctaataatctaaaggtcaagaataaagaaaggatcctaaatgcagcaagagaaaagaaatcacatacaatggtgcttcaatacatctggcagcagacttttcagcggaaaccttacaggccacaagagtggcaagacatatttaaagtgctgaaagaaaaacacttttactctagaatagtatatccagtgaaaatatcctttaagcatgaaggagataaaaagactttcccagtcaaacaaacgctaaaggatttcatcaacaccaggcgtgtcctaaaagaaatgctaaagggagctctacaatctgaaagacaaggatgttcatgagcaagaagaaaccatctgaaggtacaaatctcactggtaatagtaagcacacagaaaagcacaggatagtattacattgtaattggagtgtataaataaaccaagtagaaagactaaataatgaaccaatgaataataactacaaaaacttttccagacatagatagtacagtgagataaaaagaaaaacaacagaaagtttaaaactagagagacaaagttacagcatagagtttttattaggttcctttttgtgtgtttgtttctttatgcaatcagtgtgaagtgaagttgccattagttttacataacaggttataagattgtgttggcaagccttgtaataacctcaaactgaaacaaataaaatgggtacacaaaatataaaaagcaagaaattaaatcataccaccagagaaaaccaccttcactacaaggaagacaaggaaagaaaaaaggaagagaagtctgcaaaacaaccagaaagcaaataacaaaatggcagtagtaagtctctacttatcaataataacattaaatgtaaatggactaaactctccaatcaaaagaaataaagtggctgaatgaattaaaaaacaagacctaatgatctgttgcttgtaagaaacacacttcacctataaagttacacatagactgaagataaagagacgaaaacagatattccaagtcagtgaaacaaaacagagcaggagtagttacatttaatcagataaaatagatttcaagacaaaaattgtaaaaagagacaaagacggtcattatatagtgataaaggggtcaatccagcaagaggatataacgattgtaaataaatatgcactgtattagtccgttttcacactgctataaagaactacccaagactgggtaatttataaaggaaagaggtttaattgactcacagatccatgtggttgggaggcctcaggaaacttacaatcatggtcgaaggggaaactggcaccttcttcacaagttggcaggaaagagaagagtgaaggaggaatttccaaacacttataaaatcatcagatctcatgagaactcactattacgagaacatcatggaagaaactgccccccagtgatccaatcacttgcctcccttgacacatggggatcataggtccctccctcaacacgtggggattacaattcaagatgagatttggatggggacacagagccaaaccatatcatgcacccaacactggagcaactaaatatataaggaaaatattatgagaactaatgagagagatagactccaatacaataatagctagacacatcaaaatatcccactttcagcattgggcagatctcacggacaaaaaaaaaaaaatcaaaaaagaaacagcagacttcatctgtactacagaacaagtggatctaaagttatttacagaacatttcgttgtttttttttttttttttttttttgagatggagtcttgctctgtcacccaggctggagtgcagtggcatgattctcagctcaccgcaacctccatcttccacgttcaagcaattctcctacctcagcctcctgagcagctgggattacaggtgcatgccaccacactcagctaatttttgtatttttagtagagacggggtttcgccatgttggccaggctggtctcaaactcctgacctcaggtgatccacctgcctcagcctcccaaagtgctgggattacaggtgtgacccaccacgcccagccagatatttacagaacattgcatccagtagctacagaatacacattcttctcctcagcacatgggtcattctcaggaacagaccatacgttaggtcacaaaacaagtcttaaaacactcaaaaaacctgaaatatcaagcatcttctctgaccacaatgaaatataactacaaatcaataataacaggaatattaaaaactatacaaatatattgaaattaaacaatatgttcctgaatcaccagtgtaatgatgaagaaattaagaataaaattgaaaaacttcttcaaacaaatgataataaaaacacaacatactaaagcatacaggatacagcaaaagcactattaagaagagaatttatagctataaatgcccgtgtcaaaaaaaaagaaaatcttcaaataaataacctaataatgcatcttaaagaactagaaaagtaacagtaaactgaactcaaaattagtagaagaaaagaaatacttaagttcagagcagaaataaatgaatttgaaatgaagaaaacaatacagaagagtgattaaacaaaaagttggcttcttgaaaagataaacaaaattggcaaccttttagtgagactaagaaaaagagaagatccaaacaaatgatatcagatatgaaaagggagacattacaactgatacggtagaaattcaaaggatcattagtggctactatgagcaactatatgtcaataaatttggaaaatctagaagaaatggatcaattcctagatacataaacctaccaagattgaaccattaagaaatctaaaacctaacagaccaataacaagtgacaagagtgaagccttaataaaaagtatcccagtaaagaaaagcctggggccagatggcttcactgaattctaccaaacattttaagaactaataccaatcctactctaagtattccaaaaaatagaggagggaagaattccacactaattctacaaggccaatattaccctgataccaaaatcaaagacatattaaaaaaagaaaactataggccaatctcactggtgaatattgatgcaaaaatcctcaagaaaatactagcaagctgaatttaaaaatacattaaaaaggtcattaatcatgaccaagtgggatttatcctaggggtggaaggatggttcaatgtatgcaaatcaatcaatcaatgtgatacatgatatcaacagaatgaaggataaaaaaatgatcatttcaattgatgctgaaaaagcatctgataaagtacaacatccgttcatgataaaaaccctcaaaaaaaaaaaacgtgatacaaatggaatatgccttaacataataagccatatatgacagacccacaaccagtatcatactgaatggagaaaactgaaagcatttcctctaagatctggaacatgacaagaacatgtactttcaccactattattcaacatagaactggaagccttagctagagtaatccaacaagagaaggagataaagagcatttaaattggaaaggagtaagtcaaattatctttatttgcagatgatgtgatcttatttttagaaaaacctagaatccaccaaaaaactataagaactgataaacaaattcagtaaagttgcagtatacaaaaaccaacatacaaaaatgagtagtggccagacatgatggctcatgtctataatcccagcactttgtgaagataaggaggtggactgcttgagcccaggagttcgagaccagctgggcaacatggtaaaaccctgcctctataaaaaacacaaaaattagccggacatagtggcacatgcctgtagtgacagctactcaggatactgaggtgggcagactgagcccagaagctcaaggctgcagtgagccatgactgtcactgcaacccagcctgggtgacaaagtgagatcccatctcaagcaatcaatcaatatcagtagcatatctatatgccaacagtgaacaatctgaacatgaattcaaaaaagtaatcccatttacaatagaaacatacaaaattaaatacctagaaataaattttacaaaagtggtgaaagatctctataataaaaactataaatcactgataaaagaaattgaagagaatataaaaaaatggaaggatattctatgtttatggattggaaaatcaatactgttaaaatatccatattaaacaaagtaatctacagattcaatgcaatctctatcaaaatactaatgacattcttcaaagaaataaaacaaaaccctaaaatttatgtggaatcacaagagactcaaaatagccaaagctatcctgagcaaaaagaataaaactggaggaatcagattatctgacttcaaattatattactgagttatagtaaccaaaacagaatggtattagaataaaaacagacacataaaccaatggaacaaaaagaggacccagaaacaaatccacacagctacaggaaatgaattttcaacaaaggtgccaagaacaaacattggagaaaagacactctcttcaatatatggcactgggaaagctagttatccatatgcagaagaatgaaccttgatccctacacctcacaccttatgtaaaaatcaaatcaaaatagattaaagacttaaatctaagacttcaaactgtgaaactactacaaaaaaaactgaggaaactctccaggacattggtctgagcaaaaatttcttcagtaataccccatagtcacaagcaaccaaagcaaaaatgaataaatgggatgatatcaagttaaaaagctactgcagagcaaaggaaacagtcaacaaagtgaagagacaacccatagaatggaagaaaatatttgcaaagctacccatctgacaagagattaataagcagaatatgtaaataactcaaacaactgtataggaaaaagtaataatccaatttaaaaatgggcaaaatatttgaatagacgtttctcaacagaagacatataaatggcaaacaggcacatgaaaaggtgttcaggccgggtgcagtggctcatgtctgtaatgccagaactttgggaggccaaagcaggcagatcaattgaggccaggagtttgggaccagcctggccaacatggtaaaatcccatctctactaaaaatacaaaaattagctaggcatgatggcacaggcctttaatcccagctacttgggtggctgagccatgagaatcccctgaaccagggaggtggaggttgcagtgagccaagatcgcatcactgcactccagcctgcgtgacagagtgaggctctgaaaaaaaaaaaaaaaaagaaagaaaagaaaagagaaaagaaagaaaaagtgttcaagggccaggcactgtgactcacacctgtaatctcagcactttgggaggctgatgaaggcagatcacttgaggccaggagttcaagaccagcctgaccaacacagcgaaaccccatctctactacaaatagaaaaattagccgggtgtggtggcacaggcctgtaatcccagctacttgggtggctgagtcatgagaatcgcctgaaccagggcagtggaggttgcagtgagccaagatcatgtcactgtacttcagcctgggcaacatagcaagactctgtctcaaaaaacaaaacaaaacaaaagatgctcaaaatcattgatcatcacagaaatgcaaatcaaaagtaccatgagatatcatctcactcgagttaaaatggcttgtatccaaaagtcaggtaataacaaacgctgtcgaggatgtggagaaaaaggaacccacatacactattggtggagtgtaaattagtaaaaaccaccatgagaacagtctggaggtccctcagaaaactaaaatagagctaccgtatgatccagcaatcccactgctaggtatatatccaaaagaaaggaaatcagtatattgaagatatatctgtactctcatgtttgttgcagcactgtttacaatggctaagatttagaagcaacctatatgtccagcaaaagatgaatggataaagaaaatgtggtacttacacacaatggagtactagtcagccataaaaaggaatgagattctttcccatttgcaacaacatggatgaaaatggagatcattatgttaagtgaaataagctatgcgcagaaagacaaacatcgcatgttctcacttatttgtgggatctaaaaatcaaaacaattgaacttgttcagttgaactctgaacaattgaactctgagttcaaaacagttttactcagagagacagtagaaggatggttaccagaggctaggaagggtagtgagggtgtcacgggtaggtgacgatgatctataggtataaaaaaaacagaacaaatgagtaagatctaatatttgatagcacaacaggagacaatagtcaataataatttaattgtgcattttaaagcaactaaaatggtgtatctggattgtttgtaacccaaaggataaatacttgaagagatggatacccaatattccatgatgtgattattatgcactgcattcctgtaccaaaatatctcatgtactacataaatatatatacctactatgtacccacaaatattacaacgaaaagaaataataaaaaatcaatgacataattacactgaaaataattaactaaaatggcttggtggaattctatgtcaaaactcatgtttaaaaactgaagccatcaacctcttaattttttcataatttattaaccttctattctttcagaaaataattttcctttacttaaagaaacatttccttgttttttccataattattattttgctaaattttatacaatactgcaataaatagccatgtatacctatctttaaatactattatttttaattcctaacagatatattcacaaaaataggattactcggtaaatgggtatttgcatgtttgtgagtgtcaatgtaattttttaatagctatgactatactgctttcccttaagactaaaaatgtactttctgttaacaatacaaaagaacagcattgcccatttcatctctcttattcacttcaacagtacgttatcattctttttactgtctctcaaccgaagaacggaaaattgatagataataatttatctaatttacataggaatccttttcatatgtttactggtcacttttaggttcttttgtgaatttcttattgatatcatctgagtttctgtctattgggttgtttttcttataagaattattagtacagtgaatatattaatcatttatcagtcataggcattatgtttttccaagttgttgatggtatctttcctccacttaatgttataggtagtaatagatgtctacttttttatttctactttctaaatatcctacattttggttatcaaattcacacatatgcccaagttctacttttacagttttccaaatatgtttctgaagtatttatcatgtcatcttcctccctattgcttatttcatctggaagaattttaatatatgctgtctttttagtgatgttttaatttctggagaggcaagtatatcccattactttttcacaaattgtaggactacattaaagcatttattttcccacattaactgaatatttaaatatccaaatataatagttgtgtcttaaatttgttataaagaatatttaaatgtcaaatcaactctactgttattttaatggagtgctttactaatggatattgcactgagtttacatactgacttgagaaaaatgaacatttttgtgacgtaaaattttctctctttggctataaaagacagtgtggagtcttttttccagttggaaaactggaaaaatacaagtaatgttggtatattaagtaacagcatcctgccaatgttaattttctgattttgataactgtaccagattaagacagagaatgtgcttaggaaatttccactgaagtattttgaggtagaagggaatcctgactttaacttactctcaaaattcagaaaaacaaagcataaagagaaagagaataaatgtcgtaaaaatttaacaatcacaagatctgggagaacagtgaataggagttcctgctttattcttacaactttcctgaaagcctcaaattatttcaaaacaaaagactgattctgtctctctctctctctctctctcacacacacacacacacacacacctcaagaccccaagacagactatccagcatggaattagtttatattttatcttatttgctttaataaaattttgtagcttcattccaaagagcatgtgtacttttcttgcagaatttggcccaaaacattgtttttgtcatatttatgaatacactgtatttctgatttccattcttagctggttactgactgtcaaagaaaagctattaattttttgcataactatctcatacctaataacctcaccaaattctcttattaactctggtagaaaaatgttcaagatccaggtacacctcaggacacaggaattagattttcctagaccacagcattagaaatttgaaagtaatcttctttctttctttactagcatttatattagctgtatcttgcacttgcaagaacatcaaaaaatatgttaacaacagtgacagtaggtatcactcatttttcctgattttaaaagagatgactttaatcatttaaaatgatatttaatagtctttaccatatttgtattgttttcttatataaatctttttctgtgagttttaatacggctggcagctaacaatcatcatatgctttttttctacctttactgatatcttcgtgttttttctatttttaatttgttgatataatttattttgcaggtagatatcctaaagtaaacaattttgtaattccagtaaaaattttcagtcatcatactatataattcattctttatattgatgaattatgttatttaaagttatagtttaaattttgtacttatattcttaagtgaaattggtcttctagagttttatttttctagaataattttcagatttgctggttgtataaaattcacttggaagatttttcatcttttctaatgtaccagaaaaatgtcagcaacatatgagtttatctgttcttgatatgttagaagccatacagtgcttttaaatatttttccaattctatagcaaatgtactacttgtcaaattttctagttcaccttaggtgaatttgggtcatttctatagctacaaaaccattaatttcctctagaaatttgtatttcttatacatgttcaggcacaactactgagataagcaatggtcccaggatgagtttatcacttagtcctctcctatgagaatccaaggagagaggtgtgtgctccctcatttcctcagctacaaatactgttacgctctcaaaccctaaagacagagaaatttcacacccctgtgttcagctcctctctagaaacctggatgatcttacctttgccatagagattttcatttctggctaactagctctgttttgtccagaaagggccaactccttcaccagttttctttataggaaaaccatcagagccaagatttacctctgattattaagattagagcagccaaacaagaagcttctctgatcaagcttctgtggtagctcaactacaattgagacaagagggctaaagagacatgtactatctcccagaacccccatgactctcctataaacctagattttaattttttgatgacatatactatgtttctttggacctgccattttaccgggacaatttctcatgattatcattaaaaaacggtaacttccgcacaccaaccatatgtgtaacctacctcaaattccgcatgtctgtgaatatcttctgctctctgcctgctcaggataaattcagcttcatttgctactcttactagatgatccttcattgtctggctaagcaacctgtaagaaatgaatgttatcaaataaatatatgtatacacacacaacataaatgattattcactgcttacggtggagaggaaggaatacttactttcttcttttgacatcatacacaatgaggtaccattatttcatgctaaataattgaggaatgtaacaacagcaaaaggttacccttctggcaatagcagattagcttctatcagactagccatgtaacaaaagcaactaaaaatactggattaaagttgtgttttaatcttttaaaatgcactggaaagttaccaaggcagccaaaattaaccagtgaagatcacagagaagaaagcacacaaaggacaatcagtgtgactttttacattaaggcatttgctattcccaagtgagaacagaaaagctacacagacctgtcactagtctcacaaagataaatagaaaaaaattgaggttcacagtctgtcaaggtggaggagtcccggtagactacccaagagttacagcaggaatcaagtgtaccccagaaagcaagaaatagaccaggcctcaaaacactgaaacagaccttcagagatttggtgattggtatttaggttaactggcagccaaaaagctaagcaaagctttcagggtggggagaaaaaaatcagaaataccaatgcaggagggccatggcaaaaccccaggttttcagagtacctcagaagggctacacactaggagaaggcaaacaaaataggccaaactctcacaagaacttaaaaataaaaacccagccttgagtcagctcagaccctaaattaatacaatcggccattagtctaactgctaatcagaaaccaaaaggaagtcctttctaaaggaagataatatcatagagacttaaatttacccttgccattttaaaatacaattttcagcattcagtcaccaattaataggcacaagagacaatatcatacgaatggaaactaaatagaaactggctcacatctggacattgaaataaatatagttaatatgtttagaactaattgtgtaacagagaattccagtaaagaatgaaaactgtagaagaactgaaaaaaaataaataaatataaaaatagatttactgggttattaagctcagccaaaaaaggaaaaatttactgaaagataggtcaatgacaactagactgaaacatagtaagaaaaattaatgaaaattgaacaaaataaataacagacatataggacatggtaaaagaatctaatgtaagtgtatctgtagtataagaaagagtagatacataattagaaaaaagcaatatttgaagagataatggccaagatttttcaaaactgggaaaaaacactgagccatatgttgatggagtgctacaaaacccaagcagggtttttaaggataccctgcttaggcagtaatagtaaaactatcaaagaaaaaaattcttaatagcagacagcgggagaggccttcaaaagagcaacaataagcctaatggaagccagataagaatgcaatgacctatttgaaatactaaacaaaaatactacctaaaaggccaggccagtggctcacacctgtaatcccagcactttgggaggtccgggcgagaggatcacatgaggccagtagttcaagaccagccttggcaatgtagtgagatcccatctctaccaagaaagttttttttaattagcgaggcatggtagtgcatgcctatggtcccagctactcaggagcctgaggcagaagcatcacttgagtcaatgagtttcaagttatagtgagctatgatcacaccatggcacttcagcctgagcaacagagagagatcctctctcaaaaccaaccaaccaaccacctaagaattctatcctcttcaagaccagcctgggtaacatagtgaaaccctgtctctactaaaaatataaaaattagccaggcatgatggcaggtgcctataatcccagatactagggaggctgaggtggaagaatggcttgaacttgggtggcggagcttgcagtgagcccagattgcaccattgcgctccagcctgggtgacagagcgagactccgacagaacgaatgaacaaacgaatgaacgaacgaaggaaaaagagagagagagaaaggaaagaaaagaaaaaagaaaagaaaagaaagacgaaagaaagagagagagaaagaaaagcattctatcctcagtaagtatccttcaataatgagatttaaagggtcaagagtataccactgtgggaaaaaaaaaagagtatttttctgaactttctttatccacctaaatgaagaagctcccaaaagaatttagctttcatcaatcccttcccagggagttttgcaaccaaggaagattgactattgtcagtaaagatgagaagttagtaccaggatgagaaattatctaaatagacattgatacaaaactataatatcacttaactattctcctaagggcccacttactgttcacaaaatcattagctttcccaaatgtgcccttcattacttcacttttaccctattaaaatggtatgtatataaccccaaattctaaccccctcctcaagtcacatttttctctgaatcttttttttttttttttttttttttctgagacgaagtttcgctctgtcgcccaggctgggtataatggcacaatctcgggtcactgcaacctctgcctcctgggttcaagcgattctcctgcctcaacctcctgagtagctgggattacaagtattcacaatcatgccaggctaatttttgtatttttagtagagacggggtttcaccatgttagccagggtggtcttgaactcctgacctcaggtgatccgcccgccttggcctcccaaagtgctgggatttcaggtgtgagacacagcagccggccgaattctgacagacttatgactaaaaataggtcttttttcttgctaagctgtgtttgtctgtttaattcacaggtccccaaacaacaaacctaagagggtagaggaaaacttttcctcatcatcaaaagcaaaataagaacattccatgacaaataaaatagtgagaatttgtcaccagccaaccaacatacttcacaaggatgaaaaataatataagattgatacaagtcaaggaaaacaattggagcaatgaaaatgacaaacgtgggtaaatctaaaagtatactgaatgtttacaataattatgtaacttctagaattaaaaaatactgcaatctaaaatatataaccacagcatacaaggcaagagaaaccaactgaattagtgttataagtttcttgtgtcatacatcaattggcaaaagaatcagtttatgtaagatgttaattataatattcatactacaatctctgggtaaccactaaagttatttaaaataatatataaccaacaagccaatgggaaaaaaattaagcaacaaatacttagctcagaagaaggaaaaaaaaaagaaacacaagatgtggagcaaatataaaggacataaataataagatgataaattttaacctaaacatatcagaaatacatagaaagtaaacatttagtagtaaaattattgtcaaatcaattttttaaggcatatgatgcttgtaagtgacacaatttcaatataaggttaaacaaagattgaaaagtataatttcagaaaacatgaacaatttttaaaagctaaaaggtaataaactttttttagtatgagaagcaaacagaaataaaataaacctgttaaattaataaaaggataaatgaactagagatacagaaatttagtattttgagattctaaatttgtatgctcttaagaatatggcctactaccagatatagaatatataaagctatagaatattttttaacctgacctgactgacatatcgagaacattatacccagtaagtgaataataaatattattttcaggtaaacatggaacatattaaaaaaaacaggcaaaatgcggggtcacaaagcaatttacagtgaatttcaaatgatggaatcatactcagtatgttctttgatacatttcaattaaactagaaataacaggatacagatcactctgcaagaagctctaagctgaccactgactttcctaacctcctggtatccacagcattatgtaatcttcccctttagagtgtaagaaggagatggggcttgcctcgaagcaagaaaatatggcaacaatgaaggaataacacttcaataattacattaaataagatggtaacttgcatcttgctagcagactctattgacgctctcccttaatggcttagctaaagaaagctgtcatgttatgagctgccctgtgtaaaggcctccatggcaaggagctgagtagagccccagacaacagcccgcaaagaattcagactctcagtctaacgactcaaaaggaagtgaatcctgccaacaatcacatgatcatggaagcagatcctttcctagtcaaacatcaaataagactgcaactctggccagcacctcaattgcagccttgtaagtgaacctgaaggagaggcccagctaagccatgcctaggattcctgaccaagaaaaattgagataacaaatgtatgtttctttaaggctaagttgtgataatattgttaacacagcagtcgctaagtaatatcatttcatgtctaaaaattaaagaatgcacctctgaaaaaaacgcacacataaaagaatacatcataatggaaattaggaaacgtttgcagtaaaacatagtaaaaacaatgtgccaaaatctgtggatttagataaaccttaaaccaatgcttagagggaaattgatacactgaataaaaacactaaagaagaaaaaaattgtcaaaataaattatgcaagtattgaactgaagaaatcagaaaaagaacagccagtgaacactgaaagttaaataaggataagaacagaaattaaatagaaaataaaaaatacactttagaagataaagttaacagttagttatttgaaatactgaaaaaatccaaaagaaaaatgtaaacaattaaaagtaataattgaatttaggagggtcactggatttaaggcaaatacacaaaaatcaactagattatatgtataggttactaacaaagtaaaaatggtttttaaatactattttgaaaagcattcaaaaccatcaaaatatgtaggaaaaagaaacaaaaatgtgctagaattctgcatgtcaaacagaaagaatggtaaaaaaaaaaaaaaaagttaaaacttaaagaaaaaagtataccatgttcatgaaagggaaaggcttgtattaaagatatcaattctccacaaagctatttatagatacagtccaatcaaaatcctagcaggtctttctgcataatctgatgagttcaaatttaattctaaaatctatagaaaatgtaaacaaacaagaatacatgagacattcttaaagaggggaagagagatgataataatgataatgatattaaaagacttataagtaagatggtcttttccaaaaactggtcttagatcaatcaactgatgctcatatggacaaattaaccctgacttctacctcaaaccatacaaacaaaccaattccaaatgaatcctagacaagacctaaagatttcaggaagtttaaaaagtttctagaagattacataagagagcatcttcctgactgggtcgatgtaaagacttactgcaccaaacaaaaatacacaaaacataagaaaaatagtgacaaaatgaactacatcaaaatttaaagacttgtgcttatgaaagccaccactaagagaattaaaagccaaacttcagagagagagaatatacttggaaaaattacaaccaacgaggaactgctatcttaaatatattaaaaagcctcttacaaataaaagaaaatgatcacaatttttaaaatgggaaaagtacacaagcacttcacaaaagaagatttccaaatggtgaataagattatgaaaagttgttcaggattactagtcatcaaggaaataaaacttaaaaccataagatatactatactccacagaatggctatatatgtttaaaaggctggcatcaccaagttatatcaaagatgtgaagtaacagggactcttataatcacaaaatcgattaataaaaatgttcatggcaattatttacaatagccaaacactagcaactacccaaatgtccattaaaaataaaactaatttttaaaatgttggactttcataaagtaaaatgctaagtaggaaaaaaaagaatcaatattatgcataacaatatgaatttcactaacaatatgaatttcactaacaatattgagcaaaagcacacaaaaaatataaaatgtatgaattgccttgtataaagataaaaatttttaaaaacaaaactatggtattagaagttaagagattaagaaatggtaaccttcagtgctacctctccatatgaggactcacacggaacactgataatggccacggagttctaaatattttaataaaatgtcttagatgtataaacaaacgacccattctgattagcgcttttataacaccatttacttataaacatatcaacagaatgattcactttatgtaatctggaacatttttgatatgtataggtcttctaaacttccttctttaataggagttgagaacatagagcgggcagggatagaattattattattatcattattattattattattattttttttttttagggacagagtctcgctctgtcacccaggctggagtgcagtggtgcaattatggctcacagaaacctcaacctcccaagctcaagtgatctgcctacctcagcctgctgagtagctgggactatatacatgtgccatcgtaccctgtaagttattttggtggtgttgtagagacagggtctcactatgttgcctatattggtctcaaactcctgagctcaagtgatcctcctgccttagcttcccaaagtgctgaaattatgggcatgaacatacatggcctgcaaggattatttttttaaatttatataacaaaagtggctaaactgccactagaaaatgcccacctacaaaagttacacctagcagtcatcaacaatgacatgaacttactcccattccacagggcacttgcctcactttgtagcaatgttttcatttaaaatataaataaggccaggtacagtggctcatgcctacaatcccagcacgtagaaaagagactccttgagccccaggagtttgagacaagcctgggtaaaataaagagacttcttctctacaaaaaaacaccaaaaacaacaaaattagctgagcatggtggtacacatctgtagtctcagctactcaaaaggccaaggcaggagaatcacctaagcccaggaggtagaggctacagtgaaccatgatggcatcactgcactgcagccagggcgacaaagtaagaacctgtctcaaaacaaaaaacaaaacaaaaacaaaaaaagagcaaacataaacttggatccaaagcaattgtcacaaaaattgtttttatttttttggagatagagtctcactctgttgcccaggctagagtacagtgacaggatctcagctcactgcaacctccgctccctgggtacaagtgattatcatgtctcagcctcccaagtagctggaattacaggtacatgagtcaccacccccggctaatttttgtatttttagtagaggtggggtttcaccatgttggccaggctggtcttgaattcctgacctaaagtgatccacttgctttggccttccagggtgctgggattacaggcgtgagccaccgcgcctggccagcagtcttaataatgcgctatatgaacatgttcccacaatgcagaaaaacatgtggaaaatattcctcatgaatcaattaatttcactacaacactatttatgaaagtgagaatcttaaagaatcaaaatatacaatcatataagtagattgttccaaattgacaaaataatgtccacaatatacattaagaggaaaaataaacctgaggaatattatgaacaatatgagcttggggaacatataaaagaaaatacactttcttttaattgccaataatctagaacaggggtcagcaaattaaggcctgtgtgccaaatctagcctgccaacattttttggttagtaagttctataagagcacaactaggcccatttgtttaagtgttatccatggctgttttcaactcaccatactacactgagttgaccagttgtgaaaaagaccatgtgtactgcaaggcctaaagaactatctggccttttacagaaaaagcatgcacatgtctgggctagtgagtgaggcttaagtcctcctccttacatgtctctgttctttgaagctttacaacaatcaataatcaaaagaaaggaaaacagaaaatccttaaagaaaataaaaaagctttctgccattctatcactttgtttcgatctctattaggctcacatacactattttaatttgactccagctctgtcagactctctcttctatccccaaactgtcttccagctactttagaagttaatgcaatttcttatctatgattttggggtgacatcatcagggtattttttttcaaatgctattaaacagtactcatttaggcattacagacaaaaaccatccctagtgtaattttaaaacccactaatgaataacttcctctgattctacgatagaaaaaacaagggctttcaagagtacagatgtgaaatactggtttgggttcttaatttccctctagagacctaaaaccacattgtgaatttaacatcaatatattgccttgtactttcaaacattaattgaattgattagtcaatggcacactatcctactagtccccaaacaagtaacctcaaagttattctagtctcttccctcttctctaccaccttccttcaggcccctaatcaatcaataagtcttgtcaatatttcctttgtaatattctcagctttaatttatgctgttttatagccaatgtcctaaaaataaaggtttcatcatttcatatacattataactgaataaatcttctgagtgctaattctgatcttttaacatttttgtgcctctgccttttaaaaacactgtccaacatctgttcaacacctattacattatagactaggctaagcagcaaagatgacctttcattatattttagttggggaaaaagagaatccactggagtcctttccagcttgaaactcatattaacataagtgctatggtggacacaccctaatgtgacctccagtgagtcgtggctttaaatgatcccaaccccttgagttcaacctgggcagaatctggcacttccttctagcaaacagaatatagtaaagataatgggataatcattccttaattagggtactttacatgccaacggtgatgggataatcactctggtacttatgtaataaagttctgccctagcatactgcagagattctcctgccacccctgaagaagaagtaagtggctatgtgtgaccaggccatgagacagggaagtatggacagcctgtaggatctgagagcatcctctcagtgacagtaaacaagaaaatgggaaactcagtaccacaacagcatggaactgaattctgccaagaaatttgtgaccccaagctccagaaagaaatgcagtttgaccaacacctttattgtagacttgtaaaaccctaaacagaagatccagctaagctgagtctagacttctgacccacagaaactgtaggatagtaaacataagttgctttgagctgcaaaatttgtgggaatttgttataaaataagcaatacaaataaaattagaacataagaatatgtttgctatcatatctctatagaagcaaagatcacaataatctactaaagatgaaaaaaagctccaatagaaaattagagcatgaagatgagccttaaagggcaaaagcaacaaaaagagaaagatacttcagataacagtatgaacaaagttataaagagaaaaaaacctttgttttttgttttttgtttttgttttggagatggagtcttactctgtcgcccaggctggagtgcagtggcacgatctcagctcactgcaacctctggctccctggttcaagcaattctcctgcctcagcctcctgagtagctgggattacaggcacgcaccaccacgcccagctaatttttgtatctttagtagagacgggatttcactatgttggccaggatgttctcgatctcctgatctcatgatctgcccgccttggcctcccaaagtgctgggattacaggcgtcagccactgcgcccagccgagaaaaaatcttgtgtgttctattttcaagagaaccgaaacatccctttctatcacttagttttcaagatgtccatttactgacatatacacttagataggtaggatatttctgtcttgatgtttcactcatttttctggttacatagcatttaaaaaccatgcaacactttaataatgaagcaacaagtgaaagctcccagcccccttccctgttcacttttcagaatacatcaccaccatgagtagtttatgttcctgtccttacatttatctaaacttatagaaacatatacagtatttatgtgcatatatatgaaacacatacagtatttatgtgcatatatacatatatacaaatgtacatgttcatgtgttttgtaaaaatatttttaaatacttaagaagtcatactataatacttgtatattttacttaaccgtataccattatgtaatcagaacagcttcaagtgactcatgtggatggaatgtaccgtaatttatcaaaatagtcccttatccagagatcattcattctttcattctttgccccattaacataaccattatttatccagttactgaagctagaaatatcagtcatatcttccttcttcatcatcctacagatccaatagaccaagtactgcccattctacctctgcaataactttaaaagttgtttctcttactttttttttttttttttttgtgagacagagtctcgctccatcgcccaggctggagtacagtggcatgatctcggttcactgcaatgtccgtctccctggttcaagtgattctcctgcctcagcctccagagtagctgggactaccagagcccaccaccatgcccggctaattttttatatttttagtacagacagggtttcaccgtgttagccaggatggtcttgatttcctgaccttgtgatccgcccacctcagcctcccaaagtgctgggattataggtgtgagccactacgcccggccaaaagttgtttttctttgtaaccttttccggtgcccttcactggaaactcactggaactcaggatcatgtctttgattatgataatagcctccaatccaacttctttccatgagtcttactattcttgcccattcttcactgggatcatctttctaaaatgaaaatctgataatcactgtattgttgacaaggtatcagccgtcagccatcttcccatgatctacaaaagagactaaacacctttccatggcttataaatcagtctcattgttgttaaacttttatactctaagaactccaggtcaggaactactctctcaaacattacaccctgttactgtacactcctttgcctctgttgctactgtcccaggaatgacctcacttcatattctatctaacctaccttcaaagctaaaccaaagtaaaggttcactacagaaccttttctgatcccacacctgctttccctccacagaagtaatcccctaccaacgtgtatcagtctcttctttagtacttattactttgaaactttctgtataacacaatttcaattatgtatttacaaatctgtcttccatttgacactgcaccaaccatttataatttatctttacacaaccaaagcatagaacagtgcctggggacccagcagtgcttataaggaaaagaaactttgactatccacttctgccagtcacttctaagctgctaactgtaaggaatacaaacatgcataacactgtccacaaagagttcacaatctaatatggaaagttataggactatatacaaacagcaagataactgtgaaaaggttcttaaggttcttaaaacattttcttctcttaacttttgcaataatacatagcactttcttggttttcctcctatctagctgctgcttcttcattgcccactttgctacatcctccgctgcactacctacaaatcttgtaatgtccaagagctcagctgtgtgttctttcctccctctaaattatttcatccagttctatgacttttaatctcacctacatagtactaattcctgtgtttatatctctaaccctatccttggtctcctatatttcagactcacagggccaactgtccaactaaaatcttcacgtggatacccaataaggcatttcaaatctaacatttccagagcagaactcttgattctacctactcactgccaataatacctcttccccatcactacctcagtttgtcccaccacaataaatagcgccaaagtccactcaaactcaagaaataatctttgattttgtcatttcctcacctccaaatcccattcatgaaagcaagttctactgctttaactattaaatacatcacatatatgtttatttctctccatcatcattgctaccacatcattctaagtcaccattccctcttttctagaatacttcagtaatatcttcactgacttatctgctttcattcttgccctgtataccaatcctatcacaattcattcttctaagaatgtaagccatggtgttgggaaagctggatatcaacatacaaaagaatgaaattgagccaggcgcggtagctcacgcctgtaatcccaacactttgggaggccaaggcaggcagatcacgaggtcaggagttcgagaccagcctggccaacatggtgaaaccccgtctctactaaaactacaaaaactagctgggcatggtggtgggcacctgtaatcccagctactcaggaggctgaggcaggagaatcgcttgaacctgggagacagaggttgcagtgagctgagatcacaccattgcactccagcctgggtgacaaagcaagattccatctcacagaaaaaaaaaaaaaaagaatgaaattggatgcttgttgatatggtttgaatatctgtatcccctccaaaattcttgtagaaacctaatctccaatgcaatagtattaagaggtgaggcctttctgaggtcattaggtcatgagggctccttcctagtgaatgtaattaaggcctttaaagaatagtcttcacacaatgtttagcctcttctgccctttcggcttccaccaggtgaagacacagtgctcaaagtgccatcttagaagcaaagacccagccctcatcacacactgaaacctgccagtgtcttaatcttggacttctaagcctctaaaactatgagaaataaattgctattatttataaattacccagtctcaggtattttttatagcagcatacagagactaaggcacttaccttacatcatatataaaattacctcaaaatggatcaaagacctaaatgtaagagttataactataaaactcctaaaagaaaacataaggaaaagcttcatgaccctgaatttggcaatgatttctaggacgtaataccaaaagcgcaggcaataacagaaaaaaaaaatagataaactggactacatcaaaacttctgggccaggtaaactggctcacacctgtaatcccaacactttgggaggctaaagcaggaggatcgcttgagctcaggaatttaagatcagcctgggcaacatagagagactccacgtctatttttaaaaagataaaggaaaaaacaacaaccttctgtgcatcaaaggacaaacccaacagagtgaaaagacaaccccagtgactcatgcctataattcctgcactttgggaggccaaggcagaagggctgcttgagcccaggagctcaagaccagcctggacaacatagcaagtccctatctctacccaaaaaaaaaataataataatagctgggcatggtggcatgtgcctgtggtcccagctactcaggaggctgaggtgggaggatcacattagctaggagtatgtagctgcaataagccactgcactccagcctgtataacagagagacgctgcctgtctcaaaaacaaaacaaacaaataagcagaaaaaaaaaaccctgtaagttatatcatgccactcgtctattaaaaactctgctcttactgaatatggtttaatccaaatttcttagcatagcttatagggccttatatgatctgaatattgaatacttctcttgacattcccaagccttactctttcttgctgattttgttccagccactctggccttcaatttgtttaaataatacacaatactattcactccttatggcctctgctcttgctgtttccttgccttaaaatgttgtgacatacatctcaaaagggttagctacttctcttcattcaaactgtttccccttcacaagatttttctaaacactccacactccctaaaagccagtatgtttactctcataacattatcctgctttgtttccttctaagcatttattactttctaaattgtcttattttgattacttgtttattatttgttctctcctttatgacagcacagacttattcacagctatatcctcagattccagaatagtacctggcacatggattataatcaataaatggatactgaatgataaaaaatgagtgccataaaccactcccaatctacttttttgtcctttccttatatccaaaaccttaacttccttatatccgtttcaatcctctttccctctaaggaatattctgcaattctatcctataaagacctttactttatgtcaatctttatttttaatatcatttttgtagagacaggggtcttgctatgttgtccaggctggtctcagaaatcctggcctcaaattcccaagtagctaggactacaggtgcatactacccaattttttttaaagagataggatcatgctatgttgctcaggctggtcttgaactcctgggctcaagcaatcctcccatcttagtctcccaaagtgctgggattacaggagtgaactacaatgcccaggttattttatgtcaatcttatccctaatgattactgtaggtacggcatatattatacttgtttatagaatatcttataaacattctattagaattatatgtgtattactctattctctcagaagatgtgcttccttaaccagaactgattaaggaagcagggaaggaaaaaggaaaaatctttaaaaaaaaaaaaaaaggactaaaaaaatcttttgcttctttttattttaataaacataacatctaagaggtactgttcaggtaggctataccccatcattatttgatgagtggacagtttgtaaaaatacttcaaaccaaatattctcaagcatctaaatttatctaagcaattaacagcaacaccatggagcttttagacttaactgtatcataaatttaagtttgaaatatttttgctggataatacaaaatgattaccatctaaccttacttatttaaaagaatattataaaaagtgattgggatgtatgtaaagtatttaataatactttcagagaagaagggaagcatatatatcttttccttcacaatttacaaaatgttttaaaatcaaagtttctgagaaggtcctgaatacatacctctgatttttttaaatattcacacaatgttatttgtcctttcattaatgaaaatattaaaatgacttcaaaaattaaactaataagatatctaaatgatttttttttgctattctaaggggtcaatttttcttatctatatgcctattttcctaaatatgcaaattacacaatatttagcaacagcaattttatctaatagctgtgtaaactattctttcaaaaaagaattaaaggtaaattaaagttttaattattataagcaggctcaaaatgttgggtttactgtagattaaatgtctaaatgcagagcataaaatgattcacatattttaatattaagaagaaaaaactatgtataatttacacctacagtgcaagaaggaagaaaaaatgcttgtgtcagccttaggaaacaaacagccctatcaagtaaccaactagaaaagattcatactggaggctcaataaataacagtaatgatgacaaccatctcccataactacattacagcccattgtccacatctgattatactagtctagaccttgggtaagcacatacacattttcaccaagagttttccaatattactgctctgtttcctgggctttctgtgacccccattagcagcaactgtcattttcactactaaacatgaccactgatgagaaaggaaagttactacttttctacactctaataattgagaatgtggaaataatgttcctgaattggcaatccttctaaatatagtaatttctttagaattagctacagagaagaggataaattgcttccaaagattttcttccataatatgagaactactaaagcctcacttttcaaaatatcatctccatatattaacatagcctttattcttatagtgaagaattattgcctaactctccatgtatctgcctccttgcaacatctatctctctctgtctctcacccagcacatccaataattcagtatcacaaaaatccctaaactgttatctctctgcacctttctcagttaaagctctcagtaacaactttgaataagggatgtaaaggttctaacatcacagaatacacatgcctggaacctcagaaagaatagattttgttggtaactgaaaaaattaatttaaattaaaaaaaaatttttaatgggcttcatacacatttaaggccagtctagatctttctcggttgaaatttagcccaggtagtagccactttttctggaaggcagtatccttgatcagagaccacaaggtatccatatgctttattagactttaaatggagatagcaaatactccataaagttatttcatcctgagaatataaaaccttagtaatttaatataaatgttacatcctcacatcaacctgtttttccaaacttactttgcatgataatccctagttgaacattttaaaacaactcatgatattacagaggctagaatggaagcaaaaagaccaggctgcaagcttttatctgattattttagataaaataatttcttaggactatgaaataatctattctctagaatgtgcaaataaaaagagacagaagatagttacatgtagaaaagcaaaaatatagagaaatggctctcctgactctccacttggaattcagtttatttggaattcagcagatttctctgctgcacagtatctaccaccttctatcttcttataactgcctttgtctcttcattgtcagtgacatttccttggcgattcatagaaattcatcttttcagattccactctgaccactcttatttaacactgcaatgtcctctgtatccgactgtacctattctcctcccctcgttttaactttctcatatcacttatctcctgaacatactatcaactttttaatttctttattgtctaactttaccaattaaaataaaccctattaggcaggcatttctattctgaccattgctaaattcccagagccaagaatatggaccagcacgtggccagtatggattaatatttgctgaacaaagtgaatgacgctattttcattttatttttattttactcttctcaaaggttatgagagttccgtttttcacctatccctaatacacatcccttttttctataatcattcttatttaataaatgatcctacgtacatagatgctgttgtagtttttttaaaatgtgtaaggctatgaaacatctatacaaacataagcatattctacaggcacgctatatccaagccatctttcctaaaagtcacatacatttggtcttggtaaaaaaatgtcaaacagcaaatcctatttagcaaaacatttaaagctctgaaatctagtagaatttagcatttttagggggtgaaaaagcacaattcaaacgcagcaccatttttttacataaatcagaacaaagcaagcttaaaaagtagccacagaccagtgtggtggctcacacctgtaatcccattactttgggagtccaaggtgggaggatcacttgagcaggagttcaagaccagtcttggcaacatggcaaaacaccaactctacaaaatgtacaaaaattagttgtggtgtggtggcgagcacctgtagtcccaggtacttgggaggctgagataaaaggatcacctgagccagggagatcaaggctgcagtgagccttgatattgctactgcactccagcctgggcaacaaagttgagactccatccaaaaaaaaaaaaaagtaaccattgaaaaatcatttaaatataaaatcccatataaagtgcacaaaacaagcctccatattcaaaacctattaaaggaagtatattaatgataagctgagatcaagctataaaattaaaaataaaaaatgacctgaccatgtcagtactttaagccaaaacatatgaataaaataaataagaaacatatgcttatcctaattaaggagagaaaattctaatcttctttgataagccattaaaccttcacaaaatgataaacattaatttaaataatctaatctttaagagcatataagagcatatactttattctaaatcacccagagaaacttctatactaatacaatccaggattgaagtaaacagagataaagacatgagcccaggagctaagcggttgcagcctgggtgacagaacaagaccctgtctcaccaaaaaaaaaaaaaaaaaaaaagagagagagagagataaagtctctgctcaattaatccactgttgatctctgactctaccctaaaaatagcatcatttccaaacaactgtttacaagatgtaattaagcagagcacagtaactcacgcctgtaatcctaccaacttgggggaccaaggtaggaagatcacttgagcctgagcgacaaggcaagaacttatctcttaaaagaaaaaaaaattacaataaaaaaatttaattggagtttttctataaagtatcttcccacatatataattttaaaactgaaaccagaaaaagcacatggctctttaagtaacactcaaggatttccaagtgataatctctacctcaattcaaattttatcttccactgatacagataagaatatattctagccacactgtttacttacgtgcaataaatacctttgtctttttatcaaaggataacccagatctaaaatacaagtgctaatggccaacagggtccaaatgaaatattttctggcctctctccctctctcccttttccctctccacctttccttctagtcattcttcttctcattccaccaacattattagtaatcgtgctattcagagaagtgaagaaaaaggatggagcggctaaatgaatgctcagaaagaagacatgcaatctaagtagatgaattttgaagacagaccagtgtattaatactcgaagcattatgtcttttatgtgggctatttatatatttgtatacaagtctgagttactgctgtaataagcagacactgactggctctagaggatgattaagcaacgtgcccaacagtatgcaggataatctgccctttctgtgctttccaaggatgggagaaaaagaagagtcacagcagcacatctaaaagtaaagttgtaagaggctatgaaagctcttaaaatgtgtttttattaaattaaacacaaaactataattataggttgttttaattatttatatatttaacaaattacaagattcaagatgagaatttaaatcttaaaatttttaccaaatattgtacctttaaactaggtttcatagtctactacttccctgatttttactatcaaacatttaaaaaattagccaataaaactatgccggtttttttatttaaagtataaatgaaatagaaacaatgaggagaaactaatagaaacattaataaaactaggaacaagaatgaaaggaggccaggcacagtggctcatgcctgtaatcccagcactttgggaggctgaatgacttaagtccaggagttcaagactagcctgggcaacatggcaaaaccccatctctacaagaaaaaaaaaaaaattaaaaattagccaggtgtggtgtcctcaacagcagtcccagatacttaggaggctgaggtgagaggatcacttgagccagggaggtcgaggctgaagtgagatgagatggtgcccctgcactctagcctgggcaacagagcaagaccctatctcaaaaaaaaaaaaaagacagaaaactctgatagaggatttgcacttatttttcaaaattctagaggttaagaacaaaaagagtaccacctaaacaaataaaatattcatcattctctctaagacacacaagtcataagacaggagaccaccaacaaatcattacaaatttcacaaaataatgtctcagaacagctgacttgatcactgctacctagaacaacatcaggagcttaaaatgctctaaaaaatatttggagggatcacaagcaagctggcaagaagaaaggaggcaacctagcagccagatctatttctgccagcaaaattaacatcaatactgagatactaaatttttttgcaagtaatatcaccaaaacctctaagaaaataagaataaaaggcaaaataagaacttgaagccctttatttatccaaataagaaaaaacattcaagattcattggcaaagaattgagttgaaaaatgtaagcaacagtgttatggaatgtaattaaatatatctttcaattcaattcaatttcaattaaatacatttgtaaagtgaagaaaaaaataactaagataaagacaaatcgaatacacaaataaatgaatttaggtccaatatacataacaatgtaacctacaccacatctaaatttagtataacactgaatcctcagatttcattcaacagggtcaaagggagtagtaataactgtacattattttctattgatgtggtgctacagcatcacagagactctaaaaggtggctttaatattctttaagttctttaaaactattagtttagagaaagttgtgcctttcaagaataagaaaactcttttagatctttcacttgcacatttaaaaagtaaacagaggtgctgataataatgattcaagatatcataaaacactcataaacaaaattagtattcaggaataacaatgttcttgctcataacttgtgaaaatttaattatttaactgaaatcttttattataagtatatgtatttttttctctttaaagtcatcaaggttgtaacaattacgtcagtgattatcaattattctagctctctaaaataaatttgtttaaaatggagtgttgtttacatgaaaaataccaataattgaactcaaaattaccaaaacaatgtatttaaaaatatcttattaaacaaatgtaagttaaagagaccatcagcaaatcactataaatttcacagagtaacatctcatcgagcagctgccttgatcatagctagaacaacatcagcagtttctaccaaacaacaattacttatgtctgaacttagtaattgatttgctaatgacactctacaagtctgttagaccttatgctgtagtctgtctataaaggtcttcatgttatttacacaaatacgacattaatcaagggcaaaatttatagcagctactctataaatgaggtcaaggcaggtcagacttacataataagaagaaaaaaaggttagtctttgcagtaaaaaggaaaatcattattattattcttcctgcccctgggattaagtctagtagtcaaacactccaaactatttcacaaacacatctactcctatgaaaactcatttaacctcaaggcactaaatatttataaaaggaaagccaaatccactgatttagaaaaataaaccactaaaattttcctttaaaatatattctacactgtaaataaagagagaacgaaaatttccaattttacctccactatttcactaatgaatcttagcttccaccactgtttatttcaaacacgtaaaagataaaggctgagtgttctctataggctaagcactgaagtaaagaagacagtttctaactatgggaagctaaaaaatctcaacagaataagaaaagcaaaggtaaaaaatcagagaaagggtactatgaaaatgataacagatgatataaaaataaattattcaaacaactgtttcaccaaattttcagaaatagcaatagcaggagtattagcatttgtgccagtacctccaagtctcagttccacagaataatacaggtccagtagacacctgtatatgcagtaaagtgtgttacaagagaggaactctgagcttagggcacttgaatcttctgtgacggccagtaggcccgttggtctttggcttggagaaagacattattatactagacagtaaacgatcctgctttgttctaaatgaagacactatttctatattccaaagctgtctgctatataaagatctttgaatgataatgcaaaacaaaggcatttggtatctcttcttacaaggccaaaaatcttaagagtgatgcctggctttctctcacaacccacatccaagccattagaatatcctgtcaggtcttatcttcaaaataggttcataatcctaccacttcttacctcctctactgctagcaaccttgtcccagtcaccatcatgtttaaccagaattactacaatagccccctaattgatctctttgtctttttttttttttttttttgagaaagggtctcattctactgcccaggatggagtgaagaggtgtgagcatagctcactgcagcctcgacctcctgggctcaagtgatcctcctgcctcaccctcccatgtagctgggaccacaggtgcatgccaccatacccaactaattctttttattttctgtagagacagggtctcactatgttgcccaggctggtctcagactcttgggctcaagcgatcctcccacctcggcctctcaaagtgctggaattacagacagaagccactgcttctggctatctcttcacttctatccttaaattcctacatgcatcagccatagtcattttttccccacgacagggtcttgctctatctcccaggctacattgtagtagcatgatcacagctcattgcagcctcgtcctcctagactcaagggatcctcccacctcacagctttccaagtagctggtactataggcacctgccactataccaggctaattgtttgcattttttgtagacagagtttcaccatgttgcccaggctggttttgaactcctgggctctaacaagtcacccacctcagcctccgaaagtgctgggattacaggtgtgagccactgtgcccatcccagagtgatctttttaatccataagggagactgtcttcctcttcttctcaaaatcatgcaatggctgtcatttcccacagaataaattacaaagcctctacacaaaatcttgccctatgttatctctctgaccttacttcctatttcattctactttaatcactcttttcttgctatattggcctcattcctcaaatacaccacagaagctctcacttgtacactggctgttccctaggcctggaatgcttttccatacatgcccctttaactgactccctgtgtgcttcaagtgcttgctccaatgttactttctcaatgagtcctaatcctgccactctatttaaactacaaaccataccaaccttttttacttccttcaaaaatttcattcccctcatctgctccatattttttctcacagtactaaccgtcattcacatattatataacttacttttttttttattgtttataatctgtcaatgcctatttgaatgtacaatccacgaaaaaaagaatctttatctattttgtttattgctgtatcctccgtagcaagaataattcctgggacatagtgtgtaataaatagatgaggaactgaagctcaaaaactaaaagcgcttgtcaagtatcaaagctgaaacctgaacccagggctatcttcaaagccaatgctcttaatcttaagtctatgttgcctcatctattaaatgtaacaataacatacataaataagggtagttacacttagtaaagtctacgatgttcaaaatcacctcatataaatttttctttaaaaaagccctggaattatacttcaataaacactaaaaattataaaaaatctgttcatgggtgttttgcattaagcagaacatttgtgtatttaatcgacagctccagtcacctctttttccatatataaacttcaatatcatccaatacctcagtgttgaaatcagtcgaaagctatttttcaataaatatacactttgaaatgtttactaaaagagtaaagaattagtcattatttcattaattgccctatgaattagtaatcactgatataaatctatatcagtttttattgatcacctactacttgccacactctacatgaaaatgtatctctatgtttcatatagatcactgtagtaaccttgctactgttcttcatttcaatcaggtcttccctccttcaacctatcctaaacaattccgccagttatctttccaaacccgaaatatcacaatgactcttttgtttaaaatcttccaaggcttcccacgatcttgagggatctagatgcccaattccaacaacacctctccaacacacacacacacacacacacacgaatatcctgtacaccttcccacattacaatgccttcagatattctgttccctgtgtttgaaatgtttttcacacaaatgtcctccaatttttccataacctccaattttctaatgtttacatgacaaatcgtactgatccttgaaatgcacctcaagaatcatggttcctggttaagttttaagcaccctgtacttacatatttctatcacagaatttagcatgaagtattataattgcaggttactagtctgtgagcacctgtaattatttctgaaggaaaggattttagtagtatttaaaatcaaataaagttacgaatactcttttcgcccttttccataacatttatgagagatagagagcaaaccttgattcctagatgcaagttcaaatagttaccaaaggactgatagggtcaatcttccaacaacattacctaaaacactaatcgaacattgctgaaacagtaagtttgttcagaatactatctcgaaggggagtcagtcacatcttttaatctatactctgggtcttcagttccattaatgcaaaatcagctactacaaatcagacaaaaagtggtccactaatcatttcctcaatttctttttaccttttaatgatttcactcttttacatttgttttctcccttttatctctcttttcatctctgtactttcttcccttctcttacccaccactgaattttctttccttgaattcttctgtttctgttctttaagtagaaaatatacctccttatttcctctatcacctttctcaccacatcacattgcgaaacttgtcccccctcccattatgatcagcgtgtgatataagaaagataatatagacatctaattctaattattggctctacacacataaaataacttgatagaaagtccaaataagtatggcttttccttatacctgcaaatagaattaacagtttacttttcccaaactcagccacactttttgaaaaataaaaatcagaaatgtatcagtaagcttgcatctaaagaaaattataaaatggttaaatattaacatatacataataattgatatatcagagctccattacattactgactgaacaaacagtaaatacagaacccaaaaatatcaatgcctataggaaaaacccaagattttaaagaaaaatacaaaatgaattaaaataaaataaattaccttccttcattgacaagttcgataaaagcaaggcctgcattcttctgaatagaattttgccactcctataaaaaaaaaagcaaaaatagctgaagaaatgtcactcagtaggttctttcttttaaaacaataataatgaaaaatatcacccatatcaatttcatgcctaactcttaaaagttatgttaaaccatatgaacaggtaatactgaaaagtatactgacactaaacaagttagcaacaatttgattctgtgtaaattaaatgagcctatctatatttatcttgcccttttcattacataacacgatatactaatttatctgaaatagttgggagctgggaaagaaggtaacaaagaaaaccaaggacaaatagacattttggttttggctttgtttttccatttattttaagatgtattacccaaaatgaagagaagaaagaattaaatagttcaataaccctaataaaaacagcatagttcaccataaaaattgatgactagcaactgaaaatgaaattagaaaaatcagtgaattgagctaaaccagttttgagttagaaactataattcactgccctatgaattagtaatatctggtataaatctactaactatattcttgatccatttgaaatttacccattaaactttatccactaaaaagcaatccattaaaaagcctaggaatgaaatcaatcaatagagtatgtacaaatgaatattttaatccttaaaacaaaaaatatatataataagcattaatacaataaggaaaggcctacatgaactgaaatatacctagatttgaaaaatgctcgtgaatgccacttgtgtgtatgtgcgtgtgtgtgtgtgcctatataaacacacacacaaagatttgcttttaaagaactggaaatacatacataatcttcatatttcttaatatttaaggagctctttgtattctaactacataatatccctcaactgatctttttttgttctttcataaaacccaaatcaaaaggccatgtctggctacttaccactgctcactataaaccatattcatattttctgagtgtaataactctaagactttcaaattccatgcaatttcaccctaatagctattccgttccactccaaattcttttctttttcattctcatcctttctcttctaccttctcttttccatgtccactttcatacttaccttcttttgtgtttttgaaaaacccaaggtggttcttaagactaaaacaatcacatgacatgattttgtcaaaggattatattttatgaatagtattagtataactatgctaacagaacaaatacagtagaataaaaattaaatagaaaatcagtaaaacgttggagggtagtcactggctagaactagcagagaagaaaaagtaacgtattctcaaggaatgagcaagaaacaaattcataaaatccatgttctcattctgatactaacagaatatatccttaggcatatcgtgctacatctgcaggtcttagatattatcttctaaaagtgtattctaggtataatttttattattctaaaatttactaacatttagaaattcatgacttgtaattgtacaatatatactctctaaaattcatactgaattcatattttaccaaaactgtaaaacagggatactaaattttttccagcgaggtaaaacaaaccaatataaaacagaaatatgaatctaatttaaaagcattttctttccatcaaaataaaatgaagacaagtagtccaaaaggaagcaatcaaattccacaagactatattcttgagagaagggcatgtgccacgaaaaggtaggagaatgatgacaaaaagcagaaacctcaaattttttttttattttggtacagagggtcccacacctaacttcccaagcacagcacagagagataagactcaaagacttaccctaaatctagtaatgcacaagaacagtagaacaggaacaaatttaaagacagatggacctcagctaggaagattcaaaaaattatcatggaaggaggcagaagcagcttaggatttaagaagatgaagagaacataaccatgacctctgtggataggcagcaagtgatcagcaagaagtacgatacttcaagagatgccacagccaaacaacacaagcatatgttcattcctcagctcttatacctaacataacattcttggaaacccaactagaaatttgacataatacaagaataggaaggaaagtgagacctcaagttgagtgagttttcacttagatcatttaacttacagaaaacttcaaaatagaaacttagttaaagaagaaaatgaagaaaattacctttcttgctagaaaaaaagaagtcagtaattacagaagaactaaaattctgtatataaatctttagattagtcattttacttttaaaagtatccactgtcaggaaaacgtcaagaatgtcccctctcaccactatctttcaacatcattctggaagtcctggctaatgcagtaagacaagaaaaggataaaaattgaaaaagaagaaataaaactgtctttgttgatgacataatcatctatatagaaaatcttaaataatctacaaaaaatcctggaataagcaataaatagcaaggttacaggatacaaggttaatatacaaaagtcaaccactttcctatgtatcagtaataacaagtcacacactgggataaaatcatttgtaaaagacatctgataaagaattgtgcaaaatatacaaataactcttaaaagtcaacaaaaacaaacaatcacattaaacaatgggccaaagactttgacacctcaccaaagaagatatacaaatggcaaataagcatatgaaagattgtccacatgtcactggggaaaggcaaattaagactagataccattagacacctataagaatggccaaaatccagtacactgacatcacctaatgcaaggatgtggtacaagaataaatgaaatctcagtcattgctggtgggaatgcaaaatgatacagtctcactggaagacagtttgatggttcctaacaaaactaagcctactcttaccacaagatccagcaatttcactttttagtgtttaaccaagggagttgaaaacttatgaccacttagaaatttgcacatggagatttatagcagctttattcataaatgccaaaacttagaagcaaacaaaatgtccttcagaaggcgaatggataaattgtggtacaaccagacaatggaatattattcagcgctaaaaaaaaaaaagagctatcaagccatgaaaggacatggagaaaatgtaaaagtatattactaagagaaagaaactaatatgaaaggttacatactgtatgatttctactatatgacattttggaaaaggcaaaactatggagaaatgtaaaaagatccgtgtttataggggttagtgggaatggaggggagcacaaaggatttttaggtcaataaaactactctgcatgaaactataatgatgaagacacaccactacacatttgtctaaactcacagaatgcacaacaccagagtgaaccctaatgtaaactatggactttgggtgataatgatatgtcaaaggaggttcatgcattataacacacatgccagtctcgtgaagaatgctgacaagagagaaggctatgagtgtgtaggggaaagggaaatgtgggaaatctctaccttttgatgaattttgctgtgaatgtaaaactgctctaaaaagtaatgtcttttaaaaattagtaataaaaaagtatttactagtactatttttctcaaatccatttgttctgatccaaaactgcaatgggaaaggatttttattacataattcagacaaaatgcaaaactccacatggatgaaatagataacagcagaaagacccatatattaagtaggcaggtaaagggtaaacatcatttagattttattttcattatatacagaaacttttaattacattgtcaaatcagaaattgtgccatttagatttcacaaagattttaagtagcattattggggttagactgaaaaccagttaaagttagtataactatcaaaacttaaccacactaaaaatttgtaatctaaacttatcttggtatgtcacaggaaatatttcttttcaattaaaaacaaattagacatgaaggtacatatataattgaagaagttcagtgttttatggaggctcagaaactcaaatttattactagtaatacattatgcttctggttttctcgaggatcatctataaacccatatttgttaaccttcagtaattattacataataacctgaaataaaatgttctcattaattttttcaaattggctaaaattaggaataaaatgaaaatacaaaccttatacttttggttattgttaaaaattatcacaaatctcaggaatatccttatgttttcatttctctataatacagtcctaattactaattattaccatttaataaaataccaaatgccagatatacaaatgcatactaaaaagaatagcctatataaaaagaatctgaagcccatgagaatattttttcaatttgtttataatccaggtgttagtcaaagccaacaagttttctccatactaaaacattctctacagtaattcacagaagttgccaaaactaaaaagaatattcctgaactatgctatcctaaaccatttttctccacttcagaaacaattatcaaggaaggtgttagtctaaacaatttcataaaccacagctcaatataacccttagtgagttttaatagttaaaagaaaagcttaatggtcatcgtctttcatgatcgtttcaatatttcatcacagtatttacaattatacagtgatgcaaaatgcatagtacatttaaaggtcttggttatccttctcccagaggtactgatgaaaaacatgttaaaagcctcaaatccaaccactaatgcaactaagtaatttcaaaacacatttcagcactttggagaggaagaactcaaaacaaaacaagagagtcaataatttcatacctgttcctaagctgtatttaattgactatcacttcctaaggccataattgttgactagtcaatttttactaaaatatactcttagcttactgatgcttttaagtcacacaacaaaaacagtgaagataatacatattagtgaaatctactacatagatctccaccaaatttcaagactgtattcttggtggtaaaagttagttagggcaacaaaagacttcattaacctaacattatctattcctgcctatcctcaacaaataaatataaagaaaaagataccaattaacacactatgcattcaaattattgtaataaaattctaatttctttagacatgaacttgacagttttctataaataatctcctagaacgtattttagtgacgaatacactaaataaatttatctcaattttaaaagtaattcccaaatattagcatgttctaaagcagaaaaaatcaggccacagattaaaaagattacatataatctactctgctatcattttattttgtcaagccatgaatactgattaacattaaatatagtagcatttgattctggtgggcagatctttaacataacttttagtattaaaaaattttttttctgtaatcccagaactttggggggccaaggcaggcagatcacgaggtcaggagatcgagaccatcctggccaacacggtgaaatcccatctctactaaaaatacaaaaattagccgggcatggtggcgggtgcctgtagtcccggcttctcaggaggctgaggcaggagaatggcgtgaacccgggaggcagagcttgcagtgagccaagattgcaccactgcactccagcctgggcaacagagcgagacttgttgcaaaaaaaaaaaaaaaaaaaaaatttggccaggcgcggtggctcacacgtgtaattccagcactttgggaggccgaggtgggcagaccaggaggtcaggagatcaagaccaacctggccaacatggtgaaaccccatctctactttaaaaatacaaaaattagtcaggcgtggtggtgcacgcctgtaatcacagctactcaagaggctgaggcagaagaatcacttaaacctgggaggcagaggttgcagtgagccaagatcacgccactgcactccagcctgggcaacagaatgagactctgtctcaaaaaaaaaaaaaaaaaaaagttttttttttcaagagaggtagataatgagtgacttcaggttaaacatagtaaatctgagaataaagagggggcaacagtacatgagatacattaagaaatttattttacaacctggaaacacatgagttagtagtaataaatgcacttagaggaccaaagaaaacaaaactctacacaacaaagtagaggaatcaacatgaggaaggaaatcaatgcttgtcacaaaaactccagaaaagctaggaattgaaggcactgagtacatacgaaggtggctgagggaaagagatgcaagttggcataaaaagaaagttagaatcccacatcttctccctatgctgtgtagccatcctaccatggtaaacattggaagtttattttccagaaaagttataattaaggaaattattaaaaagctataatgaaaaaggcaagataaattgaaagtatacaaactggactatgacattgtgagtgatatttgaaaacttttctgagaaaattgagaagctaggataaaaggtaatcctctacaaataacaaagggaactcatgcatcaccagtggacaactcatacccagacatatagattttctctgtgttatgcttaggaatgagcaaattgccaaagttaaccagacatttgaggaaaccctcttctgtgatgacagacaccaaagcaaacaggcagaggagaaaaacgactcatagaaaacagacaatattgttaagagggtgaggaaaagaagattaaagaaaagtataattaaatatcataggaaaatttttttaaatttcatctaaaatatcaagatagggattttatcaagtgctgtctccttttttttttttttttttttttttttttgagacacagtctcactctgtcacccaggctggagagcagtggcgcaatctcggctcactgcaacctccgcctctgggttcaagcaactctcctgcgtcagctttccgagtagctaggactacaggtgtgcatcaccacactcagctaattttttattattattatttttagtagagatgggttttcaccatgttggctaggctggtctcgaactcctgacctcaagtaatccacccgcctcggcttcccaaagtgctgggattacaggagtgagccaccatgcccggcctatcaactgctatttctatgccccggtattaatcaggattcttcagagacacagaacgaatgggaagagagagagacagagagagacacagacagagagacacagagacagagagagaaagagagaagagattataaggaactgactcacacaattacattggctaacaagtgccaatatctacaggatgagtcagcaagaccaatggcacagtctgaaggtcagcagcctctagacccaggaagagacaaatttgaatccaaaagtgagaaaaaactaaagtcataattagaaggcagttaggcagaagaaattctctctactgggggaagagtcagccttttggttttattcaggcattcagctgattggataatgcccaacactaacagggagggcaatcttttttactcagtctaccaatttaaacttaaatttcatccagaaaagactctcacagatacagctagaataacatttgaccaaatatctaaacagcctgtgacccaaatgacacacaaattaaccatcacaagtccaccccttgtcagcttggcactcatatacatctcctcaaaccacatttcattaccaaatgaagattaataacaaggttataattctacctaacatgatacaactattctgtatacaaccaaaaccattctaaacctgtgacagtcaattttatgtgtcaacttgacaggactaacaaatgcccagggagctgataaaacatgatttctggttgtgtctgtgaggttgttccacaacagatcagcatttgaagtggtaaagaagatctaccttcaccggtgtgagtcagcatcaatcacccgatttgttgagggcccgaataaaatgaaaaggcagaggaagtgggagttcatctgtttctgttgggaaagacatcctcttcacttgccctcacattagcactccagggtctcaggacttcagactcagactgggacttacaccattggttttcccgggcctttaagttttagacagcagatcatgggacctctcagcctccataattgcatgagccaatccctcataataaatttctttgtctgtatctatatatatcctattggttctatttctctggagaaccctaatataaacccattccccaccttagctgatatgtatactttcctaatatcccacaatttacatatttacatactaggatgtacagttaacaatatgatctacagttaacaatacttaaatactatggtgttgatattataaactcaatacatcttaagttgcatggtgagggattaaaagaggaaagaaaacaaagattttatatatatatatatatacacacacacacacacacacacaaacacatatacacacacaaaataagaaagaaatgtaacaattacatttcttgttctgtaaatggtcatgtgatcacagttggtatctacaactaccttttttcactgcctattctgtattccctttgtcttcagcaagcacctcagctggtcctggtactgtacctaatagggtgacccaaagcttcattcctgaagggtctgggctgctttagtagtcctacctggattgtattaccagtgctcctcaacttaatcacacagtatggtaatactaagatatgcactgaggaatctcttgtattctagacatactcttccttacttttattgtggtatagttcaatttccccacagtagtcaggatcaatcactactcttagcatgataactccatttttgcctgaggattcagaggcaggaggagcccaaagtggctgggaagcaatcttaacttccggttcaatggaatcattgttgtgcctcctggtggaagcatttctccctttggaagtaagacctctaggccagcagactgtaagatcacaggaacaggaagcaaaacttttgctattgggtcactagaggtaataacaagtggtaacactcccatttctacctgttgattcctggaccaatgaatcctacctgtggggagaaacagcaccatatactggatgctgattcagtacacatatatccttctggaaaaccttgtcccagccatataaggtattgccacctacattcagttctatcaagccagctgcttgaggatggtggggaacatagcaaggccagtgaattccatgagcattcatttgctgtgaaatagatttcttaatcagaagcaatgctaagcaatacaatgaaggttgataaagcattctgtgaatccacagatggtagtctgggcagaagtacggcatgcagggaagataaatttgtatccagagtgagtgtctactctgataagaacaaaatgctgccccttctatgatggaaggggtcaaatgcaatcaacttgctaccaggtaacaggttgatcatcctagggaacagtgccttatcagggacttactgttggtctccactgccagcagatttgacactcagcagtggccacagccaggttggcttgctgagtggaagttcaggttgctgagtccttggataacctccatccctgccaccatggccaccttgttcatgagctcactgggcactggtgggcggctggggaaagaggctgactagtatccacagaacaggtgttcccagccactttagtattaaaattatcctctgttgaagtcacccttcagtgagcattcacataggacacaaatacacagtattcagattttttctcccattcatagacatctatacacatacctcttcccctaaactttttttgtcaacaattttctactcatgtcccttccaagtctctgaccatccagacaaaccaatagccacagcccatgaattaataatcacatttatccttccaaaaaaagtaaacaatcaggtacactcctcaaagttctgtccactgagaagattattcttcactacagtccatcagggatgtcccaaaaaagggctgtagtgctccaactgttcactttcaggtggtgcctgcatattgtcagaacaatctatacaccaggcccaagtcttctcctctggcaactgatcacaggactcaccaagagaccataggtacgggctggcaaagagaaggtagtgtagcagaactgaggaccataggatatttgggccacttcatgcaacttacttgtgttttcaagcattgcttgggcctgatcacatgtacatcacttcgatttgatgacagagtgcttctgtgcatgtacaacttgatggcttagtaggacagataacattcagttcataataagcagctcagtcacttgttaatttggtggcccagtgttaactgttcagtctctacttaaacctagtgacaggccaagagttgtttctcaaaaggagaatatttgtctgggaaggatgtcagggccttgctccaaaatcctatgggtttgcattgcaatttacctaaaggggcccgtcaaaggctccaaatagcatccccatctgccactgacacttgaagcaccattagatctcctggagcctatggcttgcacagcagcctgaacctgttacagagccttctcttgttctgagttctactcagaactatcagcttttcaggtaactcagaaaatgggacagagtaacatatccaaatgaggaatacgttgcctctaaaatccatagagtctacagccataccaccctgaaaatgcccaatctcatctaaaagccataaacggtcactagcatgtacctttttggttataggaggggccagatacaacttattcttcacctaagaaggggtatctcgacatgtcccacaacactggagccctagaaatttcactgaggtggatttaccttccaacttctgacatgcaaatgccttaccaaaaagtctggtagttacaacttcttgctcactaagtggaaccagcataatgtcatcaatgtaatggacgactgtgatttctctgtggaagtgaaaagtgataaagatccatgcaaactaaattatgacatacagctagaaagccagatactcctgacatagagcagttaagggacactgctagccttgctagctgaaagaaaacgacttctagtggtccttattgacaagtatggagaaaaaaaggcatttgtcacgtctattaggtgccagggaatgtgtcaatttgctcaagcattgaaaccacatctggtacagcagcagtacttggagttaccacctggttatgcttataataatacactgtcattctcaaagattcatgtgtcttctgcataggccaaataggcaagtgagatgaatatatgctggaaattaccacacctgtgtcaaatccttgatggaggaaaatccttccagaaatacagtattgcttttggcttataattttcttaggtagaggcagttcagtggcttccacctggggcctttcccatcataataaccctcactcaataggtcaggaaaccaatgtggagacactgccaatttctgagtatgtctattccaactatgcattccagaacttgggaaataatgacaagatgaattcgaagactcactaggcctattgtgagagagtgctcacctaaaactctattgatcatctggcccccataagcttccctgatattttaggtctcttggactcattgtcacttcagagccaaagtccaataatctgattatttccttttccccagtgaacagtaaccctggtaaaaggtcacaggtccctttgaagaagagtgaggaaaagattaacagtataaattttggtggcacaccagtgtatagagcacccttgacataacatagacatctttctatcttagaaaaagactccattttatatttcatggagcattttgccaacaaggatgttttgtttaattaaaaaaataaatcaaaacctaaaaattgcatccaaccagatgaggatacaacagacacattcttccactatcagttctgaccagaggactctgtgactatgaaagattaggccttcaacatcttgcagtcacttgtgataagaatttggcatctgctgacaaaggatctaccacctcaaagacttgtcgttgtaagactgactgaccacccagccgagaccaggactccttttgtcttcttcgctccccaaggactggtttattaaccctttctcctatctcttttccctctcgatgttaaaatgttactttgttgtggaatgtttaacttataatatttatacattgattaaatatactattatgtatggtttgcaatactgactgacttgtagaatggcttcagcctgtgtgcccacagctctgactactgagtgaacgggaagtataaggataattgcctcattgagaaatccatgtagcttgtggcttttgtgattaaaatgcatcaataaaagcctgacattgtgaaaagacacatatatgtgtggacctggttacttctaaccttgtactggtcatgagaaaatgagtccttcctcaaggggacccagcttccccttccttcacaaagttctggtcctgtaaattggctcaacttgggaaattgattgaggggccatgactcactgcttttatgattaaagttaggtatttgttcacttgatctagaacttttctgcgtatacaggtaaaataaaaaaattaataggcatactatctacttctcccctacatacaccatgatcaattcaccaatgtcatagatctgctccagtcaaatcagcatcacagttctgcttgctgctttgactctgctgtccattatggtgaccacattcaacttgcctttggtgactgaatgccaccacttggctcctgccagctcaggatccaattactcccaatgcgttcaggttttctaattgaccagctgtagttcctaccataaggtctgatctacaaagaagggtagtcgtagagctcttcaagaaagctgagcctccctttaaaaatttatttctcacagtacacggaagtgtatcttcaagaccctgcagtgtgagtaagtaggtcttacattataaatctactccaaagttccaatctccccaaattattttatttatttagagacaaagccttactacatccccagtgctaaaacagtgaccagtacatatgaattagtgatccacaaatgttcaatcaacatacatttctaaaaggaagtctgcaatggaacacacacacacacacacacacacacacacacacacacacacacacacacagtgattgcagcataagagaggaaagagggaaattctaggctgatgataaaagaagcgtctaacataaaagcttcctatagatctaaaggacaaccagactagattggaataggaaaaaggggactctaggtgctatatttccaagcaaaacaattgaaccaataaatatccagtgggtttaaccactttttccaatgcgttttatgattacagagaaaaatttaaagatcaatttgtggtgagtgcacagaaatataagtaaaggaaaaaggacaaaatcattagttctacaagaaagaatgaaaaaaaaaaaaaaaaaaaaaagaccagcaagcaagagaggggagaggaaggacgagtaagggaagagaggaggagggaaaagagaagaaggagcagagaagagagaggagggcagaagaggagaaaagaggggagaaaaaaaagaaagaaaaatatgtaattcatagtacattttttagctctggcataaatacatgataataacgtaaatactaagtatggttttaacaaatgttattatgaaagtatattagaaagaagcaggagagtgaaagttaaaaggagaggagtttaagtactcaatggtcgtctttcacaaaagattaatgttcaaagtttaaaaatcaagaaacagtaattcatggctgggtgcagtggtgcacgcctataatcctagccactagggaggctgaggcaggagaatcccttgaacccaggaggcagagattgtagggagccaagatcatgccactgcattccagcctaggtgacagagccagactgtgtctcaaaaaacaaacaaaaaaagaaatagtaattcaagcatatcactgtcaacaaccaaaaacatttgaaagatgtggctgcttccaagagttaagaatcaatcacggggaagagggggaaaagaggcagagaactattgtttatctgtttcgtattatactattatttgggtgctttatttgatgaaaaataaattttaaattaaaaatcatatgcccagctgaacacactggctcacgcatgtaatctcagcactttaggagaccaaggccagtggatcacctgaggccaggaattcaagaccagcctggcaacatggtgaaaccccatctctactgaaaatacaaaaattagccgggcatggtggcgggcacccataatcccagctactcaggaggctgaggcagtattgtttgaacccaggaggcacaggttgcagtgagccaagatcgcaccactgcactccagcctggatgacaaagtgagactccgtgtcaaaaaaataaaaataaaaataaatcatatgccctaaatatatagaatagtagatgaataaaaaataaaaattgtaatacacacatatttttgtaactggacaacaggtatttatccaagattattcttgaaaatctctaaaaaatagaacatgcattcaagttttacaaatatgaaaaaaactatgaaaatacaaaagtattataagctaactattaagaatctgtactttttttaaagtcagttttttgaggggttttgttgttgttgttgttgttgttgttgttgttgttgttgtttgaaaaagacagggtctcactctctcgcccaggcaaagtgcaggggcatgattatagctcactgtagcctcaaattcctgacctcaagcaatcctcctgccttggcctcccaaagtgttgggaatattggtatgagccactgcaccggatctaaattcaatattgtaacctaccaaatggaatttgagtttatttccatttctactcgtagtaatactacccttttttataagttttgctctcagaaaccaaacataatttatattaaagaataaagaaaaaaaaaattttaaacctgaactcatgtcaaactgtttcattttccttattataaaaatataaaaatttaaaggtttaggttcttcaatgaaatatccacattgatttgttaagatgtagttatctatgcccttgtaaaacgaagcgaattggatggatgtacctccaattacctaaatagttgacagaaacactcctaggagttcagggagaaagccagggaggatagctcaaatgaggaagggaatgtattaacacaaaactgagaaacacattacacacaagactaaaggtcaaaactaggcaaaactggccaggtgcagtggctcccatctgtaatcccagcactctgggaggccaaggtgggaggatcacgaggtcaagaaattgagaccatcctggccaacatggtgaaaccccgtctctactaaaataccaaaattagctgggcatagtgcatgcctgtagtcccagctactcaggaggctgaggcaggagaatcgcttgaacccaggaggcagaggttgcagtgagccaagatcacaccactgcattccagcctggagacagagtgagactctgtttcaaaaaaaaaaaaaaaaaaaaaaaaaaactaggcaaaactgttcatgctcaagatacagtaatcttaagtgctcaaagtaaactatcattaacttttcaacaatgtttgcactttgtgtcagcactctctcaacatcatatctaacacaaacttaaataatcacataccacaaaagaatatagtgtaacaataaaggaaagattttattctattgtgtctttaatcactctgtgaaatagtaaaatagaatactgcccttcggaaagttttggtttcccttatttttgtgaacatattcatctaatatgtacctgtagcttgtataaatattacaggtcagttagtaaagaactgaataaagagaaagtaactattcatggcattcacaaaatatataaatatcttaaactccaaaaaattaagataaccatgcaaatcaattatgtaattactataaacacatttttaattatttgtaaataatcaaaaaatcctcttgcttttatgtttaggcacatgaaatattaatatatttgcaagtacctctaaaaatctgtatttacagtttttcaggtaaaacatatctccagacaataatgatccttccagtgacttccaaactggcatcaatttactcaagatctttcactaatcaatacagaaagcttaatttccataaaggtgacaaaaaagttgctctaactctttccagctacaagctctcaacagatgatcatcattaagtctgtatcagggctccacatttaggagccatataaatgtgtcctattagtacacggtcagtctgtttggcaactctagttcttcagacatatggcaattgctgccctttgaggtctgaagtcaagtctttagggaatctcaaagcttgcactgaaattacaaggagtgttcattagagacttctggaggggaaacatgaaagacttccattaaaactatataaaacagctaattatttttaaaagatttttaaaccatctaatgttctcaactataataaaaagtatttaccaactgaattatttttagaagcactacttcaggacatgggtgcaaacaggtttcttcctacctcctatctcccacctcaatacatacatatttattttataagaattatcaactcaagatttcaatacttttaatttagaattaaattatctcatacttctaaattctgtctacagaccactataaacattttctaaacaaagttattcttagagacaaatgtttgttttctaatatttagcttaggataatatatagccaacttaaacccagccagaaatacatatgtgtttctttttaaatgtttcttttttattcaaaagtctgcctctattttaatttttattttattttaaactaataatcataaaaaattttaagcataaaatgatataaagtattagtcaataaagtggcatttattagataatattatgcaaaacaggaaaacacatgaaggtttaatgtttactttttttaatatacttaagttgataaggaggagttcaaagaaatctcatatatttactgtcagaattttgaaaaacataaaaagtatattttctaattaatgattgcttccattttaactttttgaatgtctagacactttttaactcgagagaaaatcattatttattaagttttgcaataaaacaatcctactactgaatatttatttcagtaacaaatctttataaacttatataaaattcattagcttgcctcaatcatttcttgaatccacatatatgttggtttctgacagcgtaattccaaaaagtaattacaacctcaatccatttgtaaaaagacaacagaaaacaagtatgttacaccagtttaaaagaataaaaatctaaagaaaacagattacaaatgatttatatgaatgcctagtggtgaagttaattacaagtaacccaataaaatagtgcctttattattgtacagcaagtaaaagctctagatgtaaaaaccagaactctttctgctgacttctgcatgctcaatcccacagcacacaacattaagaattaaacatgtggtaaataagccatatagaaaacagcagtttttaagtaaaagcagaaaactttcctgctgtttaaccatttggggccttctactctgaataacaaccactgtaaactggcactatgtattcatggaataagtttttatggttaatatgaaaatgagattttaatttcagtgctcaaagtttaactccaaataaaacataaataactgtaaaataacacagcattcattttagcattcagtaggagcaaataaggtatcttatgtttatgctatgaaatggtgatatctacagaatttaaattttccaaacctcataatacatctacctataaagctttggtctctgaatttaaacatatattagcaaagacatatacactttatgttacagtaacttcttatggttgtcaagagtcacaacctaaagccagtcatagtatgcttaatgactttcctggtgtacagaaataagacctttcaatccagaacgactcagtaactcttatcaaatatttatcaatgttctcaatgagacaatagctgataccaactatatatatatacatatatatacacgtatatatatatatatgtgtatatatatacgtgtgtgtgtgtatatatatatatgcataccaagtataatacaaagtcctaatacatattatgcataaacatcatgatataagccagcagtccccaacctttttggcaccagggaccagtttcatggaagacaatttttccacagacaagggggtgaggggggggaatggtttcaggatgattcaagcacattacatttatcgtgcattttattttatttatttatttatttattttgagacggagtctcgctctgtcacccaggctggagtgcagtggcaccagctcggctcactgcaagcttcacctcccgggttcatgccattttcctgcctcagcctctcgagtagctgggactacaggcgcccaccaccacgcctggctaattttttgtatttttagtagagacagggtttcgccatgttagccaggatggtctcgatctcctgacctcatgatccgcctgcctcggcctcccagagtgctgggattacaggcgtgagccaccacgcccggccgtgcattttatttttattactacattgtactatgtagcaaaataattatataatgaaccataatgtagaatcagtgggagcactcagcttgttttcctgcaactagacagtcccatctgggggtgatgggagacagtgacagattatcaggcattagattctcataaggagcacacaacttagatcagctgcacgcacagttcacaacagggttcatgctctgatgagattctaatgccgctgctgatctgacaggaggcggagctcaggcagtaatgccagtgatagggagcggctataaatacagatgaagcttggctggctcacctgccgctcacctcctgcatggcctggtttctaacagtccacagactggtactgtggcccaggagttggggacgtctgttttaaaccattgtttgatctacaacataactgaaataataaatgatgaaatacttgataacttggttttgccccagaaataaaacaggactgataaacaatcaacagtgcatctctctagtggtattttattcctattaatttcacctccattagaaatcaatacaatattaatttattttgcacctttttttctgagtcaaaatcatcacaaatctgtctcctcaaccctcctactttaaaagtagggacctctaccctccttaagtcctcaacagtgcctaattcaattttccatacaacaaacatttgaatacttgtttttatttttttaatttttttgagaacagggtcttgttctgtcactcactgaaatgcagcggtgctatcacaattcactgcagccttgacccccctgggttcaagcgatcctcccatctcagcatcccagtagctaggactgcaggtgcacaccatcgtgcccagctaatttttgcatattttgtagaaacagggttttaccatgttgcccaggctggtctcaaactcctggactcaagcaattctcccacctcagcctcccaaagtgctgggatttcaggcgtgagccactgcacctggtcttgcttgttaaataaatcataacttaacactgttactgaaagagggagaaacacttcattaagaatactcagagactttcaaagcattactggatatattagtttcttgtagctgctgtaacaaattgccacaaacttggtggcttaaagtactataaatttgttttctcataattctaaaggccagaagtctgaaatcagttttactgagccaaaataaaagtatcagtagagccattctccttctggagactccaggggagactctgttccttgcttcttccagcttctggtggctgtcagcattccttggcttgtggccaaagaaaacagggtctctctgctccattttcacattgccttgtcctccatttctctgtctgtagcctcccactaacgatctctaataatgatacatacgataacatttagggtgtacccacataatccaaaattatcttttcatctcaaaatctttatcttaataagatctggaaagacatttttccaaataaactaacattcacaggttccagggatttgtcatggctatttgttggggagccatgtctcagtcaatcacgctgaagaaaccaaatgagaacagaaagagcaagcagacgaaaagtgaaccttaccagcaagtgcaaattcaaaatatgcaaaggaaacaaaaacttttttttttaaatttagtgctgtgtggcaagaactggaaaaaaaaattaaacaaatcaagtcaccttatgctccaagtgttggttctaataatgactgcattgtgactggttttgttttcaatgtcagaaattcagcttaatttgttaagtataaagcctatcaggctgcaataaactgaaaggtgggcagctgagcttcttgtgacaagctgatatcacaccgagcaatctaactgcctaatgccagagtacttaaggcagcagtccagatttgctaaggagactggttaagcaacagaaagcttcttaaaagttctccctcattattttactttctcactgcccctaaccaacttctttttccctttttaacttacaatactagcaaatagaatcctgttctcacgaattagtagcacttcacaaacaattataggataatagcgtaccgttccaatggatagaaatacaagacaagtctgaaagatcaagcaactttctaagtgctctcaagtaaagaaataggtaagcttttctgagaaaaagaaataaaaagaaaccaaaattaaatttaacttcaattttgtagtatctgatacactgcaacaagaataaactgacaagccagccagcaaacaaggcagtactgatgtttcaattaaatgcctaattataatctgagcttctaaatgaagaatttacagaaataaataattactaccaaaaagaatgcactgtgttgtatccagtattcaggaccttggtaaacagtttcacactcactatctataaaagcccactgtggaagagaaagtgtcaggagaatgtggggaacagatttagggtcacacagtttggggtttctggttaactacctagaagatagtgtgatatgcttaacacatatgtctcatatatggatactatttgtaagtcagcatggaaataagtataaatgaaaataaaacagctattaagaggccttgaaaataaggcagagaagtttgaatttgacaaaacagtaaacaactacagcttctcctggaaagaaaatataaagacactctactaggaaagtaaatttgttagtatgtactcagagataaaatcaggagaaaggaaaaagggcatttcactaattcaggaataaattggaccagaatctaattcttttatctcactctctgcccaagttttattaaggtataactgagaaaaagaaattgtatatatttatatatccaaggtgatttgatacgtgcataaattgtaaaataattaaatcaagctaattaacatatctatagcctcatatacttatcactttgtggtgatgctgtaggagttattaagaaattattttaggcagatagagaggaaaaggggtcctcgggaagttttcatttttaaagctgcttcagaaacgtttcttgtaaaagtcctggctctttgagcctgatggcaacctttgatatgcaaatttaggccatttgaaactgggtccacccaaacttggtgattatcgctgcctttttgcccttgccccacatgatcctggcaacacagctgcccccacatatccccatgtgtgtagaacatcatggtgccctgtatttgcatattaaaaggctagggtgggaggcccagcctttttgccctacgtgaatgacatgcctggtcaaaccaatcccctgagccctatgcaaatcagacaccacctcctccagcctctacatatacctgactggtatccactgcatttggggttccctctcttggctttggagccccgctccctctgtctctgtacaggggagctccttccttctttctttcccctttctatcttgcctattaaactctctgctccttaaaaccactccacgtgtgtcagtgtcattttatctaaactggcatgaggatcaagaaccctggtgttcctccactcatcggagtcatatcagtgagaacatttaagatctacactcttagccagaatctgattctttacagagggcttttgaaaatgatatttccttttatttctccccaatttgtaaccacccaatgggctcaccttgcccgctgcctagacagagccgatttatcaagacagggaaattgcaatagagaaaaaatcgttcatgcagaacctgctgtgcgtgagataagagttttattatcactcaaatcagtctccccaaaacctgggggtttgtttttcaggataatttggtggggaggaggccagttagtcaggagtgctgattgtttggattggggatgaaatcatagggagtcaaagttgtcctcttatgctgagttagttcggggcgggggcgtggggacagaactggttggcaagttcaggtggggccatctggttgtcagaaatgcaaaaacccgaaaagacatcttaaaggccaatcataggttcacagtagtgatgttattttcgagagtatttggagaagttgcaatcttatgacctctggaaaaatgtctggtaatatttagaattccagcccctctcatcctaacttggtggctggtggcctttcattcattttacaagaacagtctagcttttgggaagggctactatttaaactataaatgaaattccttgtcaaggctagtttggcctacgcctaggaatgaacaaggacagcttggaggttaaaagcaagatggagttggttaggtctgatatatttcagtgtcataatttccttagttataattttgcaaaggaggtttcaaattctactaggactcaggaatcatcataatgaacaactgttaatgataataatgtacttgaccagaaaaaaaaggtggattatcacagaactagattaactactataaaagtatttctcaactacggtaaaacaggaggtacgttgaaagtaacatagtataaacaaaaagcactaaagttgacaaaaggggcacttaaaaacaattagagtagtaatacaagtaacacgacatcagtgttacttgtattttggtacattttgtttagtatcccagaaagggcagtcattaatagctagcacataaaaaccacggaatcatctttgggagcctattgaaaaagtgaatgttatccattatccttgtctacatggaaatgaaggccagaaatggctaatctatgagacctcgtctagctccaccaggttaggaggatgagaagtgcctgaattctgttaagatgtaggcatagttatcagccattgttccagaggtcacaacatttgcaacttccctaattactcccgtaaataacatcactgttgtagaccctaaggttggccaccttttgagatgtcttttaagacttttgcattttgcatttcttttttttttttttttgagatggagtcgcctgggctggagtgccaatggcatgatctcagctcaccgcaagttccgcctcctgggttcaagctattctcctgcctcagcctcccgagcagctgggactacaggcacccgccaccacgcccagctaatttttgcatttttagtagagacggggttttgccatgttgtccaggctggtctcaaactcctgacctcagatgatccacccagctcagcctcccaaagtgctgagattacaggcatgagccactgctcctggcctagacttttgtatttctgatgaccagatcactccagccagactcaagattcatgactcaagggtcctgtagccctcacccagaagtggactcagcaaaagaggaccattttccaccatccaatgattttatccccaaactatcagcagcactctgaccaaaaaaatatgtttaaaaaaccctagtctccaaatttttagggaggctgatctgagtactaataaaactccacagtcttctatttagccagctgtatgtgtattaaactttttccctattgcaattccccagtattcataaattggctctaccttggcagcaggcaagaagaacctattgggcaattacattggaaataccgaataaatgaagaggattttgagtgctgttaaaaaatactcagattcggccaggtgtggtggctgacgcctctaatcccagcactttgggaggcaaaggtgagcaaatcacctgaagtagagagttcaagaccagcctggccaacatggtgaaaccttgtctttacaaaaataaaaaaaagtcgccaggcatgatggtgggtgcctgtaatcccagctactggggaggctgaggcgggaagatcaccgcggaggttgcagggagccaagattgcgccactgcactccagcgtgggtgacacagacagactccatctcaaaaaaaaaaaaaacactgattcagaattcagtaactttaatttacaacctactttgctctgtaaacagtactgcatagttttacatgcactgcctaataagatccttttttaaaattgtttcgagaaagtagtgttagaattatatgtggatcgtaaaaatgtaatttttaacacgagatatagaaatattaatttaaacattaaatttataacaaaggatatgatacgtttaattttgtttaacaccttttactagttaaaaacttcctagcatcttctatctcaatactttttgtttttttctttttaatctttctgggtacataggagtatatatttatggggtacatgagatgttttgatacaggcatgcaatgcataataatcacatcctgtaaaatggggtatccatcccctcaagcgtttatcctttgtgttacaaacaatctaattatacttttttcattgttgtaaaaatgtacaattgaattattattgaccatagtcacactcttgtgctatcaaatactattattttatttataccattaaccatccccacctctcctccatcctcccactacctttcccagcctctggtaaccatccttctctactatctctgagttcaactgttgcttccaaattttgcctattgtgaacagtgctgcaacaaacacggaagcgcaaatatctctttgatatgctgatttcctttcttttggatatatacccagcagtcagattgctggatcatatggtagctgtatttttagttttttgaggaactaaaaaccattctacatagtggttgtactaatttagattcccaccaacagtgtctgattaaatctttttgttgttgttttgagacagagtctcattctgtcacccaggctggagctcagtggcatggtcttggctcactgcaacctccgtctctcaggttcaagcaattctcatgccccagcctcccaagtggctgggactacaggcacacactaccacacccggttaattttttttttttttttttttttttttttttggtatttttagtagagatagggtttcgccatgttagccaggctggtctcaaactcctgcctgtgataatccatccacctactcctcccaaagtgctggtattacaggcatgagccacgatgcctggcgctaataagatcttaatatacccatttcacttaataagaaactgagactcaagaaaggaaagtaatttgccaaggttacacagtaaataagtaatagaataaaaaacatttattaaaattcaaaatctaagagacgggcaaatcacctgaggtcaggagttcaagaccatcctggccaacatggtgaaaccccgtttctacaaaaatacaaaaattagccgggcatgatggcaggtgtctattaatcccagctacttgggaagctgaggccagagaatcacttgaacctgggaggcagaggttgcagtgagcagagatcatgccattgcactccagcctgggcaacagagtgagacttcgtctccaaaaaaaaaaaaaaagaaaattcaaaatctaggtcaggcacagtggctcacgcctataatcccagcacattgggaggctgaggccagtggatcacctgaggtcaagagttcgagacctgcctggccaacatggtgaaaccccatctccactaaaattcaaaaatgtgccagacatggtggcgtgtgcctgtaatcccagctactcggaaggctgaggcaggagaatcacttgaacctgggaggcagagattgcagtgagccgagatcatgccactgcactctagcctgggtgacagagtgagactctgtctcaaaaaaatatatatatatattcaaaatctatcatcacagtattttcctggcctcagccttttcttaaaaacccacctaaggcatctttttccttcttcctgttatgacccatgacagagacaagagccacctgtacatagttgacctcaaacagctgaggaattcagtactagaaaaccaaataaattgcatcaagattctgattcttttattcaggcctaaatcaaagttcaagcctcaaattttgctaaaactgtatatatatttctgaattttcatattataaaataacagcttgaataaaaataggtgcctgactaaaaaatgtacaatagatggaatgtttgtgcaattactcaaataatcattccctcctaaattatactatgtcctattatgtatgtcaaggtatgtaaattactaaataataattttatcgcagcactaagttaaacactgcaaataccataaacatacagcaagatttaaatctggatcctgagaagctgggatgcctaatatgaactctgactactctgactaaaatccattaaattatatactattcatcaaaaactatatagtatgagaatatagctaaaacttctaaaagttatcagagagtttggtattaaacaaaggcaatctcaaaatttacacttttaacctagcctctctataattccttaacttcagtagattgattagaataggaaaaaaaagtactaagtaaaagcaagcaatgatagctgagaaacagagacactgatctgtattctttttttttatacttcaagttctagggtacatgtgcacaacatcattaaaaccaaagaaaaatgttatgctcagaatattcccatttgtgtatttctcccttttcctaactctcttcttaatcccaaatttaaaagactagttgtaaaacagtagggtgccaaattaaaacacattttattttcagatgtctccacactcacaggctgacttcctgtcaggaagagttccatttcattgaataccccaatcagcagggaacttgcagaattaagtgccagttgatattactttgttttgcatttaccacccttgagaataatgttcaaagatctagttatatagtcagcatggtatcatccttctgactagactgccaagccacagggtgtactgccagttccacaaaatttacctcaaaggttgtgttttctaaatcctagtgtgctggtgaatccataggacgcctgtatttcaggtcaaatcctgaatctaaagttaaattatgtttttctttggttgtaacagcacttttaaatcaatattatggaaactcaaataaagatcaattaatgctcaccaacccatcaacctattttatttttgaaaagaaaaaaaaagtactttactccgatttattttgtattaatgtttttgctattgtttcaagacaaatgtttccaccttataatagaaagttatctgttataaaattttgaatcaataaagcatgtttgcatatcagcaataaagtacagttattgagctgattttaaatattttaaaatagttcatgcatctaagtttttcatgaccaatttatatagcttgaatcttcacctaacctctccaactaccatagacttcctatccagtcctcacaagtctatacttccttcttttaaggtcaactgtttttactgcgcacaaaatgaattctgagcatttcagcaaagaatacctactttctcgggctttgtatattataagaacaaagcattcacagcagctctaaagcaaaacaatatgagtgtattagaagcctaccctattgattctcattccatctgcaatcaaaaggtcataggtagtaacaataacaaagctcagggacaatcaatttatatccactaattttttataagtacgttctaaggataagttacaaacacatcaagaaggaattaaaaattcctttttgaaattgaaattaaaatgtactgaaaccaacattttccaaacttatttaacactgtatattcttttcatggaacaatttcttttgagactgggtctgctcatgttgttgcccaggctggtctcaaactcctggcctcaggcaattctatgcttcagccccagtagcggggattacagttgcaaaccaccacactgggcagaacacctactattattatcacaaggtactcactgtggaatttgctgtattgaaaaagtcagatagtgagagttgatcaaacaagcacatggctaccacaatttcaaccaaggaaaattgttaatgtccgtttaaaattattatcttatattacaattatttgtctcgctcactaattgtctcttctactgcttaaggaataatagatgatagtttccttaaaggaaggggcttgtcttaaaagcatacgacacatgtttgctaaataaatgaataaataataccagaagcagacataaagaaaaggacttgggcaaggcagatatattcacacaaagctctgtagaagagacagcatttgaactgagcctgattgaccataaaactgaaaattctaaatgtacagaataatggcctcctcaaactgctatacaaaacttcgtatcataggatttccttataggtgaaagaaatgcataatgaagttaagaaggcttggccgggcgcggtggctcatgcctgtaatcccagcactttgggaggccgaggcaggtggatcacgagctcaggagatcgagaccatcctggctaacacagtgaaaccccgtctctactaaaaatacaaaaaaattagccaggtgtggtggtgggcgcctgtagtcccagctgctcgggaggctgaggcaggagaatggcatgaacccgggagatggaggttgcagtgagcagaaatcgcgccactgcactccagcctgggcgacagagcaaggctccatctcaaaaaaaaaaaaaaaaaaaaaaagaaggcttatttctattttgattaagcaaagcaactcatagtcaaaatttctattttttggttggcaaaaaataatcctttatttcattacctcaattatttctttgaaataaatacataattttcctaataccggatagtaagttttagttaaaaaaaaaaaaaaggttgaagcgtaccctaaacacagcacactatgaatagctaaccactccacttaaaagaaataaatttctatttatattaagttcagcagtaagtaaaactaatccacagtaatagaaatcaaatcactggcaacttgaggtgacagaggaggggattgattgaaaagaggcacagggaaatttgaggattaaaatggttgggtatatgtcaaaattcactgaacagtacacttaaaatgtgtgggtatttactgtatataaattatacctcaataaagttgacgttttttatttatttatttatttttgagacagggtcttcctctgtcacccagactggagtgcaccagtgcgaccctagctcactgtaacctcgaatctttgggctcaagcgatcctgctgcagcatccagagtagctaggtctacaggcacatgctaccaagttcagttaaatgtttttctttttggtagagatagggtcttgctatgttgcccaggctggtatcgaactcctggcctcaagcaatcctcccacctgggctaaattgttttttttaaaaaaagaggtctaggctaggggccgggcacagtggctcaggcctgtaatcccagcactttgggaggcctaggcgggcgaatcacctgaggtcaggagttcaagaccagcctggccaacatggtgaaaccccgtctctaataaaaatacaaaattagccaggcatggtggcaggcatctgtaatcccagctactcaggtggctgaggcaggagaatagcttgaacccaggaggcggaggttgcagtgagccaagaccacgccattgcactccagcctgggcgacaagagcgaaactccatctcaaacaaaaaaaaaaaagaaagaggtccaggctgacaaacataaggagaccctatctcaacaaaaaaatcaaaaaattagccatgtatgctggcatgtgcctgtagtcccagctacttgggaggctgaagcaggaggatcacttgagcctgggaggtcaaatgcagtggaccatgattgcaccactgaactccagcctgggcaacagagcaagaccccgtcttaaaaaaatgaggtgaatctgattaagtcacaagaaaatgaaaaaccaaaggccctgctcataaatgaacataactacactatttggtaatgataaaattagttgtcttaatgaaaatgaagatttaatataaaaactaattaatacaggaaagtatggaggtatttcctaatgaaaaagaccaaaagacaaagtccaaaatatggtgacttatgatccatgttaccattgatttatcaattatacaagtacataaacatttatatggttgaacagtactatactggacgctggggatacaatagaaaaaaaacacagtgcttgtcttcaagaaatttgcagtctacatggaagagaaaggaaaacaacaggcaacttaaatatagaatgaaattaactatgggtgagtgttctgcacaatacctcatttaggcgtagagttgtagggaagagagggtaaaggaaatctttccaaaagagattgtaatttatctaggagctagctaactgattcattttttccataaatattcactaagccataatgtgctaggtaccagaaatactttaatggacaaagcagaaatagctgttaccttcatagcatctagaaaacaaagaggaatactaacagtaaacaagtaaaccaattagcatatttatacttacaatttgtggtaaattctataattggtgctaagattaagacaaaaagataccaattatagatatgatcctcgaagaatgagataattaagctgagctctgaatgataagcagcagctaacaaaagtcaccaagttagaaagaggggcagcttagggaaagaaaaagcatgtaccaagacacagaaatataatggcatatttgggtatctttaaatagttcagcatggcttgagaataagtggtaagaaatgaggttcaggcattaagagagacctaaatggtaaaggacaccttgtgccatgtatggagctggtttgccttttttgggggtggtggaagagaggtattttaataatcttctcatactgaaaatattcatctataaaatcataactatagaaaagaatattaatatcatatattcagaaaaaataaactcaaaatggagaagaaacttgggattagagaaaagaaagtacagaagaacaaaaaataaagaaacgttttactgaagattcaggaaaaaaattcaaacataaaactgacataaaataatcataagaactatctcattcttattataaattattataattttaaaattaataattcagaggtacagaaagaaatacaagtcaaaaatgaccaaaccttatatcattaccttcatgtaaagaaaatatttcccaaaacagcaacaatctacatattttgttgaaaaattttttaaagaataatcagcctaaaatagtattttaaattaacttttgctgctaattaattactcagacaggatgccagtccagactacatggtgcttctagtttttctatatactgtatgcatttctgataaatgggaaaagaatagatgacctggcagaaggctcagacaataatatgtgatttacaggacaagaatgcagctaccacaagatttatctgacagccctctccgatagtggactgttgagtatccgaaggaatgatttctagtctacaaagtctactactgagtagccatacacattatttatttattagatgttttgggttgaaaccatttttaaatgatgcacttcacaatgcacagtcataaatttagctttaaacccaagaagggaggtagtgttattggaatgtatgtcagactgaattaggactagcaacacaacgcttttataaagtggccttgaatgcaacgtcaagtctttcaaaaatgatattaatgtcaaatgaacaagatacaaacactttatataatgctggagtaatattacttgaaacatttgcttaacattttctttaaattcatatatatttaaaacaggtttatacacatatacaacaaatttggcacacaagtaagttgcatgtttgtgaaaaaccacctgaaacacagttgagaacttgttcaatttttgtgtatttgcaacagagaacatacagtttcctgaagaatgtaagcagtcttattttaagaaataaagaggatttaaattgatctttggaacttcagtcattcttgaattattctacatgggattcaacagatgaataaatctatttttacaaacctcatattttaattatactcaaaaatataatgctgagtattatgagaggtttccaactctaattaataacattttgcctaaacaatattaacatttaaatagactaaaatatgaaatggtgcctaatcaactattatatatagcctaatcaactattggtaaatgagtggacattgaaaatgacaatcttagtcaaaacaaatatatagtgatctgtttggttttattgtcagctaaccaaatgtgatcatttcctcatttcttaaatttaggctctaaattctcttttacaaataaaatgcagttaaacaccttattaaaaataacacaaaaagaatataagttttgaatggattcaagaaaaataatcagagcatggctgattgtcatgaaattaacaccaactaatttgtaaagttctaaatcaaatttgcagatgttaagttcataagcatatcccattatttacgtgattaaaaagtagtttttgacctgatctttcgatctttggcactccgtcctctccatctcctcttaaaaaattaattaaaattttagcaagatggtagcttttgcttcccaccctatctcagaccaaaaaaaattatcaatcaaactcaagccatccccacccaggatctgtaaaatgtcgacttgaaattcaatttcatatctcttaagctttcatgtagaaaaagacagttcacttcttaacaaaataaatcacttttgtgattgccaagttgacctctttgaattaggaaaattcaaagtgaaaaatgtaattatcaccccagaacaatctgtatacatctggagctaattctagcttcatttttcacatcatttttcacactgtgctacatcttgtagagatgccatggaacttttgaagaactcacaaaaaatgttaaggacttcaaatacccaataatgtattttattcaaacaaaaaccttgacaatttctgacttgaaacttactgtactatatgatcttcatatcccatttgattgcattagtattaaacagtactgtgacatacatgataaataggcatattaaaacatgtcattctttatctttgcagctcctaacattaaaatatgcaatatactatattggaaatagcttccatgtaccaaaaatacattcgattcttctaaactagaaagtaaaacttcattgtgaaaattcacctatgaaataattatatcactatgaacaataaatttatattcttgtaaggaaacatccaaaaccataagaatgctcttttaaagtgagggcaatttcatgtagacataagaatgctatatggcaatttctatccaagaaagaaacaattatttctaatcaaatggcttaatgagaaattttatctagtcagcttttgaagaaatggagttttctaaatgagatgattaaattatagaacatgattctcagtaaatctaagaatcacaagcctactaagtaactacttctcacaagttcattacaaaaatccattaggtgtaatctctagaagtaattgttcttatcgcaccttattgacaatgcatagtattgatttttcacaccttctatgattctttaatttatattcatgaaatgtccatcagcacagtctaaataaatttggcatataggcactaaaacaaataaatcgatgcaaagaaacattaattttgcattatccttattcgttaggcaagtaaaccatgagagttgtaaatgaaggtcaaaggttttgaaatgggtcaaaacccttgacctctagaccaatacctttcctattaaaaaaggctattttaaagttttaagtgggggaatttactaccaccaagatatcactttaaaagactacaaagaaaactctcaataaaaacattcatctgtttaattgcaaaacagaaaagaaaacctcacaggatacatgatttttatataagttttttttaaaaaaatcattaaagtttaccacatgaggtacaaggttttggaacacctaaaataattttgctcttaggaatttattttctacatcttattatgatagctgccacatttttgttaatgttttcccaaatctactgtgcatgtcaaaaataattaccaatgacaaggattcaaaatcatttatcgctcattttataacctctgcacaaaatggaagtaaacccataattcccagtggagtcagcgtggcactccacaagatatagaaataaatctgtttttataaccttaatatatacagcaaagaaattatcaagatcatttgatctggacatttttaaagtgactctaaaaacttttgtttctcacttcctctcatgcttgcttcaaaattatctgcaagtatcaaaaataagaagtaatccttttgcaatacaaacaaaattattttaaaacagcaaactcacaattttattataccaaaaatttcagtaatgcaaatataaaatcccccatgaaaacaaattcatgtgataatctacttttaattcaacatttattcttgccactcacctgagaacacagtagcataaccaattccacaactgaactactcgacttcatgcaaaccagacctattttaaagagaattttaaaaaagaagttataaagaaaacaaatgaggatttgttacaatttcatccaaactgtttcttcaaattattttttcagactattaatagtgcacatttaatcacatgatcaaataaggtacactatagttagttcaaagctggcttcaaaactaccaccatttttgtaaagtatttcatttcagctttcaaaatactaaaacatttattacaacttcatatataatgacaattcacaatactcatagaaatgtgcacaacatatgccatattgatcaatatcatctacattttgttttggagagagttgatcgttatacatgcagagaagggaaatggctccctgacctttgctttctccactacactctctcccttcaaccctctagctatcaatcaagtttccattttgtttcatggcagcagacatcccaaacactcttattagtaccttgacctctgacctcacactaaaccttaacagaaatgcaagccgttgtctgttatatattcttgatttcttataaattaattcatttacttttatgtttcattttggttcaccaaaaatatctttagaatggatattttatataattaatacctatttaaagaagtctttggttttaattaccaataaaatataaagtagttcattagtatcttaacaaagcaatgccaataattaaagggactaaattattaaattgcattactagtaatcaaaaaaattacaatttttttattcgacatttttctaagcaaacacaggcttaggttccagggtataacatctaaaataattcctgatggctcttaaacatcctattgccttcttttttctcccgaagaaaactcttccaggtaccctatccattccctttgtctttttattctttagttctttctccttccccgtttaaatacgaatgcttccaacctaatgatagcgcatgttggcattttttagctttataaatagcattcaagttaaaagggctgttcacccccttcgttttttaaaaaatgttagaaccatttttctcaatgtctgaaaaaatatgtaacatagaaatgatggtaacagtgtcagcactggcaagaaaattagctatagaatgtctctatattgtattaggaagcaaattattaactacagtgtgatttctgtagggcgaagatgaacatggctcttcaggctaatgctgtcaaggccaaaagaaaaggcaagcaatactccctctcttactgcaggtgtagccctctgctggtctgaaaccttgccatttttccttaaatttaacccagataataaaagaagttcagttttgctccaacttcaaaacccattatttccagaaagtaaattcagatctttctattattaggtcattaatccttattgctttattcgagagaaactagaattcctgccattgggccctgatgggcccttttattatacatctcttcagataatgaaaaatagtaattttaaaaaagaccttaagctatccaaaattagggagatttataggtgctcctttgtccctcttaccacacttatcatatttcatacatatacatatatatatattttttgagacgttgtctcgctctgtcacccaggctggagtgcaatggcacgatctcagctcaccacaacctccacctcccaggttcaatcaattctcctgcctcagccacccgagtagctggaattacaggcgcccaccaccacacttggctaatttctgtagttttagtagagacggagtttcaccatgttggccacgctggtctcgaactcctgacctcaggtgattcgccaaccttggcctcccaaagtgctgggattacaggcgtgagccaccatacctggcccatatacctatatagtcttaagaaaaatttcacacatacacatttctgtttatttatttcagtcttattttccaataataaaggctaacaaaccagaagaaggttcatagctactttctagttggatatgaatattcaggaaaaaatatattcactgacaaagctagtaaaaggtcaaataacatttcatagttcggtttgaacaattaaggtggaggagagtgatggtagatgtattgcaggggcagggtggaaagtatgttcaattcgaatgagtaagggcttcagaaaacaagagagacctgataacagaccttaagttccctgtctaaaggacactggtactgtaaacacaaaaataacattgggagcaaagaaatagaggatagccccaataaggaacttaacatcaaaatgtagaacttacgtcacttctatttttgacctaaatttttgccaatggatgacactcatcacatgtgcaaaaaaacaaataataaacctgtaaatctctcttcagatttagtcatactctaagaacatccaaaggaaggccctaaaaccttaaagtcaagttgtaagttactgccagaactatcattttcattttatacacccacaaacacacacaccctattactgtctcaatcaaaagaaacgaagtactgcaagcttacagatttgaaccagctcacaatctgacctctctaaaactctcagtagaatagtagaataatagggtttggtttgattattttttggttggcttttcaaaggtagaaaatgttagtcttttcaaaaggacaaactcaggataccaagccaagagttttatatctgcactaatctggaattttatgatcaaagaccactgtaatttcttcagtggagactcacccagatatatcacttcagtgaaaggattaaatgactcaccagacagtaagccagtgccacctaaacccatcgatctatctaaatcctcaagtatacaatgaaaaaatagtcatgactatttactatctggaatataagagccctcttgttttttgtatttaagtcaccttaaataatttattttttaaaataggatggcaataaacattatgagaaactttaataagaatttaaggataataaactcaagaagttttactccatattttcctggttttgaaggtatatacatatactccaaatgagcattatcttttagataaaactaaatgctcatgatgaatctgaaacacaaccatcttgaaaacactaagtcgaaatttcaaatacatgtttaataggctctagcttatcataaattctggttttccttcctgaatttatatcatccaatccaacattttggaaaaattggatgactaaaaattttgttaaagaggacagacatcttctttgcttgagacttgcaaaatattttcttgtacagatttgcaaacatttagaataatcaatccactgaattttttatttccatataaacttttccttctagtcatcattgtatgcacacctgcctttagcatttatctacttagaaactgtatcaagtaaactgtggtacataatcatcccacaagacggaagaacaccgccacacgtctttttagaaaaatgggatggcccaggttcttgtctcaagttatcacacaaactaagcacaatgaagtccttcctgctaaataacatgctcatagagtgtacagagatactgtgaccctttggagggtcacaaaccattgtaatatctaagatattttttgcctaccccaaaaaaagtttttgccccattgagactgcaagtttatactttcttaaaacacagtgcaggcagagtgcagtggctcatgcctgtaatcccaacatcttgggaggccaaggcgggtggatcacttgaggccagaagttcaagaacagcctgggcaacgcagcaaaacccatctctataaataaataaataaataaataaataaataaataaataaataaatcaataaaattttttaaaacattagacgagcatggtgacatgcgcctgtagtcccaactacttgagaggctaaggtgggaggatcaactgagcccaggaagacaaggctgcagtgagccatgatcacaccattgcactccagtctgggtgtaggagtgagactcagtctcaaaaaaaaaaaaaaaaaaccacagtgcaaaattttgggtaaagcaatacaacgacagaggctaataaacaagagtaattatttcttttcctattgcaccatcactccaagtgcaattctagcattcgtgggttttttttttttaattttagtccacagcatagtaaagaatagctgatgtgtaatagtgaaatagcaaaatgtttcaagatacagaaaaaataagatcactaagactataattaatcatatttataaaaaggatccagtgaactcacatataataattgtaagacataatttaaaattttcaagcttgtgttctctttgttctttggaaaatctctttagaaaaattaatccttacaaagggttataactacttgaaaaagagggttaattaacatcattacaattgagacaatcaggctacaggtgattccaggcatgatgtaatatgaaatattacatctaatttaacttttagctttaacttcaagtcttcaaaatatacagggcatatggccagacgcagtggctcaggcctgtaatcccagcactttgggaggcaaggccggaggactgctcggggtcaggagtttgagatcagcctgggcaatgtggcgaaaccccatctctacaaaatatacaaaatttagccagcttggtggcacatgcctgtagtcacagctactagggagactgaggcacaagaattgcttgaactcgggaggcagaggttgcagtgagccaagatcgcaccactgcactccagcctgggtggcacggtgagactctgtctccaaaaaaaaaaaaaaaaaaaactaaaaacaaaaacaaaaacaaacaaaaaaaaaatatatatacacacacacacacacacacacacacatatatacacacacaaatatatatatgtctatataaacatatatatttcttaaagataaatatgggctgggtattagacgacattaagaaactattactattattaggtgtaatagcagcattgtgattatgtaagaaaatgtctttttttacatgctattaagtattcaagggttgaatgacatgacatctaagatagttttaaatatctaagatagttttaaatattaaagcaaaataaagggaagtagagatatcaaataattatggaaaaatgaatatggtttggatagctggtaataagttcatagatactatacttactacttttgtgaaaatttgaaattttcattaaaatatttttaatactaaaaaactcataagcatttttttaaaaattaagaagctttgtaatgtttggtcacacagctagtcactggcaaggacagaatgaaaaccaaagtctcctgccttttatattaatgctttttgtacagtattatgctgcttatacagtactatggcacaatcacctctttttaaatcctttctgttttacagtacatgaaaccacaatccaaaacattcctcacaacataaaatacataagttacataagaactcttagatttgtttgctatttttatgaacatcatcaatgaataggcactgctcaaatttatacatgagcaatagtacaccttcttccttcttacaattttaccaaaatttattggtaaaaaatcattctaaattaaattttgttcagggatatagaagtgtccattgctaatgcttctgggtatttaacatgatcctatcttgttatctgctataaaattcaaagaccaataagcaacaatgtcttgcaatactgagaggctgtatttaatacatacatcttactcactgtaataaaattaaacatagttcataagttgttacaccatttaaaaaaaaagtttcatatatgaaacataaattagggaaaagccctgaaatatagactcttcaatttttaaaattcaatttttttccaattatattacttcataagtaaaagtcattcattacttcatcaaatagttcatagctaaataaattatatccttcaatagatctaaggaaattgctattccaaacttaagtacttctaaaatctgaactttctttttcaaataaactcattgttactttttgactgcatgaaaataatatcgctcatcaccaactccatttacatctatagaagagatgaaattcctaactaaagcttcatatgtacctactgatattgtaagggtcaaacgaagtgctcatattgcacagttaatactcaaatatagatatcttaaactattagcctacctataaccttgcatttccattatatccttattgctacaagagagatgctttttcacaggtttttaaaaaattcctcagaccatctcctagctactgttagtcaacaaaagattacaataactaaagctgccagttgatacttaaagacactggaatacagatgggagtgtcattcccatgatttttcagtttgaggagaatacaagtatattatcctaaaccatcaatcacgggcccaaaaaaagccagatttagcaaccacctaatccaagcacttttgaatgcaaaaattaattctatatcatcatttataaaaagccctgtagcttcaccttaaaaaatcctagttatgaggtcaggtgcagtggctcacacctgtaatcccagcaactcagaaggccaaggtagggttcaatcttgccagtacactgcactccagcctacacaacaaagcaagactctgtctcttcaaaaacaaaataaaataaaaaataaatcctaggtacgaagatgaagattggtattttgaagtcagtctgataaactcttcaactcattatttaagaaattatcctctattgaactgcaatctgttttctgaggaaatttacggtaaatctactttcacttggttaagtcactctctctaatattcgaaggcactcactacatggcaatgctccatgcgcaaaaagaaaaaaaaaaggaaggaaggaaggcagaaggaaggaaggaaggaaggaaaggaaaggaaaggaaaaggagaaggaaaggagaaggaaacgagaaggaaaggaaaggaaaggagaaggaaaggaaaggaaaggaaaggaaaggaaaggaaaggaaaggaaaggaaaggagaaggagaaggaaagaaaaggaaaggaaaggaagggaagggaaaaggaaaggaaaggaagggaaaaggaaaggaagggaaaggaaaggaaaggaaaggaaggaaagggaaaggaaaggaaaggaaaggaaaggaaaggaaaggaaaggaaaggagaaggaggagaaagagaaggaaaggaaaaggaaaggaaaggaagggagaaggaaaggaaaggaaaggaaaggaaaggaaaggaaaggaaaggaaaggaaaggaaaggaaaagaaaggaaaggaaaggaaaggagaaggagaaggaaaggaaaggaaaggaagggagaaggaaaggaaaagaaacgaaaggaaaggaaaggagaaggagaaggaaaggacccattattcctcatccactccataaatagcatggtttccaatcccctcagcaacctacctcagcatgctatctagtttgacaatctcaaagtacactacctagaagagacccaggaatctatgaatgacgtaagcagtatagagtaaaatgctgttatctctatttgtaaaacagaattctacaaataacaatgcattccttatctgtgtggcaatacattgttgttcatatggatctaagttcaagtaaaatcctgtgacactagtctctccaattctttgctctcaaaattaattttaatgtatcaaaaaaaaaaaaaagtcttagttctttggttcaacacataattctacgctccatccaaatcactgataaaaatcttgaagattacaacataatagacatgtgacacagtcttcaaaagatagcctatgagaaaccttgtcaaaggctgacaacacttaaacaatgaaactccatgttatttcattatccatgtaagtttttaatcctgaaatataaatacatacaaataaaataaagaaaaaccacttacttgttccttctataagcagttcttgtccatggctacccaaaagtgtccgagaaagaaaaggtgcaaaatccacaaaaatctcacgaaggagaggagctgccttttccaaagcgtgttcaagcctctctgtaatactaaggaaaagacattaagttacttgaactattcaacagattgtatcaattttctagttttgaaaataaagatgtatttccatatatatatataattatttaaaaaaattaaaaatcacctaaagagacattactgctatgcatagcagtccttctgccaaaaatattcgtttttatcctgatctatcttgcccctacaatctccaacaaacaacctggttaacaaccactccaagcatcagtacttactacaagtctcacctggccagttaagagcagtttgtttttaggcccattataatctaaacaaactctcatcaagtcttcaacaaatttttctatttaccactaaaccattagcacactgagttcaagaaccatgacttcattttaaaattcacagttatagcatatagtatagactcaacagacgttgagtgcttataaattataaaaagcagttcttttttattgaagtcaattattcctttctaatgcaatgtgaatgatttttctcctgaaaataatatactttataggcacattataacaaaactatcatttggttgatagttatatttattaataaactgagatagttgtaaatgtacctataaatatataaaaatatattaatatatatttgtgattatatatacatgtattcatgtatacatacacagatacatttaatgagggttttttttttaaggtccccagcatttcagataattcacagatatccacagctttagtttctaacttacaaattaaacatatacataaagagccactagttatctactattaacactaggagtacttcctattcatactaccaagaagacagttgctactgaaactatcaacacaaacatatataaatttttgctgtgaataaccatctcctcacaggcactgctctaaatactattttcttccacacaactcatagaacttgttatccctgaagagtatcacaaatactagctatactcgaagcactcaagtacctacatttgtagtgtctaatggatttcccaattgtggtaaagaaaatcaaggactctctggacactaagtctccagtggtggaaaatacactcaaagcattcgaaattaaactctgaaacccaattaaacaaggtaagtaacaataaaaatctatctacaattcagtattattgtggctttggctgactggctatcacttatatcagcattttgttgttgttgttgttgttgttgttgttgttgttgagatggagtctcactctgtctcccaggctggagtgcagtggtgcgatctcggctcactgcagcctctgcctcccgggttcaagtgattctcctgcctcagcatcccgagtagctgggactaaaggtgtgcaccaccacacctagctaattttttttaatatttttagtagagatgagttttcaccatgttggccaggctgatcttgaactcctgacttcaagtaatccgcctgcctcagcctctcaaagtgctgggattacaggcgtgagccaccgcacctggcctatatcagtattttatagaggagaaacaacaaattccacactttcaatttgcaatcatttgaaagaaagtcataagcttatgtaaatatttgttatgcatgcagcaattatttttttaccacaaatagtcacttctcatgaagtgacttgtacatcatgaaatgacttgtacatcatcaaatgacttgtacatcttataatctttcaaaagaaaatgaacttctaaaatgttcccaagcctctaaatgtcatatatgttgaaagaaagaaatgaaatgaaatgaaatgaaacgaagtaaaataaacctagatagcttaaaaagtcatcaaaaggtataaatcacaatattcaagttagtagcttaaatacctcatatttgaaaccggatcttgtgaaactgaatcaactgttggaactgagggcaattttgcattagatgatctactgcctataaaagaaaaataaccatctataggaattttctgcttttagatatgaagatttaaataaaaagaatgtcattataccagtcaataaaagcattataacgtatttttatgtccattactatttggataacattaaaatctaacaattaacaactaaatgctttcatatataaacctcagctacaagctcaattatcatgccagagcaatctttctatccatgagctgaagaagcaagagaaaagtaaattctgactccctaaataaggttcacaattccttctactcaacaccaagtgtcaacagaaagttacaagtaaaagcattttcttaacatagcaaaaacacagaaacagctacattccaaatttagctttaaacctccattaccatgaaaactatccgtattcagttatcaaatcactactaaaggactaaattgtagcaataaatgtaatcagggttagaagcctagatctctgagaatctgtaatcttgtatcacaactattatcagttattttccccttatgccccaaatacaaaaacactatgctttaaagagaataagggccctctttcccaaagattgttgaatctttcagtccaaaagtgattagaaacacatcaaggaaagcatctgcatcaggctggaggttgtgttggcccagagaaagttattggagccagtgtgaggaggaaatccaaggaaaagagaaaactgagaattgtagaattcatatctatatgaattcatggttccaataaaggatggaaataatatgtgaatgacagtatatatttttatagacttttatatacaaacatacacacacacaaacacacacactgcctctagctctgtccactaagaggacacggaagcagcagcatcttaacacttggtgtccagatcttggtttctaaatactatactccactaaaagaaagaaatggctgattcaagatctgtgtaagaaaagcacaaaatgagtttgaaacatctagttatgctttgtagaaagcaaggaatgataagatatatacaaggaataaggttatgtcaaaggacaatgaagccagcttgaaggggctcccactgatcaaataccattgtactccatcctgggtaagaaagtgaaactccgtctcaaaaaaaagaattgccatttttggccaggtgcagtggctcacgccagtaatcccaacactttgggaggccaagacaggaggactgcttgagctcaggagttcaagattagcctgtgaaacacagcaatgcccgtctctactaaaaatacaacaaagtggccaggaatggttgtgtgtgcctgtggtcccagctaggtcccagctcaaggatcacttgagcctagagggcagaggttgcagtgtgccaagactgcactactgcattctagcctgagtgacaaagcaagaccctgtcttaaaatacgatacgatacgatacgatacgatacgatacgatacgatacgatacgatacgatacgatacgatacgatacgatacgatacttccctctgcttcacaccactcccagaacttcctcaagctcacttcaattgtatctaggaattctgattcaatgtgctctttttggtaaggcaaataaggttaattctggatatagataagcatagccaggacctaatcagaagatttgtggatataactgaataaaaaacagcaaggatctgaggcaattttgaactttcctgaaacatgcttggtttttaggcagtacttgatcaataaccctcagttctgattaccaggtctcagtcaaatctaaggatccaaaaatctagacaatttggccccccaacaagcttggttccttttggaaagcaggcaatgcagcaatcttccacaattaacctctggataattactgagcccaccccttagagtgagcacatacctagtacaaaatgaacttaactgtagttaatctttcttttccacaacatatttcctttcccattcccttgataatcaaagttgactttcctttatataccggaagttttgtattgcttacagtcctgccttcctcaccatcctgctcaactgagatctaactgtacctaaaaactctaaccaagtgactgttggtcaggacgcataggattcgtttaaaaatgaagctaaagcacacacttcatcatgctgacaattattttttatttttctttttttgagagagggtcttgctctctcacccaggctggagtgcagtggtgtgatcagagctcactgcagccttgaactcctggactcaagccgtcttcctgcctcagcctcccaagtagctgggaatataggtggatgccaccacacctggctattttctattttttttgtagagacagggtctcattatgttgcccaggcgggtctcgaactcttggtctcaagcaatcctttggccttggcctcccaaagtgcgagggttataggtgtgagtcaccatgcccagcccattgtgacaatttttaaaagcataaatatcaattcacatttcatcataaaaatattgctatttttgtgtttttcacaataaaatttcaaattagagggcaagaccagggaagttcaaaaacattttttcaccctttggtatctggcacttctaagagtcaggtccaatcctaaaatcatatacaacactcagtaaagtacttcacagacccaatggctttattaaactcagtaaatgacacctgcaattttctaagttcttgacaactatatgatcactgaatcacagtgggtcattgactgttaccagtgattaattaaatagttctgttttcttaattggtgatagtttttgaagaccatttttattgcaatgtatcagacattttctctattaggattattgatggattttcttgagcttttctgaagctaatacaaaggaacacataaggacccatttacttaaaagtagaaatggaaaaaataaatccctccccagaaaacatatgcatgaggctttaggaaaaaaaaaaaaagggggtgtgcatgaggctttaggcaaaattagtctttactgtgttaactggtttattgggttttttgttttttgttttaagagacgaggtcttgctctattgcccaggctggagtgtactggtgtgatcatagctcaccacagccctgagttcctggactcaagtaatcctcctgtctcagccttctgagtaggtgagattacaggcatgtaccaccacgttcagctaattttttttaatttcttgtagagataaggtctcactttgttgtccaggctagtcttgaactcctggcttcaggtgattcttccaccccagcctctcaaagtgctgggactacaggtgtaaatcaccacaccctgcccactgtgctaaatgatactaattttaatgagaaatgcatattagaaatgtgaaaaagaaaagcaacattgttacttctaaataaagcagtaacaaaaattatttcctcacactaccctagaagtaatgccaattttcaattctaaaagagaatatagcagaaagagattttttacagtgtcttaagtcataagaagacactttaccaacacggataataaattaaccagcaatagttataagaaaaaaatcacatgaaagaataaactaaatacaccagtaatttcacactaggttgtcctccattcctgctgtggaaaaaaatgtaatatccaaacacattctgtattttttcaactcaggtaaaaatataaactttcaatcaatttgttttaaattatcattaaatatttccagcaaatgatcacaaatacataaatgcagaagctacctcctacatgtggaatgatactcacttatcttttccttatcctagcactgataaactggctccttctaactgacagttttccagacattcaaaagaacaaaaaggaaaatgcaaatatatcatctgtctagcatctatctggggagtaggcaattgtttatttaaggtccctgcgggtctaaataactaatgtcccttgcaataaagaatcattaaaacaaatgccaatttttaacccctaaacactttagcactgcatttctctctctcttttctgaaccagttaattcagcctgggatagtctacatgcccagtaaaaactaattaaacaaatcctattgaatgaataaaaataagcctattggcctaaatcttacacaaagcaaagatggttatgactcaaatatttccctaatattaaaaaagtactaattaataatgtatatggctctgataaacagatactgtctaatattctagtaagtggtagaattactaaattttgcaaaatagcaaacaccaggcatataaattagtgaacagtatacttagttccactattgagctagtttcaattttgatttattcatttatgctttgcaatatagagaaacagcatattggaaaaagaataatgatattttaacatacaagaagggatatgggtgaaagtggaaggatcacttgaagccaggacttcaaggcttgtctgggcaatagaacaagactctgtctctacaaaaattttaaaattagccaggaatggtgacacacacctgtagttctggctacttgggaagctgaagcaggaggatcactcaagcccaggagttcaaggctgcagttgagctatgattgtgccactgcactccagcctgggaaacaaagacagaccctgtctcaattaaaaaaaaaaaaaaagaaagaaagaaagaaagaaaagaaaaaagaaaggatactgtattctaggtaatcagatctttgctgatgactataaaatttctagattttgatatatttactaaaatcactttcgcttttctttgaaaacatgcatatacaaggatatgccttatcctctgatgaatatcttttaatacttattaattagaagatacaattgttgctcttagactagtccttttggttgataaaatgctgcataagctaaggtatactattcaaattaaaatttgaaatttgaaatttgtacaccaaaaaagttttgtatgttaattacagtcttaataatgtatactatttcaaaatgcaaacaaattctcaatttttatgggttataaaatttttcagtgataatattttcatagaaaaagcttggacctcatataaagctggcaagttttaactctgtttctgtgattattatctatctagtactagtttctctttaattgtaccacatgtaaaatgtgtctcattttgatatcaaaatttccaaatatccacaaatgggaatttccttgaagatatcatgtgaatatataacagaaaatatgaatgtcacagaagaaacttcatattttctatcaagtaaattttttgcccaactgtaggataatgtaagtgttctgagcacatttaagatagggtagattaagctatgttgtttggtaagttaggtgcattaaatgcattttcaattttcaatattttcaccttacaatggtttatcatgatgtaaccccatcataagtcaaggagcatctatattctaagtcacaaatgcatttaacagagcctattttataagaaggtattggatatatcacataatttactaaatattgtattgaaagtgaaaaatagaatggtcatacggatacttgaggtacagtttttactgaatgtgtattgctttcacaccattataaagtcaaaaaattgttaagatggaaccatctatatatttatctacttattttaatggcagataacttaaatcgagagacccaccaaaaagaaaacaaaaatttaacagttaaaaaaatactgacaagggaaagagaactatttgggaggttggggtagtttccatgtgaaaatgagtactaacaagtacaagggcaagtatagtaggcaaaagcatgtaaagtggggcggcagaagagtaagaagcaggacaaccaaaaacactagattaggttagatttttcttatcaaggcagtaatgttcatggcatcaattaacggaataaaatagaagcaatacactgaaatagagaacccatatgacagtaacaagaacacagtgaaagaggaaaaagaagagtcagatgtggaaaccaaaacaaatggtaaacagaaagaccatcatcacaaggaagacttgaaataactgaaaaagcaataactgtttttttaaaaatggggggggctaaggaggggaaaaaagtttaaaattctagctcaagatggaaaaaaaaattggtaactatttgagaaactccatcacaaattatacaaaatttaaacaatagaaaaataagatacattatgagctggatcaatggtatagggttttgtagattttgccaataaatgtaacagtcttcaagatagcaaattgttttataattctgcatacagtttttcaaagtgaatattttaaattacaatgaatttattggaaaaaatacaatggtttcagagagaaatgtataatactgttacatgtaaaatattacccatatgtctcagctgtttcttatctcttctgaaaactccaagacttaaattttaaagaatagacttaaaagcaatcaaagggtcctatttcctctgttcctaaactgaaactagagggcagtataagaaaatattttactcaatgtactttgaatttctgaaactacatttgattttggatgttaatgaaaaatttactatacctgaatttaaaagacggcaggtaaatcatttcatagatattaataactattgcatttttcacaaaagggactactctagaaaaaccacagttgattctttttttttaaaggactttggatgggggtggagaagcggaaatgtgcatacccagctccaaatgaattaccaaattatttcttctccaaaggaaaaaaaaaaaagaggcatcagagtataatggaacaataaagatgaaaaatttgctagagtttcatgcccattttcctttgtaattctcactgggccaggggaaaccagcgagggagagaatgacagggtatttgagaattctctgtacttcaaactcaattttcctgtaaacttaaaactgatctaaaaaataaagtctattaatttttggaaaaaattataaaataaaaagcaaggcagacaaaactctgctaccatcgcagcttttggtttcaaactagaaaaaaaattctaatcactatttttcctaagaataaaaataatacaagactattaattaaatgttagaaatgccacctaaagtaaatttcgaaaatcaaaattgccagtagcccaacttcatggagatccaaatgacttcataatacactttcttgcttttaccatgtaaagaaggtagataagtcacttggttgtaattatacagtacgtaaagaattgcatataactttcttttacttaacctactggaacattttctctattcactaaatactataaaatttgtaaaaaaattaaatacatttaaaacttcttataaaatgtatttttgttaacacaagcacaataacaaataaaagagaagacaaaagaaataaacatagtatttgtttctaggatacatgattacatagtacacatcaaggaaaaaaattcccagctactggccagtagcaatatcaagtttggaacaaaactctccaagatatgctaatttgccaaataaaggtggaacagcagaatagaaggcaaaccctggcctgagatatcccaaaagaagtaacggcattatttctgatctcaatataatccaccaggccattccttcaaaattcctttattttccgtcaatctcaacctagaatcataagatgagtgttttggtaggtacaatatcttgttattaactttaagaaacagcaaaatatccagaagaaaaccactgatacagtaacatcccttttgttatacttggtcattttaatactgcacattcttcacattattcaagtttacccagtatcaccattaagcttcccatcaatgtataggatcttgcatccatatatatgcttttatacatggaaataattttttatccatatatatgcttttaaacatggaaagaatgtagaaggagagatggacaaaaataaaagtgctataggaggaaatgaaccagtatgaccattgttagaatgatgctacacttcagagcagcattcctttccaagcctctaattcaaaaaaatatgccaaaaaaaacaaagtattggacactatataaatattttttttttgtacagtccaaaatatttgacaaccagtaaccacattaaaagattacatgtcaacaagactttcttatttaggccactatctatatacatcttcttaagtgcagggaaagaaaataaaggaaaaaaatatttttatgaatctatcattcatccatgcactcatctacccaactagcagcatctaatctaccacacactactaggtttgagtggagaaaatagtgaaatccttgacttaatttcttttaattttactcaaatttattcagaaaagtagtaaacaatcaacagtataaaagtacaatggtttctaatgtgcccccaaattttaagttaatcaaaaatcttaagcgttgctaaaatgagatctaaaaacatttttgttgaaatcactgataactaactcacctggtgattctcctcccatatctgaggcttgggctgaatctactgaggaaaccacactgacagcattggtaggtatgcttgtattaaaggtggaaggtgagactgctgacttttttgctgcaacaatgacacttctgtaataaagaaagtaaacagactgaaagatacaaattgatctcttgaattaattacatgaatttcaaaacagaaactaggtagctaacttatttttctaattttctttcttatttctatttgatgtacaatttagacttttcacccaacatgaaatatcttcaatactgtccatatttatctgcatttcactatgaaaatataataatctatttaacatttaagcttatatttaccacatagtatttttaaaatttaggatcatcttaattatctaacaaataaaatataaccaaaagtattaaagcagaaaattcaacgtttccacaagaattgtaaagcactgctaatctgaaataataaaaccttagaaatcttataagcttaaaaaaaaaaagcagatataagcaatttgctaacatgtatacaacccagtttttcatttttaaaccccaaagactatatcttttgataatatataaaaaagcaatgcataggaataaaaaccatacgcaaaaatatcaaatagtcaaagttctttatcttgtatattattcaaacacaggtatttatgatataccaatttcaattaaaatgtaatactttataccaaacagtaagtaaaagaccttgttaggcataacttaaaaggcatttttaattgaagttggctccataaacatgcaaaaactcagttaatgaggtaaagaggacagctgatatataatgcactcccacagcagtgcttacttttaattacctggtgttaaccataagcccaaagtcttcaacattcaatttatttaatcacatcttttgttgacagtactataactgcgagcttcaagtattcccttaatagctttaaagtattcagcttctaaacaaagtaacttaggtatttgatccctatacatgcattcaaaagtgaaaattatgtaattccaatattttaataatacatttttgtagttatttttaaaaacacacacacaaagcaaaataggtttcgttttacctcagtgcctatcatgtgagggcaaacactgttgccaattaaatcaaggtctcttgtgctaggcatggcttattcaatgtacttcagggtagctggtgtcacatcattataagggtgactgccaatgttaactatacactaaaaaatagaagcaacagccacctgagcccccaatccaaaatggtgtgcttaaatcacagcagcttatatcagatgaagattattgacttaagggggagtagatatgacgaatgtctgtgtgtgtgtgtgtgtgtgtgtgtgtgtgtgcgtgcacgaatgtgtgtgtgtacgtatgtattagtggtaccttcaaaaacaacgcaaaatgtaatttttgtatttcctactggagggagaaatttaaaacccattgcttaagaaaatcactgtcttctaccaatgtttttgcaggggagggaggagaaatatgaagaatttactttcacatttgttcacaaaagaaagaaccagcaagatctagtttactcatactgtaagtagggactgaattgagcaatagaaaagaatacttagaaaagtgcaattgctttttctataatcaaaatgtaagatatatacccatctatgctatgactcaacaattccacttctaggaatttcctcaagaaagcttatgtccacaaaacatgtatacagtaatggtcatacaggctttatttataatagtcaaaaactggaaatagcccaaatgtcctttatgcagatatagtaaatttttaatggtgctatgcttctagaatggaatattattcagcaataaaaggtaacaaactactgatgaatgaaatgaaaaggtaacaaacaacatggatgaatctcaaaagcattatgttgaatgaagtcttatactaaggagtatatactttatgggttttttttttttaacatgcatgtctagaacagacaaaactaatttatggtagaaaaaaatcagaataattgcctctgggggataggaacaggaattggctgggaaagagaactttcaagaccaatgatatcatgatggggacttaaggttacacaagtgtataaatttgtcaaaactcatcaaatggtacacttaagacctgtgtctttcattgtatgtaaattttagctcaaaaaaaaaaactgtattcatctccagttagagagctgcatgctggctgaaatatttaagagtgaagtgaactgatgtctacaactttgaagtacattacaaaaataagattgattgatggatacatggtgaagcaaacagagctaaaagctaattgttgaatctcagtgatgggtctacaggtgttcactgtgcaattctttcaacttttctgtatgcctgaacattttcataataaaacactggaaaactggtaacagaacagaatttactacagctgttccaaatatgcacaatccctatttattcaagatgacatagctaattaaacacaacaaaagaactcaacttcatttctaatcctctagcctcttgctgttaatgtttcagtcacaaataagatcttattcttttattcagttcagtaaatatttattgtccaagatctttcacctattgtcaggaatgatagatcagaagtacggctttctacatgaatttacattttacatgttcctcacacacttcttcaacatgctcttatggttgctaagcgtgttgtgtcatttcacaactccaacccttcgtatatatgcctcctctgccaagatgctttcttcttaatcctgcttgcttgttaggtaatataaaattataaattctaatagcagctaagataaatgcactgacaatatgccaacaattattattcaattctcaaaacaatcctaaggtacatattaattcaatttttagaaattttaaataaaaacctcagaaaggtaaagtaataaccaaagtaaatggtagaactaccatggaaatctaggtttatctaacagcagagccttgaatttgaaccgtttccccatgttgacctttcttaaaacttcagagatataattcacataccatttaattcactaaaaatatacagttaagagatttttggtatgctcacaaagttgtatatttatcaccacaatcatattaacatttaaacataattttagaatcatctataatcaacagcaataaagatctctaacatataaaattatttatatactaccataaaatcacaaaaatacatctgctcataaatttttaaaagctgaattatttcatatagctacataattagtatataatagagaaataaaatcaatttccaaattcgctgactgattcaaatcaattctaaggaattaacataacattgcttcagcttaaggctacacaaaatcaaagaaaaatcaaagttacaatgatccaattaaaaggacactaagcagtaggtagattttgaaatattttcattgtctttaccaatcattgtcattattactataaagtttcagtgtaaaagactaaaatcttcaacagagatctttaacctatcgtgtttatgttgttaaatataagtataaatctaaattagtaaagcatgttccacagttaacaaaaataatctagaattttaaacttaccaatagttaagattgatcatgcaaaaactaagcatttaatattacctttttatacaatgcattggaaaacacagaggaaaatgcaatatgcatttgacaaaactgagactttacatgacagacaatgtgctagggatatttctggcatctttctcaggctacagcttaagtttctatttaagaaacaaattgaaatcttttttaatgtttaagaacaattattggaactttttatatctacatcaattttagcagaaagtgcttcaaactttttagcataaggaatctgaaagatagacaaccaattatgcaagctggtttcccaaattgtcaattataaaccaaatattaaaagagataaaaattgttcttattatcatttttttctttatgaactcactatgaatacttaatatttgtggggcaccgtgcttaagaacatacacaaattatcatatttaatttatgacaacccttgagattagtagtacatattattatgctaattttacaaatgagaaagaagtaattttcctaaagtaccacacagaacaaatgaaaatactgttgctggattttttttttcccctgaacaagggatactcatttcaaagtttcttttaatttactggcaataggcaaatagcaacaatgccttcccgatcaataaagttgagaacttccatttcagtattatatcagtttcaaatatcacaaaccctcacacaaatgctattttacttaacatgcaaatagttcactaaaggaaaaaagagcatttcagcctaccacttcagtccctaaggatccagttgaaaagccaaaccagtccttgaactttatcaagataaatccctggcattcactaatcatcagagaggatcttcaaattagataagaacaagaattttggcatgggaatgaacacaaacacctttgcattcacaaaggcccacaacctggcagcctttcagcaaggttttattcatgtagctgttactctaaactttccagctattccttggaagttgataatacttaagatatgaggagagttgtgatttctgacatagcattcctgagataaatacatgatcagagggatgctttgaaattcccaaagatattccactagcccaaggcagcatgaaagtttttacaaaggggtctctaaataagaaaaaaaaagagggtaaaaaacagagcagtttccttgccatcagagactgttaaatgaatactagacatgttaaattctacagaacatcctggaaaatgctaccatcaaaattatctgttgttttctatttcaataaaccccttaaaatgtattacacctaagcatgatttcctaaatatgttcatgatctactcactgaagacatcagtaaggcacaaatttaatttctacactattttaaaaagaaataaatgctaaaatacataaaattttgatcattagtaaacaatgtaactatattaacatatattaaatttaaaagtatagcctcacatatttctgggtactcaatctaacactaacaaatctaaataaattataaaaattgagaatagacagggcacagtggctcacgcctggaatcccaatgctttgggaggacaatgcagcaggatcgcttgaggtcaggagttcagcaccagcctgggcaacagagcaacacctcatctctacaaaaaattttttaaatagctggacatgttggtcccagctactcaggggactgaggaagaacgatcccttgatcccatgagtttgaggctgcagtgagctatgactgccactgcactccagcctgggtggcagagcaagacaccgtctcaaaaataaaataaataaataaaaattgaagccaggcgcagtggctgatgcctgtaatctcaacactttggatcacttgaggccaggagtttgagaccagcctggccaacatggtgaaacctcatctctactaaaaatacaaagactagctgggcatggtggcacacatcagtaatcacagcttaaaccggtaagcacagtgttataaacacaaactagttctatttttagttgcctcgggaacctccaaactgtttcccatagtggttgtagtaattacactcccaccaacagtatatgaaggttcccttatctccacatccttgccaacatttgttactgcttatcttttggatataagcgattttaactggagtgagatgatatctcattgttttgatttgcatttttctgatcaatgatgttgagcatcttgtcataaaatcatttgacatttctatgtcttctttgagaaatgtctattgagatctttagcccattttaaggttatcatttcgtttaaaatgtagtaatatttttaaattattattaatacatttcttcctatagagttggttgagtcccttatatattctgattattagaacccttgtcagttaaccagaattataagtttattatataatccccagtctgtgggttgtctcttcaatttgttgattgttttctctgctatgcataagttctgtagcttgatgtgatctcatctgtccatgtttgctttgactgcctgtgcttttggggtattactcgagaaatctccccagattaatgtcctggagagtttttccaatgattttttttcagtagtttcatagtttcaggtcatagatttaagtctttaatccattttgaactgatttttgtatatagtaagagataaaggtattcattcttctgcatatggatatacactttactcagtaccactgagaagactgtcctttccccattgcatgttcttggcacctttgtcaaaaatgagttcacttgtagacgtgtggatttatttgagttctctattctattccattggtctatgtatctgtttttatgacagtatcatgctgttttggttaccatagctctgtagtataatttgaagttttgttctctttgctcaggatagctttggctattctgagtctctgtggttccatatagtttctaggaatattttttctatttctgtgaagaatgtcactggtattttgatatggattgcactgaatctgtagattgctttgggtagcatgaacattttaacactattaattcttccaatccatgaatatgaaatatctttcattttgggggtcctttttagtttttgcatcaatgttttatagttgtcactgagggatctttcacttctttggctgtttattcctaggtattttacttatagctattgtaaattggattactttcttgatctctttttcagattgttcactgttagcatatagaaatgatactaatttttgtatgctaatttttgtcatgcaactgtactgaatttatcagttataatagttttttatggactctttaggtttttctaaatactctaaatacaagatcatatcatctgcaaacaactgacatcttcctttccaatttaaatgccatttctttctcttgtctgattgctttacctaggacctccagtactgtgttgagtaacagtaatgaaagtgggcatcgttgtctcattccagattttagagaaaaggctttcagtttttctctgttccatatgatactagctgtggatctgttctttatggctttttattgtgttatgttccctctatatgcagttttttaagggtttttatcatgaaggaatagtgaattttatcaaatgcttttcagcagcaattgaaatgatcatatggcttttgtcttccatcctgttgatatgatgtatcacactgatagtttgtgtatgctcagacattcttgcatccccagaataaatcccactcattatgcatcaatttttaaaaagtttctttgagacaagttctccctctgtcacccaggctggagtgcagtggcatgaacacagctcactgtagtgtcaaactcctgggctccagtgatcctcccgcctcagcctcctgagtagctgagactacaggcacacatcaccatgcccagctaatctttttgttttaaaatctcaccgtgttgcccaggctagtctcaaattcctggactcaagcaatcctcccacctcagcccacaaaatgctggaattgcaggtgtgagtcactgcacccagacaaaaaaaaaaaattcataaaatgaaaaatctcagaagacacaaaaataagttaaaatatatcaaaacttacaaacacaaacacttagaaatagtacatggtaccatctacagttaaaagaaatgtaaacaatgtaaatttcaattattaaagcataactgtataaaattaacattaatgcatactgtactactgtaataatttcatagctacttcctgccacaattgcattgagcattggtattgttagcatcacttaaaatgctgtgtgacactagtcatctcagagcacgcagttcatctctttttatggggcagggggggaaggagttttgctcttgttgcccaggctggagtgcaatgctgcagttttggctcactgcaacctccacctcccaggttcaagcgattctcctgcctctgcctcccaaatagctgggattacaggcacccgccaccacgcgtagataatttttttgtatttttagtagaggtggggtttcaccatgttggccgggctggtcttgaactgctgatctcaaatgatccacccgcctcagcctcccaaagtactgggaagtttgtctctccagtaaactgtgtatcacggtaaaagtgctctctcccagttctcatatatttttcatcatgtttactgcaatattataaacctttgataacataatgggacccatacaaagtgccactagcaatactggacatgctcccaagcagcagggaaaagtcatgacattataagaaaaagttgaattgcttgatatgtactgtagattgaggtctgtagctatggttgcctgccatttccaaagaaattaatcccgcataagaactattgtaaagaaaaggaagttggcaaagttgtcactgcagtgacaccaggaggcaaaaaaacaaacaaacaaaaaaacaaaacaaaaaaaacttgcactttttgtgaaatatctttatcttgcactgaaaatgcagcttttatgtgggtacaggattgttataagaaaggcatacctatagactctaacatgatttgagaaaaactgaagtcattatatgtcaaatttaagtaaaaaagaatctaaggctagatttaatgccagcaaaggatgatcaagataacaggagaagcagcttctgccaaccaagaggcaacagatgagttcctagacatcaagaaaatcatttagaagaaaggaccagcccagtcaggtttttaatgcagacaaacgtaacctatttgggatgggggggaagccacaaaggatatttattagcaaggaagagaagtgagcactaggatttatggcaggaagagataggctaactctactgttttgtgcaaatgcagttgggtttatgatcatgactgcccttatctattaatataaagctgctaacccctgagccttgaaaggaaaacacaaacaccagctgcaagtctgttggttgtacaagaaggcctggacaaaaagaatcctttttctggattggttctattgatactttgtccctaaagtcaggaagtaccttatcagtaagagattaacttttaaagttcttttacaattggacaatgctcctgaccacccagagcttcatgagttcaacactgagggtgttgaagtggtctaactgccctcaaacgcaacttctctaattcagcctctagaacaggaggtcacaaggacctttatggttcattacacatggcattcttaggaaacaactgtcaacactatggaagagaacccaacagaacatcgtgaaagtctagaaggattataccactgaggatcactgttacagaaaaagctgtggaaaccatcaagtttgaaacaataaattcctcctagagaagactgtgtttctaggtgttgtgcatgactccacaggatttctgacagaactaatcaaggaaatcatgagagactatagatatgacaaaaaggtgaggggtgaagggtttcaagatatgaatctcagagaaattcaagaactaacagataccacaagaacagaaggatcaacagagggaaaacaatttgacggagacaagaacatccaaaccactattagatgaggaagacatagaagaagcagtaccagaaaatgaactgacattagacaatctggcagaagggttctaatgattcaagactgcttttaacttcttttatgacattcacccttctatgatacaggcactgaaactaaagcaaatggtgaaagaagggtttgtaccacatagaaacatttttagacaaataaaaaagcaaaaaggtcagaaagaaattccagtgcatttctgtaaatttacaccaagtgtgtctgcctctcctgcttcccctttcactttctccaactctgctacctcaactgcccctgagatactaaaatcaacctcttctcttcctcctcctcagcatactcaacatgaagacaagaaagatgaagatctttatgatgattcgcttcacctgatgaacagtaatatatttttttcttccttatgatttctttttttttctttttttttttttagacagagtttcgctcttcttgcccaggctggagtgcaatggtgcgatctcagctcattgcaaccactgcccctcctgggttcaagcgattctcctgcctcagcctctggagtagcctggattacaggcacaccccaccatgcccagctaatttttgtatttttagtagagactgggtttcaccatgttggtcaggctggtctcgaactcctgacctcaggtgatccacacacttcaacctcccaaaatgctgggattacagatgtgagccactgcacctggccttccttatgattttcttaataacatgttctttttttctagcttaccttactgtaagattacagtatataatacatataacaatcaaaatatgtgtgaatcaactgtttatgttatcagtaaagtttctgatcaacataagctattggtagttaagttctgagggagtgaaaagttatatgtggattttcggctacacagggcgtcatcatccctaacccccatgttgttcaagggtcagatgtagaaacataccaaaacgaaaaactattatcagtacctgtcaaaagatctgaactgcacgggttgttccacagatagatcaccaagggctccaaggcaggctggtggcagaagggcaggatccactgtgactccatctgctggtatgttaaccaagcttcggagaatgtctttcacattgacgttttttgaaactgaaactgacggtgtagccttagtgtccaagtcatttcctctatcatttttggtttccggagacttattgacttctaaagaaagagtagatagcacctcgctgattgcatctgggcctgcactgacaccaggaggtgctgtgtgaggagttacttccacatggcttcctaaaccagtggctgtttcttccccaatgcctgagtccctccttcgagcagatgatgtgctttcagattcttccactgatgccgtagttaaagtgctgaatgctgctggtgtgatttctatatcatacccagaaacacaagaaataaacaaacaaaagtttagaactaatttttaaaaggtatattctgttttaatagctatctactgttttgaattatgaaatacatcatgttctaaaaaagcaaaaactaattacgtattctacagaatgtactgagtgggtgcacctattatcaagacagatggtataataaaataaataataaaatacttgcaaaaatgatctaaagtaatgggtagcaacacaaggttgaaagtcattggcctgtaagaaaaagtctataatcttttttgggggtgtgtgtgtgtgtgtgtgtgtgtgtgtgtgtgtgtgtgtgtcagtctgttgcccaggctgaagtgcagtggtgtgacctaggctcactgcagccttgacctcctgggctcaggcgatcctcccacctaagcctctcaagtagctgagactacaggtatgtgctaccacgtctggctaatttttctatttttttgtagagatgaggtttcaccatgttgcccaggctggtctcaaactcctgagctcaagcaatctacctgcctcggcctcccaaagtgctaggattataggcatgcaccaccatgcctggcccaagtccgcaatctttaggataaaataaaaagctctacctcaaacatggttactgcagctggaaaacttgttaccccttctacgtgcataaataattcaatgatccttaaaatccagttcaacaaggaacacctccttttctctcttttaattctcactccctttaatcagggtttcaacccattctagcaaaaatagtcttatcaaggtcaccaaaaaatctgcatcttgctaactccaatggtcagtgttcagtcctaataggacttcacataacagcaacagctgattattccctccaactagacaatgcttcctttcctcggctttcaggacaccattctctttttgttttccttgtactacttcactgactgttccttcttaacatccttcacctctttttctccctgatttcttaagttggagggacacaaggttcagtccttgttcctcttatgttctctgtctgcatttagtcccttcgtggtatcattcattctccaagttttaaataccactatatttccccaccaaaaaactcaaactattaaatataactgctaccctacaacttatcttacatgtctaaaaaaacctctcaaactcaacatgctgaaaactgaatttcttctctttttatctttccctgaaaatctctttcacctttaatctactccactgtaccttgtaatcatttttgactacctttttcattcacaaaatgcacacctaatgttttaaaattctgttttttctaccactaaaacatattcagaatctgactgcctctcaccatctctagttaccaacctaatccaacccaccataacctcttgcctggattactgattactgcaatatcctccttcctaactgttgtggaagagggttgttttaataatcctactgccccatgtctcctggtatgcatcccttgacaagcccttgaatctggactaggcttgactgacaataacccacaggatctggcaaaagcagcagtgggccagtatttggcccacgttttaaggtctggcagctcttgcattcccagaatctctgaacatctctgtaagaagtgtggcttatttctgatctaccttgctggaaagaacatgtagagagacgatatggagacagagatgctctccaaactaatgaaggaaaccaggaactcagttgagaacaagtatcaaggctgcagacacacaaccccagctcagctgttttagtcagtcagtctcagctcttggagccatcccacctgaggcactatatatactattagaaaagtcatcttagattttccagacccagcaaacatcatctgaaacagggataaaccatgcccaccgtgccctatccaaatctaactcaagaaatcatgaaggaaagattaaaatggttatggtcttaggacactaagtgcagggtaaggtattaaacagcagtacccagccaaaaacactgattatccttgccctctacgctatatcctctacacagaatacagagttacttttttttttttttttttttttggaaacggagtctcactctgtcacccaggctggagttgttgtggtgggatctctgctcactgcaacctctgcctcccaagttcaagcgattctcctgcctcagcttcctaagtagctgggattacaggcacccaccaccatgcctggctaattttttgtatttttagtagagatagggttttaccatgttggccaggatggtctccaactcctgacctcaagtgatccagctgcctcggcttcccaaagtgctgggattactggcgtgaactaccaagcccagcccagaggtactttttaaaacataaattgtaactcctgtactcaagaccctccaatgagttctcatttccctcaaagagaaatccatacccaattactcctggtcattcctgatatttttaccatctttattactttctttttttttttttttagcactttcaccaccttctaaaatactacacaatctacttatagcatgtagatattttctatctcctcccattagaatataagctccataaggaaacagattttttgttttgttttagtcatgaatatatacccaagtatccagtagatattgaatgaatatcgagtgaataataaattgcctcctttgggtggtagctacttctataattgcaacagctacttaactaactatacttttataactggaagctacttttaatactccaattattgcagttacttgttaacaagtctgtctcttagaatatgagttagtgattcttcacagcaaatgaagtcaataaaatttttcaactctttttgtataacattttctgacttacatttaattagttcatttaaagaacaaaaaatatcccaattgcaattaattacattatatttaagccacaacttttagttaataataaaaatatatgtatgctctcccttaatttgcacagaaatggatttaaattccaatatcaatattttaaccatcaaaagtaagtaacatttatttgaactttggtacaaaggaatagaaaatgcaaacttaccagagagtgatacattctcattttcactgccagtttctgtacatgactggctatgcctttcattttggggttccaaaatgtctctgtacttggagaccataagaacagagataaagtatactactgccaaggctaaaaattgagcttgtttgctatcctcctgggaaaaaaaattaaaggagttgattatgtaaccataaaataacatcattatattttacatcacaatgtttaaatacaaaacatgttcacaaatctttcaatatacacagaaaatacattacctacgtaaataataaatttattaataaacttacttgagcaaacattaggcaaagactcttagaaaaatgtctttaaatgagaagctttatacttgcaaaacatggaaagagagaagttagctcatttttttaaattattcaatctaaagacgtatgtcctaatatacattataatgttaatcaaacaaacagtaattataattatatgaaaacaggtcagatgcagtggctcacacctgtaatcccagtactttgggggccaaaccaggcggatcacttgaggtcaggaatttgagaccagcctggccaacatagtgaaaccccatctctactaaaaatacaaaaattagccaggtgtggtggcacatgcctgtaatcccagctactcaggagcctgaggtgggagaatggcttgaacccaggaggcagaggttgcagtgagctgagatcgcatcactgcactcaagcctgggcgacagagtgagtgagactctatctcaatcaagcaatcaatcaataaataaataaacaatgatatgaggataactggttatttttatctgtaatcataaaaactaaaatacataaaatatcacaataaaagtgccaaaaaataaacatgcagaagaaaaaaactgaagctattagatacagaataggatgccaaaggaattccttcttttttttgagacagggccccactccattgctcaggctggagtacaatgacacaatcatagctcactgtacccttgaactcccatgctcaagagatcttcctgcctcagcctcacaagtagctaggactacaagaatacaccaccacatccagctaatttttgttttttaatttcttgaagagacagggtcttgttatgtagctcaggctggtctcgaactcttggcctcgagcaatcctcctgccttagcctcccaaagcactgggattataggtgtgagctcccacacctgaccacaaaggaattcttgagagtatttaaaatagtacaaacaattatatatcaagatttaaaaaaaaaggatctatgagaaagaagacaaactagactgacctcttgaagggcctaggctccattctagctctacaggtcacctatatatcactgacctctttatcttgtcaaattccccatcttcaaggagaacctacacacaccactattctactaactttcccaaatatgtttgaacttgttaatttaaagaaaaaactcaaatttatctatcaaattctgaaaaccaaaggctcaagcagaaggtaaatttaaaataagaacatgaagaacactgttccctatcagataaatccaggcataccatggagataccacaggtttagttccggaccactgcaataaagtggctatcacaataaagtgagtcacacaaatattttagtttccgagtgtatataaaagttacgtttacactatactgtaatctattaattgtacaacagcattgtatctaaaaaaaacgcacataatttaaaaatattttatagcttaaaaatgctaacaattatctgaactttcagtgagtcacaatctttttgctagtggaaggttgcatctccacattcatggatgtcgactgatgggtgagggtggtaactgtagcaatctcttaaaataagacaagaaactttgccacattaactgaatctttctttcacaaaagatttttctgtagcaagcaacgctgtttcatagcattttactcacaggattggagtcattcctctgaaaccctacaaaggttttatcaaatacatttaggtaatattctaaatcctttgttatcatttcaacaatgttcacagtatcttcatcatgaatggattccattgtaggaaaccaatttctttgattatccataggaagcaactcttcattcgttggagtattatcatgacattgtaggaattcaatcacatgtttaggctctgcttctcattctgattctcttgctatttccaccacatcagcagtgacttcctccatggaaatcatgaactcctaaaagtcatccatgagaattgtaatcaatttcttccaaactcctattaacattgatatgttgatttcttcccatgaatcacatgggtacttcatggtatctacaatagtgaatcaattccagaagattttccatttactttgcccagatccatcaaaggaattactatctatagcagctacagcctgataaaatgtatgtcttaaataataagaagtatttcttaaatagtaagtcaaaatgactcttaatccatgaactgcagaatgaatatttcactaaaaagcatgaaaataacatgaatctccttgtatatctgatcagagctgttgggtgaccaggttgattatcaatgagcagtaataatttgaaaagactcttttcttctgaacagcaggtctcactagtggccttaaaacattcagtaagccatgtcgtaagcagatgcgctcttatctaggctttgtccttccttttatagagcacaggcagagtagatttataataattcttaagggtccgaggattttcagaatgataattgtgcattggctttaacttaaagtcaccagctgtattagtccctaacaagagaatcagcctgtcctttgtaacactgaagccaggcattgacttcctggtagctaggaacattgtaggatggtatcttcttccaataaaaggtgttttggcttttgttgccattgcttttggtgttttagacatgaagtccttgcccatgcctgtgtcctgaatggtactgcctaggttttcttctagggtttttatggttttaggtcttacatttaagtctttgatccatcttgaattaatgcttgtataaggtgtaaggaagggatccagtttcagctttctacatatggctagctagttttcccagcaccatttattaaatagggaatcctttccccatttcttgtttttgtcaggtttgtcgaagatcagatagttgtagatgtgtggtgttatttctgaggcctctgttctgttccgttggtctatatctctgttttcataccagtaccatgctgttttggttactgtagccttatagtatagcttgaagtcaggtagtgtgatgcctccagctttgttcttttggcttaagattacattggaaatgcaggctcttttttggttccatatgaactttaaagtagttttatccaattctgtgaagaaagtcattggtagcctgatggggatggcaatgaatctataaattaccttgggcagtatggccattttcatgatattgattcttcctatccatgagcatggaatgtttttccatttgtttgtgtcctcttttatttcgctgagcagtgatttgtagttctccttgaagaggtccttcacatctcttgtaagttggattcctaggtattttattttttttgaagcaattgtgaatgggagttcactcatgatttggctgtttgtctgttattggtgtataggaatgtttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttctttctttctcctgacggattgccctggccagaacttccaacactatgttgaataagagtggtgagagagggcatcgctttcttgtgccagttttcaaagggaatgcttccagttttgcccattcagtatgatattggctgtgagtttgtcataaatagctcttattattttgagatacgtcccatcaatacctaatttatacagagtttttagcatgaagcgctgttgaattttgtcaatggccttttctgcatctattgagacaatcacgtagtttttgtcgttggttctgtttatatgctggattacgtttattgatttccatatgttgaaccagccttgcatcccagggatgaagcccacttgatcatggtggataagctttttgatgtgctgctggattcggtttgccagtattttagtgaggatttttgcatcgatgttcatcagggatattggtctaaaattctctttttttgttgtgtctctgccaggctttggtaacaggatgatgctggcctcataaaatgagttagggaggattccctctttttctattgattggaatagtttcagaaggaatggtaccagctcctccttgcacctcgggtggaattcagctgtgaatccatctggtcctggactttttttggttgttaggctattaattattgcctcaatttcagagcctgctattggtctcttcagggattcaacttcttcctggtttagtcttgggagggtgtccaggaatttatccatttcttctagattttctaatttatttgcatagaggtgtttatagtattctctgatggtaatttgtatttctgtgggattggtggtgatatcccctttatcattttatattgagtcattcgattcttctctcttttcttctttattagtcttgctagtggcctatcaattttgttgatctttccaaaaaaccagctcctggattcattgattttttgaagggttttttgtgtctctatctccttcagttctactctgatcttagttatttcttgccttctgctagcttttgaatctgtttgctcttgcttctctaattattttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatgtacccagtagtcattcaggagcaggttgctcagtttccatgtagttgagtggttttgagtgagtttcttaatcctgagttctagtttgattgcactgtggtcggagagatggtttgttataatttctgttcttttacatttgctgaggagtgctttacttccaactatgtggtcaattttggaataagtgcgacgtggtgctgagaagaatgattattctgttgatttggggtggagagttctgtagatgtctattaggtccacttggtgcagagctgagttcaattcctgggtatccttgttaaccttctgtctcgttgatctgtctaatgttgacggtggggtgtgaaagtctcccattattattgtgtgggagtctaagtctctttctaggtctctaaggacttgctttatgaacctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatctctttattttcagcctatgtgtgtctctgcatgtgagatgggtctcctgaatacagcacactgatgggtcttgactctttacccaatttgccagtctgtgtcttttaattggagcatttagcccatttacatttaaagttaatattgttatgtgtgaatttgatcctgtcattatgatgttagctggttattttgctcattagttgatgcagtttcttcctagcatcgatggtctttacaatttggcatgtttttgcagtggctggtactggttgttcctttccatgtttagtgcttccttcaggagctcttgtagggcaggcctggtggtgacaaatctctcagcatttacttgtctgtaaaggattttatttctccttcacttatgaagcttagtttggctggatatgaaattctgggttgaaaattcgtttctttaagaatgttgaatattggcccccactctcttctggcttgtagagtttctgccaagagatccgctcttagtctgatgagcttccctttgtgggtaacccgatctttctctctggctgcccttaacattttttccttcatttcaactttggtgaatttcacaattatgtgtcttggagttgctcttctcgaggagtatgtttgtgatgttctctgtatttccttaatttgaatgttggcctgccttgctaggttgggcaagtcctcctggataatatactgcagagtgttttccagcttggtaccactctccccatcactttcaggtacaccaatcagacgtagatttggtcttttcacatagtcccatatttcttggaggcttcgttcatttctctttactcttttttctctaaacttctcttctcacttcatttcattcatttgatcttcaatcactgacaccctttcttccagttgatcaaattggctactgaagcttgtgcatttgtcacgtagtacttgtgccatggttttcagctccatcaggtcctttaaggacttctctacactggttattctagtttgccattcgtctaatcttttttcaaggttttcatagcttcttttggatgggttcaaacttcctcctttagctcagagaagtctgaccatctgaagctttcttctctcaactcgtcaaagtcattctctgtacagctttgttccattgctggcaaggagtggcgttcctttggagggggagaggtgctctgattttttgaattttcaaatgggatctatttaaactgaagagcttctgtacagcaaaagaaactatcatcagagtgaacaggcaacctacagaatgggagaaaatttttgctatctactcatctgacaaagggctaatatccagaatctacaaataactcaaacaaatttacaagaaaaaaacaaccccatcaaaaagtgggcgaaggagatgaacagacaattctcaaaagaagatatttatgcagccaacagacacatgaaaaaatgctcatcatcactggccatcagagaaatgcaaatcaagaccacaatgagataccatctcacaccggtttgaatggcgatcattaaaaagtcaggaaacaacaggtgctggagaggatgtggagaaaaaggaacacttttacagtgttggtgggactgtaaactagttcaaccattgtgaagacagtgtggcgattcctcagggatctagaactacaaataccatttggcccagccatcccattactgggtatatactcaaaggattataaatcatgctgctataaagacacatgcacacgtatgttcactgcaggactattcacaatagcaaagacttggaaccaatccaaatgtccatcaatgatagactggattaagaaaatgtggcacatatacaccatggaatactatgcagccataaaaaaggatgagtttatatcctttgtagggacatggatgaagctggaaaccatcattctcagcaaactattgcaaggacaaaaaaccaaacactgcatcttctcactcataggtgggaattgaacaatgagaacacttggacacaggaaggggaacatcacacaccagggcctgtcatggggcggggttaggggagagggatagcattagaagatatacctaatgtaaatgacaagttaatgggtgcagcacaccaacatggcacatggatacatatgtaacaaacctgcacgttgtgcacatgtaccctagaacttaaagtattaaaaaaaaaaaaaggtgttttgtccacattgaaaatctgttgcctagtgtagacaccttcatcaatttcttagctagctcttctgcacctattgcttcaccttgtacttttctgttatggagacagcttcttttcttaaattttatgaaccaacctctggtagcttcacttttcttctgcagcttcctcacttctctcggcctttacagaattgaagagcgttggagccttatctgaaataggctttggcctaagtgtgcctggttggatcttttatacagaccactaaaactttcttcaaatcaacagtataaagccgttttacttcttatcagtcatttgctcactggagtaatcgtttacttttaatttcctttaagaactttgcatttgccttcacaacttggctaaatgtttggcacaagaagcccagcttttggcctgtatcagcttttgatatatcatcttcactaagcttaatcatttctagctttttatttaaagtgagagacatgcaacttttcctttctcttgaacccttagaggccactgtagggctgtaattggtctcatttcaatattgttgtgtttcaggaaatagagagacagggtaaaggcccctcccaaggagatggggagagacaggaatggccagtttgtagcacagtcagacatttattaagttcactgtcttaaatgggtgtggtttgtggtgccccaagacaattacaatagtaataccaaagatcactgatgacagatcagcatgacagataaataataataatgaaaaggtttgaaatattgtaagaattaccaatatatgacataaagacataaagtacatgctgttggataaatggcatggatagactagttcaacacagagttgccaaaaaccatcaatttgtaaaaaatccagtaatcggcaacatgcaatagcaaagcacagtaaaatgaggcatgcctgtaaatagaaactaatggtaaaaatgagactaattgttaatacttaatgtcaaaaattttggatataatcagtttcagaaaaatagaagataggctcaatttgaacatatccacttgatgcaattctttgacatatttgtgatccgtgatctgacaaaatctatgatattttgcaggttcatatgtaatgacttcttagtctgttggaaaaaacaaaggtacatttgtcttttttataaaccaccccttttctctagacatacccatgttcttctgccacacaattctgccatgttataataactgctgctaatgatattaatattcaaaatgcaagcaaataatttacttgttcttaacttcttagtctgttataaattagttatgccaatctaaatccttatttagcccattaatatgttcaatgtttactaactaccacatgaagtttacagtatatgcctgatttttggcctcaaataaaaaatatcccataaatcgtttacatttaaatcctaactcaagaaatagatttgctttccattgtagctgtcatttattgaatacttaccgtaggccaggcactgtgctatgtatttcatacatatttttattagcaaacttgaacaagataaggcttagagaagcaacttacttaaggacatatagtatgtaaaaaagcaaatctgaactcagattatggtgattaaaaaccttagctctttacctcaaggtagaaatttatttatgtcgtcgatcttaggtcatttccctttttttttctttttattttttaaatttttttattttattttttgagacagagtcttgctctgtcgcccaggctggactgcagtggtgtgacctgggctcactgcaagctccgcctcccgagttcacgccattctcccgcctcagcctcccgagtagctgggactacaggcacccacaaccatgcccagctaattctgcttttgtatttttagtagagatggggattcaccatgttagccaggatggtctccatctcctggccttgtgatccacctgcctcagcctcccaaagtgctgggattacaggtgtgagccaccgcacccacccagtgatttcctttttcatcataggttccttttgttccctaaagagactaaactctagcatgtaaaatatagtgttttcttttttctaaaactcctataaggtgattatataacttttataattacaaaacacttaaaattatttatgactttcagtaatcatatagtaaaggagatattctaattgtttgcagaatattgtaatataataactggttagaaggttcttcaagagccagatcatccagaggcactgtgaagagtttggattccatttaaccactaaaagatgatattagagaattctgaaagaaaaagagtaacatcatctattctagtttatttgtttgtttatgagacagggtcttgctgtgtcacacaggctgtagtgacacaatcatagctcacggtaaccttgacctcctaggctcaagcgatcctccccacctcagcctcccaagtagctaggactagaggcgtgtgctaccacatgtggctaattctattctagatttttaaggatcattctaggaaatataaagttatggacaatagactcagaacctgcccaatggaaaaaaagtgaacagaggagaaaacagcaacatttggtcctcaaactgaccacattcaaaggattccagggagaaaaaaagttgatggcttcttaattaaaggaataataacagctactagagaactatgatctaagaaggtagtatagccttttagttaagatcaaaatttcaagaatcagattccctaagtcctaaactcactttcacctcttactaattgtataatcttaagcacattacttaaatattgctaactccctcatagaattattgtgagaattaaacacacatatacagcattggtccccaacctttttggcacaagggactagtttcatagaagacaatttttcaatggacctgtagggggtaagaggcggggtgggggtagggggcatggtttcaggatgattcaagtgcattacatttataattagattttcataaggagcgcacaaccaagatccatcgcatgcacagttcacaatagggttcgtgctcctatgagagtctaatgctcctgcccatctgaccaggaggcggagcttggcttcactcctcaccctttgctcacctcacctcctgctgtgcagcctaagtgcaggtcagtggtctgggggttggggacccctgataagagcatccagtatcatgtttaatacacagtaagtattcaatactattaagtagtgataatactccaaattctacatatgcataaaaacctagtcaagaactaaagagaataaaactattgaaaaaaagggaggggaaaaagaaaaattgaggttagaaagtttgtaagaaatatatatgtaaaacatacagtaagtgttcaacaaatatttactaatgataatattccaaatgctgatgagtgcaattataaattatttttactttcatctttatactttctatatgactttaaattgtctacataagaattagcaatgttttctatcaaaatcagctgaaacaaaactgtttttcaactttaaaaaattagaaacaccaaactgagagcaacatttcatcatgcacctttttatcacattagtgtacctttgaggaaaaaatatccaatattcagtaaaataatatgccattcagaagttgaacattttattacattcagagcatcaattttagaattaagactgctgggtttgaatcctgattttatcattgtttatcaacactagcttggagatgttactcaagctttatgtgccttagattattcatctataaaatggaaattacaatagtacagctcaataagttgttggacttaattaatacatgtatatcacttagactgcttactatgtaataatgcattattccttttaatatcactatgctgatctgctagctcgctttatataaactatcttttctaatattctgtttctaaaatcattgtcaaaagaagtcgtttctagacctttctatctctgctccactatttgatatcacaaagaatttttaatctcaatacattaggcctaagaggaaatatgcatcagttaagagagtatgtgaaagacatattgtaacttactatgtctctgaaaacaactgccctaagccgattaatatccatgtcctgtagaagcctgtcaagatctcttactggagatataccgccagtcacaatgtccactgggctctatttaagattaaaaaaaaattgtatatatatatattcatatatacattacacagatattctttaaaaataaacacagtattcccagaaccagaaaagcaaagctatagcattcctttccccactttttttgtgtgtatgcttccttcttctttgaggggttggggagagaggtggagaaagatggcatgcaggaaaaaatgacatatttgaaggaaaaggcatcacagaaacaatcaaagtaaacactgggaaaagcagagaggtttaaatataaacaaatctttattgtgtatttaaacacaaatatttgaatgttatatgcaggcctaaagtaactattttaatctctgccagatttatttaactttatgttgaaatgaacaaataaaaatcttaattgtaaaataggagtatgctttttgaaaattaattaatctgtatacttaccttcgctgcagatttccctaaaggaataaggctatgcattggtttcaaggctttatctcccctagttttcagttgtgaatgctgttgacactccaagcaattccttactgcgactgcacaaactgtaatttattttaaggaaaagatagggaaagaaaagttaatatttaagattatggaagtgaaaaacatcaactacacaatatgatttacataagattttattcaaaacagacgacattcagcttattcctaaaatgtccctagactttatcgcctagtgttggttgtctgatattgttagcttccatgctgtggcccagttaagatttagggaggcagtatggcctagtggtctaaacgtttagggtttgctgaaaggaaatcagttcaggaatcttaacaataggctactatttcttagatctcaactaagctagctgggacaatctttagttaagaaaaggatagggaagaaaagaattgaaagaaatggaagaaaacagggaacaaagtacattaccatgaactagtcgaggtaacaatcttctattaccatcattaaagtaaattagttaaactggaaactttgatgttcttcttatattgcatcattacagcatgatattaattgagactaatagaggatatagcttttgaaagaagctttatagggtccagcatttactagctttcattaaaactgcttagaaaatgggagacaggaaagggaatttgattaatatacagtctaaaattacctaaggctcccacgaatcaggcagttagattacttagaaattaattttggattttaaatgatgaattacattatgtacccttcactatgaattgcttgataccatgtaatcatctaaattccctccaaatctgtagcactcaaggtacttgaactgagcaaaggagggagagcaaattaggaacaaaatagcaaacttaaggggggacttcacaaagaatcactggcctatcacatggctagcaggcatgagaatttagaaagaaagtgttctgaaaggtgcccaaagagagcaataaaagttgaaagaaaggaaggagggaacaagaggagggaagagagaatatggaatacagctttgtcaaatttgctatcagacccaagaaatattttactttatcaaatttgctatcagacccaggaaatacttttcatacaaactttttcacaagttgcataaaatcaaatttgagtctgtattacaaagttaaaaatcacacctcatttcctggtttcaatcagttactcttactgctgtcatcctaacttctaactccaacctcaggaaacaagaatgaggacaccagtgtccatcaacagataactagataaagaaactgtggtacatatacgcaatgaaataatattcagccgtaaaaaagaaagaaatcatgtcttttgcagcaatatagatggaactggagatcattatcttaagtgaaacaagtcagacacagagagacaaatattgtatgttctcacttataagtgggagctaaatagtgtgtacacatggaagtagagtgcgtaatgattgaaaatggagactcaggccagcggtgggggctcacatctgtaatcccagcactttgggaggccgaggcggggggatcacaaggtcaggagatcgagaccatgctggtcaacatggtgaaaccccgtctctactaaaaatgcaaagaattagccgggtgtggtggggcacacctgtagtcccagctactcaggaggctgagatagggcaattgcttgaacccggaagaaagaggttgcagtgagcccagatcttgccactgcactccagcctggcgacagagtaaggctccatctccaaaaaaaaaaaaagaaagaaaatggagactcagaactcagaaggatgagggggtgaggggggtctgatgatgagaaattatttaatggtacaatgtgtgttattcatgtgatgaataccctaaaagctctaacttcaccactaagcaatccatgtatgtaacaaaattgcacttgtaccccataaatttacacaaatacaatttaaaaaaaagatatcacacatttggactgttactttgtttaccatactctattaaatgatcttggacaagtcattttttaagtcccatttccatatataagaacagatggtactggggtggattaaattatctcttaattcttttccgtggctatgaaaaactaggaacatagagtatttccctagcctctgaatctgatgattcttgagtaaggctttgctagtatagccttgcacttttacttctagaaatgtactctttctaggaaagtgaaaagccttcgaaaatggcacacataaagcaataaagtctaaatattttaattataatactaatagattaaagaagtatactacaatagaaagagtaggagcactagttagacaaaagtatagtattcaaattctaccttcaccaattatagctttttagctatagataagtttcccaatttcttttatcttcaatttcctcatgaataaaaagaacaaaattgtcaccgtgaaaatcaacaatgacaaatgacaatagtcaataaatgataacttttattttgttatgcttacaattagaatgtctcttaaattttaaaacaactgtctataaattgttattccaagttacttagaatagcaagatataccattgattattaaatataaaatacttggaattttacatttaaactaatactattaaatactttgaatagcattttgagtaaaaattatacttgtggcaaaaagcacaggtatacattagtttatgtaacagacattcttgctaaatatgaaaaaatatgtcattaactacattttccacttccatgttatgttttcataggtgctttatctcttcatatgaccatggctcctaatggtttgcttccatttcttgtgccttctctcctcaccaccttctcttcacttaataatcaaatcatttaacaaagtctcgatatttacaactatatagaaggaaaattatgcaaaaaagggtttttttgttttgttttttgcttcacctaagaagtccagttaacattaaaaagtcatttcatgtatttttacttttacttagggaagaagtgtttccaggagaagaacagagatttcatgattttattaactgcattaacaaattaccacagcttttttgaataaaggctgtacttgaatgatgctagtttagaacgttgttattccagtgtgtttgtaagaaaagcagcatcaacatcacctgggacttggtagtcaattttaggccttaccctagacctctataaccctttttttttttgagacagagtcccgctcaattgcccaggctgcagtgcagtggtgtgatcttggctcactgcaatctccaacttccaggttcaagcgattctgctgcctcagcctcccaagtagctgggattataagcgtgcaccaccacacctggttaatttttgtatttttagtaaagacggggtttcaccatgttggccaggctggtcttgaactcctgacctcaggggatccacccactttggcctcccaaagagctgggattacaggtgtgagccaccaccccagcctagacctatataatctaatctgcattttaacaagatcatcaaatttatgaatcaccttgtgttttttaatcaccttaagtttatgtatctccttaaaatttcagaagcactactttagagcaaaaagagataggggagcacctctaattccagctactaggaaggataaggaggcgggatcacttgagcccaggattttgacaccagccttggcaagaaagcagaaccaccatttcagggagaaaaaagaaaaaaaaaaaaaaaaaagataggggagagtggaaactcctgaccaaaatcaccttagtaaatttttcaaaatacatcctccttcttgcccatccaacttaccaactactactatgtacattaaaaaaagtaaccatatgacaaattagctaacatatattttctcaccaacagaagacggataattttcaatgtcatctctgaattactgaaaaattttttttagtaaattcccaacggtttttagcagctcacctagtcggagacactgccgcaaaattcctccagatgacatacttttttcagcttcaatttcagtaaagccaagagaacttgcaaatataagcacatccacaaggctaattagcctctgcaaaaatgtcacagaggcttctattgaaaggccttgagtaggttcaatattttccagttcatgctgtaaagaataaagtttgacatttatatatatatattctgaaaaaaaaattttaccagatatagtcctaaaatttataaattgcataagtagtcagactttcagaaacctagtaacacagagtgatttatacttattatttcatctaaaaagggtgggggatgaggaggagcaacagaaccatacaggtgaaacatcatgaaccacattcttcactagctgactcatacttagggaatcaacattcttttaagttctttcattactagaacagattctaaggtcctctcaagtaaaagatcctattgttttttatttatagcacctacgatgcatagtaaccaccacatttaagttttagtcaataaagttgcataacactcatgttttcacaccaattttctatagtaattaagtccttactgtagccgatgtagcagctgaaagcaatggcagtatacccccacaagccatgaccatattgtccatcacttgagagatgagatgaattgtgttgtgtacaaagatgacattatcactgctattcacgaagtccataactgtctttgttgaatggctgtccaaagataaatgatatttactgataaagctaaagaaaggaaatcacagtttgcctacttgaggggaggaaagataagaaggtgcttttgcttcatcttgaaaactgaaggaagatgatgcagcaggcatttggagggtgtatacttcttcagaagaaacagaccattccatatcagtagttactatccatgccctccttcagtgctgaaacataaatactattcattttacactggatataaaaagttgaagaaaattatccttactgggaacaaaactaagaaatcatgtgacaaaaattaggaggtaaatactggtaaatgtgctattaaaaatgaattttcttctgtaatgcctataaaatgcttttaaacataacaagaatcttacacaaataaaaaaaaataaattaggtcactttaaaatcataaatcatacaatgggggataacttgaagtacacagattttttttaatgctaaaaatacattggaaatattgataatgttataacaattttttttttttttttgagacagagtctcgctctgtcgcccaggccggagtgcagtggcgtggtctcagctcactgcaagcgccacctcccgggttcacaccattctcctacctcagcctcctgagtagctgggactacagacgcccgccaccactcccagctaatttttttgtatttttagtagagacagggtttcaccgtgttagccaggatggtctcgacctcctgaccttatgatccgcctgcatcggcctcccaaagtgctgggattacaggcttgagcaactgcgcccggcctataccaattattttttaatacttctagtaataaaccaacttgataaacctaccttctggtgaattccgtgccataaaattgctacaggaaatctactacaaatttttttaaaagagaaacctctgcttttcacatttttgtaatccagataaggattccattcttataatggagaataaaagtgaattcagtaaaaccctaccatagaataatttctattctactttttaaccaaatgtctgaaattaattacaaactgtttctatggatttctttgaaaataaagactaggtttatacacatcttccataataaacatatagacaaaccttctccacatctgtatatctgtttctattgaaaataatagatcagtgagcaaacgttgatgcatctgagaccagttgaactcaggaatacgaaacacagtagatctggaatccctcctttgtccattaactgcatctggtgctattccttgccctggctgctcatgttgccttgatatctaatacagaaatttaaaaagtaataaaataggttcaacttcagcaggaggctttagcaaagtaaataatttagtagcttctatgcaattcatctaacacgtttttaagacactataagaaccaaattagagaaagaaaaattatcaatgagtaataacattaacattttagtacatgtaagcaaagctatcaaaagtgcaaaactaccacaatttaaaagtaattaacttggaaccatgttaagtattaccactatgtagcattttataaaagaatcaagtaacagttcttagtttttagccttagcctaaaagaaaggcagtatttagaatctaagtggcatttggattatgaagtggctagaatgaagaataaaaacagagataacataatgaagaaccaaccaacaaaaacaaaaaaaaggagggtgggacagaggataagaattgaataaagtggaaaatgacaacatgctaccaagcactgtctcatgggtcactctgagatatggacagaggagaaggctgtgcctctagatctcacaaagcctcctctctcttatagacttcataatacaattttaaatcacatgcttagtaactaaaattatacactggcaggtaggtagccctagagtttgttggaaaactaatgtactaggattgggttagtcaaataaaaggtaaaatgcaagtgtttccaatatttgttttataaactaaaattataccaatccttcaaagtggtaacttctggtgatactatggtaaaaatagtaataaaaactgtcatttaatgaactcacattaactgccaaacactgtgctaatgatctgaaatacaatcttcacattcattgcatttatttagttgtgaatagcatgtgaaccaaattcaaaataaaataaaatttaagtatatacacttgctcttttttaactcagtgcaaaagtacttgaataagacaatatataaaatcacctcaagcacatgtcgatgaggttgaggtgcttccacgttgggactggccttcaactccagcctctcagtatctgtagcaacattggaaacatccaacttcgcaatcttttgctcagaagaagcctcagagacactaccatgacaatcattaattaatttggtttctctagtgaggttagttgctttcttcccttcctccagcatctgaccaaggtctgattctacagctatttgggaaacagtagtttctggtgacatagctgaagaccctgatgctgtcatagtctgaattccagaatctttagaatcttgagtttcagtatcagtttgcttttcagtaacaggttttccttcttgaaatattaatttgtcatcattaccaaacatgtccagtttttcaccggcttcagatgcagctggagacaaactgttatcttggagctctgtgggtagattagcttcctcagtaggactgccttctactttcagttccacataatcatcatcttcctcttcctctactatagatttatccaagaattctggcatctctgaggcatcctcttctgaaggagaacttatagaagcagttacttcactgacagtcattgaatctttgccagttgttataaaagaattagaggaaatagccacagcttctattatgtcagaagatacttctaaatcatctgcattccttgtctcatttgtcagtgtttcttccaaagtgccttcatctggtaactcctgattttcttgctcagctttcatttcttcataagatgtattagtagtttgcagttcaatattagatgcagattctagtgaacttgtcttctctatacttgaattttcattaccatttgtggtgaaatgaggacagacaggagaatccttcgtatctggttgctgggatcctactgaaacattaatatcccttctaatgccagaggctgcttgaactgaagttgaagaacacagccctatttcttcatcaacttttccttgctgttccctaaatatattggcaaggttttctttgtgtatttcaaaagtgacctaggtgaaaaatgtacaatcagttaaaatatgcatgagaaatgaagacagaatacaaaatataaaactaaataattttcaaatacatagtttatataatacaataaaacttaattttcctatattttattttagtagaatgataaatgtaagtcaatcacagaaatctaaatattcattaaaaactacagccaattttaatgttaacaagtaacacagcatgaaaccacaagaagaacataattatttagcctattattaaacatgtataggaaaaggatacactattctactggccaccataacttgtaccagaatttaagtatgtaccattgggaagtgctttatgcactggataacacttgtttcaaccgctatgaataccaatttccccaggacttgtccgcaggagagattaaaaatatcaattaattatgctcaccattacagtagctctacagatatctattaagctacaaaaccattatctcactaagccaatgaatacaaattcttttagcaatgggagaaaaaagatccagcccttcccccaaaggttaaccataatttccaaagtttgaactggtcgaaaatagtctgaatgtttcagttgatccatccatacatccattcattccatttatatctgagtgactacaatatattaggcaccgtgaacattcctatatcatgctttgccttttacccaaatgggaaaaaactgaaaaagtaaatttttttttaaagagagtgctgtacttgttaatgtcacaagatttagaatttttaaaatctaaggattatcttatagccaccatcatatgatttccattggtgtttcaatggtaacccccatcaccccttgcaacaaaaatgccagaaaaacctataacacatgcagaaagtattagcctaattatagtttattaatcccaaaagtgtttgtttctgtaatctacattattatatagagtaaactgaacattcattcaataaatctttattgagccatagtataagaggatgataggacaatcaaggaagaaaagctgatttttttatccacaaaaatcaataggccttattgaatcacaagagtatacacacagatgaaaagcaaacaaaagtaaaaatgactctcaatgcaaaaatttccttctatcgacattaactcgcctttactcatgacatatacagaacattcatgccatgtgatatacctaaaaataaaaatgttcagggaatgaatattttcctgtgaatatttgtatttttcctaattgtaactatttccacattgtaactatgttcttaattctaaaacttagaaatctttttataatatttcaacaataaatgcatgtattcctcactaaacagtaaaatgacataatcacattaacaaaatatcaatttcttttacattcacaatgccaatattttatttgacatgggttctgtattttaattgaccaattcctcatattcattcaacaaaaatttactgaacatcggtagcaggccaggcattgtgtgatgaacacattgttcctgacttcatggagcttatattctaaagaaggtgtcagaaaataaacacacgaatatgtaagataatgtcaaatagtaataagagctttgaagggagggggaagtacagagtgaagaactgttctgaaagtctaggcgagaaggtgtatttactagtgtaactgcagtaggcctctctgttctatttgaacaaaggcaagaataaaagagagagcaagccatgtaaaaagaaaagagtttcaggcagagaagaacaaatgcaaaggccttggagctgaaataagcttggtatgtatgatgaataacaataaagcaataaactgagaactaaagaaaatgaggtcaaagatgtggccacgagctagattatgattgtagaacattatagactgtattaaagactgtattttattctgagagagccatttgagaattaagagtgtagggaagacaatctgatttccctttttaaaagatcagtggctgggcacggtggctcacgcctgtaatcccagcactttaggagtccaaggtgggcagatcacctgaggtcaggagtttgagatcagcctggccaacatggtgaaacattgtctctactaaaaacacaaacattagctgggcatggtggcacacacctgtaatcccagctactcaggaagctgaggcaggaaaattgcttgaacccaacccaggaggcagaggttgcagtgagccaaaatagcaccactgcactccaccctgggtgacagagtgagactctgtctccaaaaaaataagactggttagcctactttttggaaaactgactttagagagagcatttctccaccaacaaacaattatcattgtcaaaagaaagcaagttacatattaccaacctcacagtcattttgaaaataggccatttatttctacaatagcctgtgttatagaatgactttagttttcaataatcatttgctttgattttatttatattaaaggtttttagaatttgtattatacaatggatcaataaacatgagtatatgtaatttatatgtacaggttaagaaacaattttttttaatctcacatgcctaccacccatgtcaagaagtaaaacgttaccagtacctcacaattcccctatgtgccctgcccaaactgtactccctatttctccactacaatcagaaaaaaatcactatcctggtatttctatcgttcactgtttataaatagttttacctggaggtcagagctttgggagataattttaaaagatagttttactatctatatactaaacatacccattatgtttagtttaaaaaactaagtctaacacaaacctagccaattgtattttaaagagcaatactgccacacctgagctcccaagaaaagacaagatacacagaatctgtgagttgcagcagggcttcagcttatttgagagaatatgtaaagccatttctgggaagtcttataggcaagtcattaggaaatacaggaaatatagaggtcaagagaactggagaacctatcagaggcagtgtgtgccaggtagagtgtattggcatgaaatactttatatttttcaattctaagctcaccatggtgaacctctaccctaagaagtaggtcgaagcacagcatgtctttgtggagtgaagtgagaatcttcaggtgattcacattagacaggaaaacaggaatttaatcagcacatgatgaaggcaagcaagctaagtactcctaataagaatacaggtccacctctcctgagtgaaactgctccagtccagatggactgtcatctgcctactacatagctgctattgggatctccctttctacagtcctggagatccccttcatctctcttctatgttgtctcttgtttcttatatttcatttcttcctctttgtattattctctccttttgtgcaatatcctgcagtgccttcttaagaaaggatgtatataaatgttttgagatctcaaatcctgaaaaggtatttattctcgcttcatacttgattaatagtcagagtataaaaccacagatagaaaagcatttaccttcagaatctgaaatgcttttaaaattctaaagtcatttggtttttaaatttgcccttaatttaattcatccaatggtctaaaagctaaattgcaattgaacaactatcagtattatctttttggatgctgttttccttaagatatttgtgactttaaaactgataatttccaattaattgccagatattgttctaaattacccagctaaaagactagtcattaatcttcacaatcatttgatagctaatctatagctgtttgtaatgtttggaaagcacttctataaactactagttaaagatacttgtgagctaatgactataacatttcttttgccattattttcaacttaattggcactcaaatttactaattagtagataaaagataaacacaatacatccagatgttaatattatctttttaatctatacattaaaaccgtataacctgtaaaatttagacattttaaactgttaggcaatgtttagcaactgactttgtttttaagcaaaggcatctttttcagtgtctgttttcatatgaaaataccagctaaatatgatgttaacttctgattaagttaccaacctttgataaataagatatatctttaaaaacaggtggatcttcccatatgtattatcaatgagcataagtcaaaatgattgccaccacattaatgagatcttttataaagactctgatgtataacaatggtataggtaacagatataatggtaaaatcaagcattactgacataattaagagcaattctaaaggttggtagtacaatccccatttataaagataggaagaacactgacaaaagaatattgcagcaaataacttctaatcttttcatttttaaaacagtcattttgatcaattttaatttcttaaaaacagtctaaacagatgctttcatgcaaatctagcgtataaactggtacaaatttttagagggcaatttagcaatatctactaaaaactttttaaaacatgtacagactccttcctctggaaattccacttacaggaatttatcctacaaaataagggttacagtattgaaccaggctcatcattggtcaatgataaggaacagataaagtatgattataatataaatcaatagattttttaaatctctcttccatcaatttttctaaatacaattttggagaatgccagaatataaaaagaaaacttgaatcatttacacggtcactccttcctagaattttaagtggtctgataacattcaaatgttatatcaaagctgaatcttatgctctttacttctccataatgtcatataatatgcaggcattaaaattcatgtaagaagcatatcattaaataatactctaaaatagtaaaaatacgatcacattttgttagcaaataattatatgttatgtatagattcatgtatagaagagaagactaaaaggtctcgcactaaaatgttaataagttatacataggtgtttggataatggataatttttgttttctgtgtgtatgcatttctgctgggttcaagatttcctgtaatgaaaacttattattattttaaattttttaaagtaataaatgctatttggtttcaaaatgttaaagctaagaatacttttagccaggaacaaaggtacatgcctgcagtcccagctactggagaggctgaagggagaggatcacttgagccaaggagtatgaagctgtagtgtgttatatataatggcacctgtaaagaaccaccgcactctagcctgggaagcacagcaacagtctgtctctctctctttttcttttttttttttaagtgccatttaaatttgataaaaacacacacacaaacactcacacagaaatcaggtatttttaaagaattatttagcaattaaataaggtgcaaagtgctgataatccatgaaatgcggacattttgtaacttttttatttttgtaatttttgtgagatatctcctttcatcacccagactgaagtgcagtggcacaatctcagctcactgcagcttcagcatcccgtattcaagtgattttcatgccttagtccccagtagctgggaccacaggcatgcaccaccactcctggctaatttttgtatttttagtagagacagggtttcaccacgttgaccaggctggtctcaaactctggcctcaagtgatccacctgcctcagcctcccaaagtgctgggaggcatgagccaccatgtccagccaattttgtaacttttgaaatttcttcaaacaagtcgcttttaatcttatcatacagccaccataaacacatatacatttttgtatatgccagttcatatcttatgatttaaaaaataattttaataaaccaattagagaattctttaaaaaaaaatcttatttccacatgcttttacccaatctaaatggtagttttttcttatgtacagtgactgaaatgtatacttcagatatttcatttcttatgtacagtgactgaaatttatacttcagatatttcatcagtaaacagcaagtaaaatcttcagatatttcaaaaaatccaagataattaaggactttatcctcaaattcactatttaggaggaaatccaattcatattatacttttaactctaacatgactaatctttattcattttaagtcataaacccattctaacttatggcaatatgagtctagacaaaatacagtatctaaggtgttagttttatgtgtttagaaaagaatgtgtttacaaaattctcataattcagaatagtttaaatgccttaatttaaattttaattaatgagtaaaagcattttatcataccaagtgaaaaaaagtattacttaagcacagaaaaatgttcaatttgaagccaaaaacaaacaaaaaaaaatgaaaacctagacaacaaataagacaatgaaatcacaaacgttactaggtgcactctttaaaaccctgagatcaaagtaaccaacatagtgcagttatactagaagagcctattactgcttataaaacccagttcagctgctggaggagaggcatatagtgacaaacagcttccctgctacaaaggtggcaggaaatctatcaaactggacaataaaactgcaattgagtttctttggctttttatagcagcagcatgtatcctgatgtaactctgcaaaagctatccaattctgcaacattagttctttacacatcagttctttatcaagaaccatgttataaatttgggatattgagattcaaaatgactgcaaaaaggaaaaagcatcactttaacactgtatgtataaaagtattataaaatcttcagaacttatatttttagagaaaagaaaattttgttccaataattccagtggaatttttaatagctgctaaaaattgttcacctacttactgaatcactacagctctattctaagctttattaaataatgacttgaagagccttagggtataagtttctgtcttattttaaaaatagctataaagatttaaaattccaaaaaacttaacagcattcaaataaattactttgtataagcctcatgaaacagaaaagccttttaaaaatgaagaaaatccacacgaaggaataaaagacatgtatgaaacactaaaataaaaggtgaacaaatgtaagaaccaacttacaactttaaacttttgttttccctctcataagtaatgttttagcatgtatttttaaaagtatactttgacagcaaaaagtggtaggtctagttttactcagataaaaagactccatgattaacttagcattatcccatcttataaatgaatactaaaacttaagtcagtgtggttcttggtcaaaagtaggcactagagacctctccttaaagcaactattttcttcagaaaaattttaagatctgtttaaagccataagtcactggactaaagaaacatataggccgggcgcggtggttcacacctgtaatcccagcattttgggaggctgaggcgcgtggatcacgaggtcaggagatcgagaccatcctggctaacatggtgaaacctcttctctactaaaaatacaaaaaattagccaggcatggtggcaggcgcctgtagtcccagctactcagggaggctgaggcagaagaatggcgtgaacccaggaggcagagcttgcagtgagccaagatcgtgccacagggcgacagagcgagactccgtctcaaaaaaaaaaaagaaatatataaactaaacaaaactatagtcatgcatcacttaatcatgaagatatgttctgagaaatgcatcattaagcaatttcatcatgtgaacaccatagagtgtacttaagcaaacctagattgtatcacctactatatacctagactctatggtatagcttattactcctaggctacaaacctgtatagcttattactgtacagaagactgcagacaactgtaacacaatatatgtatttgtgttatctattttttttaatgttttaatttttgttttaacaaaagactgagtctcgctctgtgacccaggctggagtccagtggcacaatcatagttcactgttacgttacttcaaactcctgggctcaagtgatcctcccacctcagcctcctgagtagctagaaatacaggtgcatgccaccatcccagctaatggtgtgtgtgtgtgtgtgtgtgtgtgtgtgtgtgtgtgtgtagattgagactcactatgttgcccaggctggtctcaaattcctggcctcaagccatctttcagacttggcctcccaaagtgctgggattagaggtgtgagccaccattcccagcccttatattgtgtgtacgtaaggtttagaaatgtgtatctaaacaaatataaacatagaaaaggtatagtaaaaatccaatataaaagatttaaaatggtacctacataaggcatttaccatgaatggagcttataaaactagaagttgccctgggtcaatcagtgagtaagtggtgagtaaatgtgcaggtctagtacactacagaagactttataaacactgtaaatataggctacactaaatttatttttaaaaactacttttctttgttcaataagaaattaacctcagcttactgtaacattttaactttttaaacattttaatttttaaaactttttgactcttttgaaatcaaatttagcttaaaacacaaacacattgtacagttgtaaaaagatattttctgacaggcacagtggctcacaactgtaatcccagctacttgggaggctgaggcatgagaattgcttgaacctgggaggtggaggttgcagtgggccaagattacaccactgcactccagcctgggcaacagagcaagactctgactccaaaaaaaaaaaaaagttagaatggtgatcattaaaaaataaggaaacaacaggtactggagaggatgtggagaaataggaacacttttacactgttggtgggactgtaaactagttcaaccattgtggaagacagtgtggcaattcctcaaggttctagaactagaaataccatttgacccagccatcccattactgggtatatacccaaaggattataaatcatgctgttataaagcacatgcacacgtatgtttattgcagcactattcacaatagcaaacacttgcagccaacccaaatgtccaacaatgatagactggattaagaaaatgtggcacatgcacaccatggaatactatgcagccataaaaaaggatgagttcatgtcctttgtagggacatggatgaaactggaaaccatcattctcagcaaactatcacaaggacagaaaaccaaacactgcatgttctcactcataggtgggaattgaacaatgagaacacttggacacaggaaagggaacatcacacactggggcctgtcatggggtgggggagagggaagggtagcattaggagatatacctaatgtaaatgacaagttaatgggtgcagcacaccaacatggcacaggtatacatatgtaacaaacctgcacgttgtgtacatgtaccctagaacttaaagtataatttaaaaaaaaaaaaaaaagtccaggtgcagtcacgcacgcctgtaatcctaacactttaggaggtggaggtgggtggatcccctgagctccggaattcaagactagcctgggcaacgtggtgaaaccctgtctctactaaaaatacaaaaaaattagctgagtgtggaggtgcacacctgttgtcccagctactcgccaggctgaggcaggagaatcgcttgaacccaggaggtggaggtttcagtgagccaagattgcaccactgcattccagccagggtgacagagcaagactctgtctcatttaaaaaagacacacacacacacacacacacattctaaccgggtgtgtggctcatgcttataatcccagcactttcagaggcccaggcggggggccacttgagtccaggagttgaagaccagcctgagcaacacagtaagacctcgtctctacaaaaaaactaaaaaagtagccaggtgtggtagcacaagtctgtagtcccagctactcaggaggttgaggtgagaggatcacttgagcccaggagtttgaagttgcagtgagctatgagcacaccactacacttcacctgtctcaaaaaatattttttttcctttctctatatccttattctaaaagcttttttctctttttaaaattatatatttttcaaacttttttgttagaaactaagacacaagccagtcccggtggctcacccctgtaatcccagcactttgggaggctgagtcaggcagatcacctgaggtcaggagttcgagaccagcctggccaatatggcgaaacaccgtctctactaaaaatacaaaaattagccagttgcagtggcaggcaactgtaatcccagatactcgggaggctgaggcataacaatcatttgagcctgggaggcggagtttacagtgagccaagattgcgccactgcactctagcctgggtgacagggagactctttttcctgagcttacacagctaataattactataaatcaggattcacaccctgtctccaaagtccacattctttcattacttacacaaacggatttgaaaactggatataaatacttagtcataaatgctcacaagctcaaaacacctgagatatcacctaatccaactcctttattttgtatatagggaactcaaaaagactaatctattcatcctaaatatcctattattttctaagatagcagttctcaaactttttggtctcatgacactttatttatttatttatttattttattttttgagacagagtctcgctctgttgcaggctggagtgcagtggtacgatctcggctcactgcaactccacctcctgggttcaagcgattcttctgtctcaccctcacaagtagctgggactacaggcactcaccaccacgcccagctaatttttgtatttttagtagagacagggtttcaccatgttggccaggatgatctcaatctcttggcctcatgatccacccacctcaacctcccaaagtgctgggattacaggcgtgagccaccgtgcccgggcaacactttacattcttaaaaagtattaaggtccccaaagactctttatctatgtggattatatctactactgcttattatattaggaattaaaactgagaccttttagaactattaacccacttaaaaataataaactcaatatataatataaataacattttttgaaaatgattatttttcaaaaccaaacaataacaagaagagtgccattatttcatatttttgtcaatctctttaaagtttggcttcatagaagacaactgcattctcatatttgcttttgcattcaatctgttgcatatattggtttggctgaagtatataaagaaaatccaccctcatacagctatgcagtaggaaaggaggactgcacagaccccatgaaaagctctcatgggcccacgttcttttttttttttttttttttgagacagagtctcactctgtcacccaggctggagtatagtggtatgatcttggctcaatgcaacctctgcctcctgggttcaggcaattctcctgcctcagtctcccaagtacctgggattacaggcatgcaccaccgtgcccagctaatttttgtatttttagcagagatggggtttcaccatgttggccaggctggtcctgaactcctgacctcaagtgatccagccgcctcagcctgtgattacatgcatgtgccatcgtgcctggcctccctcccaaggtctttaggttatacttttaacaacgattgctttaaagtttatactcctccagccatctttcctaaggacttgaagaaactaaggtgaactgacatagatctgttagaaacgtgaaaaatctgctttatactgggcacttccctaacctataatctcccctagaaatctctgaaatctactccagatgtatatggggcacaaagtcaaccctatttttcttataatcttttgtaaatggcaacatagtatgagaaaaaaaatcagtctagattgcagcagcctactgcaatagaaatgagaatatctgggcatcagcacaaactaaagttacagaaaggatggcaaacagttcctgtaatgagccaaatagtaaatattttagattttaggggccatgtcgttgatgtaacatgtatgattatccttatagtgtgaaagtagccatatacaatatataaaggaatggtagtggatacattctagcacaattttatttagatctgacacttaggccatggctagctgaattctgttttaaacaaaactgatcaacctcaacaatacagtgactaaaacaaagccattttataaaatcagatctcttttcttatttacaaatggattttactccttgtaaacccttgtagaagcatactttctctcaatgaagaaagaggaggaacaatgaataatttgtaggaactttcaatcaataattaaaagctattcaaatacctagaaacatgtaattaggaaagggcaatatattcttttttttttttttttttagatggagtctcactgtctcaccaggctagagtacaatggctctatctctgctcactgcaacctctgcctcccaggttcaagcaattctcctgcctcggccccccaagtagctgggattacaggtgcacgccaccacgcctggctaatgtttgtatttttagtagagatggcgtttcaccatgttggccaggctagtctccaacttttgacctcaggtgatccacccgccttggcctcccaaagtgctgggattacaggcgtgagccaccacacctggccagaaatggcaatatattctacagaatgacaaaatatcttagaataataactttgatagtcagtaaaatgtaacacttaaagatatagagaaattatcattcttggtatttattccttctagtcaattttttattaaataaatagctatataattatacagtattccttctgagtaatgaaaaagttcttaaaattcaaaaaacatacaccgtaaatgaaactaatagattttaatgcattaattacttgaaatgtaaattttcctcagaaggtacaaacataaaactccaaaaatagttagataatccacatattggcagaagatgttcataaacaacatagctagcaaaggattaagaatgagactacataaagaactcccacaaaacaacaagaaaacacagatcaagattatggtgatgtagcattttaaattcatcaaagtgacaaatttttaaactccagccataccacgtgattaggtgatgtgaagcaatgagaacttaaacactgctggtgatatgtaaactgatacactactttagaatactgtattgtattggaatacgatactttggaaaagaatttgcattatcttgtaaagttcaacattttcaccttataagtcagcaattctacttctaggaatatatgcagaaaattcttgaacaagcacaaaatgtatacgaaaatgctaattaattggtaaataaatagtcatgtcatgcaatacattacaattgagaaaatgaacaaaactatatgggtcaatgtggatgaatctcaaacagtaataagcacaaacagtaattaacaaaaaaatgcattcagtatgccacatttaccttaagtgcaaacataaaaaataaaactctttattgtttagagttatatacacgtagtaaaggtatagaaaagacaaaagacaacaccaaataaaagctagtggtgttgggggtcaggcgaagaagaggagacaaagcaattatagaggagtaacccaatttcataaacagtgatcctttttgtatgcttagagtatttcaaaaaagaatttaagctatatataaataactaaacttactttggcttaatttaaaaaaaaaaaaaaaaaaaaactacattcttccaaacccagtttttagctacctgtaagattagcacagggcagacatcacccagagcttttctgtttactcatccaccttacgttgctaaaacaactgttcatctttgaatatagtgcgccaccttgtgttcaaaagcttttaactcatataaaattctgagacccatgtttgtaaacagggcttcctcgaaaaaaaatattaggttggtgcaaaaataattgcagtttttgccgcaactactttttcagcaccctagtataaattcctttatgctgtggcaatagatttaccattataaagataagtacatgtaaaaacaacattagaaaaaattattttgattctaaagaaattacaaatgctttatttctattgataatctttttgagctttcattttgctgtactttcagaagataacttgccttttttccttgattttaagtatcgaaattttttaaatgactaaaattcaaaaattatagatatttaaaatgctacaatacgctttcataaagaaacttacctttgaatgagtgattgataaagtgtctacccatacacgccagccaccccactcatatttgactgcatggtaaagcaggattctgaatatggcgtataccatttctgttatcttttgctcatctgaattcttaggattaaaatagcagagagaaagcatccattcttgccacacagagcattgtagcaagctcctgaaaattatgagagggtactaaattactgaagaaaaaaaaattatctaaaataaatctaaaggtttaaaacaaaataaccctgcccctccctttccccccgaaaaagaaacacatttagttatacattaagaacaattcgacaatgtggtactaaaaattctaacttaactatgtggtacattatttacatactcttaataaaaaaaatagaaaaatcatttcacagtatttttaaagcaatttttcttagataaaatgggcttatacaaaagtacatttgaatactgcaaataaatgctttctgattcagcttacctcctgttttctctactgttattaaaaagtttaatcatgtcagaaagaaaggctctgcgaacctccatgctctctgggcactggggagaatttcgaagtagggtcgcaattacttttagtatctctgtaagacagtttataaataagtaaaaaccaaactcaacaaaaaactcatgatagaaggtcatccatctattgcaatttctttagtttccctaacacaaatgtctaccaaaaacatcctcttctgttattaaaaaaaatcacctctggaaagaaatgacaatacattcattagaaagcatttataaatatgaaaggaaatttctttcatgattcaaatgtgcaaaaataaagctgaactttaaaaggttaaaataaaacaagttaaattataaatgaattaaatgtcagtgaaactgcttactctctctgagatataccaaatagtaaagttgatcttaaaaacaagcaggccgggcgaggtggctcacgcctgtaattccaacattttgggaagctgaggtgggtggatcacttgaggtcaggagttcgagagcggcctggccaacatggcaaaaccccatctctactaaaaatataaaaattagccaggtgtggtggcgtgtgcctgtaatcccagctactcaggagggtgagacaggtgaatcgcttgaacccaggaggcagaggctgcagtgagccaagatcgtgccactgcaccccagcctaagcgacacagcaagactctgtctcaaaaaaaaataatgaaataaaataaaaaatactataatcaaaatctcagaaaaatataataaattcttagattcctcatcataatttatggtatgcacacacagtctttcatagctgggattataggcacctgccaccacgcctagctaatttttgtatttttagtagagacagcgtttctccgtcttggtcagggtggtcttgaactcctgacctcgtgatccacctgccttggcgtcccaaagtgctgggattacaggcatgagccaccacggccggcctaccatagagaatttttaaaggtgtgaagattttctttcataatcttaaaagtaaaattagacacaaaaaacccaaaggaaattaaaacctattcaacatcccatctccccagaaaatgcaaactaaactactattgtaatggtcttagcataaagctatttaaatctccagaatttagcttaaattaggccaggcacagcggctcatgcctgtaatcccagaactttgggaggctgaggcagttggataatttgaggtcaagagttcaagaccaccctggccaacatggcgaaatcccatctccacaaaaaatacaaaaattagccaggcctggtagcaggcacctgtaatcccagctaccagggaggctgaggcaggagaatcacttgaaccaggaggcagaggttacagtggctgagatcctggcactctactctagtctgggcaacagagcacaagactcggtctctaaataaataaataatctccagaacttagcttcttagcttaaattaaaacaaaaaaaaaaattcttttaaaaatatgcacttagaccaggtgcagtaggctcatgcctgtaataccagcactttgggaggttgaggtgggaagattgcttgagcccaggagttttagaccagcctgggcaacataggcaaaataatgacatcacgtttctctgaaagctgaggaaaattaaacctcaaagccacgtgctttgaaaattagcactggagtaccaaacacacaaatacacctaaccacataaaatgtaattaaattttaaaactctacaaactaataattttaataacatgatcttaaaaagcaagatgaaaaaggtatactttatacaagtgcttaagaattctaaatatcaaaagaaaagactgtttaacaagactatcttcataaacaataaagaagacatattgttctattccaaatttggtatttttatattcacagtaatttaagataaaactaccccaatggttcttgtaattctgcctgacatcactaaatagcacaatcaaaattttgctgaaagtctgaacatatattacatcaagaccttaagcaaacaattcttcaaaacctttatataagaatttccacataacttaaggttgattcgaaggaatactcaatataaaacccaaacaaaactagtataatatcatcacccttaatgaaacattcatctaacaatctgtttcaacaacatcaattttaggttgttcacagtgactttctttttaagtagcaaaaggtagtttttgttaaagtatataaaatacatacgagggttttgtatcttcactgaagaatcaggatctggatgctgtttatgtatcacctgagtaccaatctgttctataagaatctacagaagtaaaacaatggattacattagcaaatcactggattagcatcactattaatgaactttaagtgcatcactattaattaactttaagtacaacactaatcaaaatatagtatatttttagtccaatattgtcatgctaaataatatacttctaaaataactacagcattattactctatgttttcttaattataaaatgagacatcaaatagttaataaaatggagggaacatttaaacagaaataacgatactgtttagaaattcacagattaattatagatttctaaaaatgcagccacatctccttatatcatttcaaagctgtacattacaaacttaaatggtctggtcagcatggtggctcatgcctgtaatcccagcactttgggaggctgaagtgggtagatcgcctgaggtcaggagttcgagaccagcctagccaacacagcaaaacccgtcactactaaaaatacaaaaattagccgggttaggtggtgtgcacctgtaatcccagctactggggaggctgagacaggagaatcacttgaacccgggaggtggaggttgcagtgagccaagactgtaccactgcactccagcctgggtgacagagtgagactctgtctcaaaaaataaaataaaaataaatgatcttatttacctacacaatgttaagaggcatttttataataagaaatttagaggagtaaatcctaagtacattcctacctcaaacagcacattatatgtggtcattgtgattaaatttgtctgaagcatgagcctttcagctagcaatgaaaacaatccatgtccaagcatgacttctgctttcctcctgcaattacacaaaaagaaatcatcaaatgtagagcttttctgtgctctacttaatatgcatgctggatgaaggaaacacaaaatactttttcacattacaaacaattcccaactcaattactctcccaactatcttcaatctagaacttttaaggccacaaaacctttaagcagagaaatgctaactatataagcatagccgaagttaaaaattaaaaaaaaaaaagacaagtgtgcctatgctacagcacagcaaaaacctcctccaaaatcttcagagcagttatttatttaacgaagttgctacaatctaccagcactaacttagtctcccctggggatgatcatctaaagcacaataaatacttaagtagaaaaacaatgtggagaaaaagtagaagaaatgtaatataattttttaaaataaatactatgaaaacatatataccaaaattaaccttccaagcataaattcagaaactaaaggatcacaaactttaattttacccttggggtcagcaaagcttttctgcaaatggccagggggtaaatattttagaatttgtggaccaggtgatttctgtcacaactcaacactgtccttgtatcatgaaagcagccacagatgatacacaaataaattattgtggctgttttccaataaaactttatttacaggtggctaactggattcctaaagacttcagtttaccaacacttgttctacccccaaaattttctttttaaaataaactacttctggtacaaagaacaagaggtagaacatgaatatctgtattcagctaagaaaataagcgtggaagtttcagttttgagttacgcatacagcagaacacactatgtgacaaacatccaggttatgtattactttataatacagataaagcaaaaatggtgtgagtcacctgaaatcaagtctccatagcttcttgaatgcaagctgtccaaactaattctcataattcacattaaatacatgaataatttaaataattttatgtacaaaaaaattaatcctgttcacttaatttttaaaatatgtactagtgggattacatttatacagcaatttatgaataaaaataaaagaaaaactagaggactatagaacaaaattactactgcaaagatttataaaataaataagtagaatacaacagtccatcttagatttcggcatacttactttggggccagatgttttaaaaaataacccattgccttaagagcttgtaccctgattccttcacttttcgatgccagaagtttgtagataacactgaatgaataaaaatttaaaacaaactattttgagtataatttttaaatggaaaggtttaaaatatatacttttcatattattataaatctatttcaaataatatggaaggaaatttaatatagatttctgtatataaaaaatctgcttatctcaggctagagttcctttcaatgaaaactaagaaatgagaagaaattggaatataagaaatgaggtgacttttccatgcacatacttatatgtaacgtgtgtatcaagctagctttcagatacttttttccttctgctacaggcttgtaaatgttctgaaggttaccaacttgttattttaagtcagtagaaagaaagcatttctaatggtagcacatatttaaatttctaaataattgtcgccatgaaaaacaagacagtaggctaataataaatgattatcagaaataattacaaaagtaaaaagatttacaaccaaagaactgctaaaaataaatttctcattcaattctcaaaaattatatagtaatctaatttaatttttaaagatctatgaggcagctggatgcagtggctcacgtctgtaatcccagcagtttgggaggccaaggcaggcagatcacctgaagtcaggagttcgagaccagcctagccaacatggtgagaccccatctctactaaaaatacaaaaattagctgggtgtggtggcatgtgcctctaatccagcttctcgggaggctgaggcaggagaatcgcttgaacctgggaggtggaggttgcagggagccgagatcatgccactgcactccagcctgagcaacacagtgagactctgtctcaaaaaaaaaaacaaacaaacaaagatctaggaaggccttctgattttagtataagtaaagtataatgcaactgaaattaaactgattcattacagcattcccttcctcataaacatttagaacaagaacagtaattagaaactcttataattacttataaaaattaaggatatcagtatcctcctagatcaaaattttggtgtttagtaagttagaaaacattctgaacaaaaaggaaatatcttcaacctctagtgatcaatagaaaagcaggtatataaaaaagaagtttgattccttttaaaacatgaactaaaggcatccaggtccatatcacattgtaactgcataattttaattcaaatcttagtacaaaaacttaacagtcaatcattaggaaaatactaatatgttgtatgtttcttttcttcaaggatttaaattcagccaaataaaaattaaaccttttaaaagaaatattaatataataccagtttaaaatcacaatagttttttgagtttttttccccaaagatggcagatttgagggctttagcatttctcagccacttagaaatagcaagatagtatataaaaatcaactgtgagctttaattcaggaagaaaagcaggactccaccagaatcatgaaaggcaccctagttcccgagagcactttgtttctcccaagacctggagctaactgggaaagaggtatggagatactgtgagggaaagacaccaggaaaagttgcagggaccaacagcaggatgccattttgaattcaagcacacacaattcaaactggaaatctggcagtgtggctgtgcaggcatgccagagattagagtccctgctttggagccagaattgtgaaaactgcctcagcagtaggtgttataattgtactctaccccgtcgcaggcctggggtgggaggaaagctgctacagctgcaatatctcctggacaacaagacttggcaggcagaggcagcttggtgacctggaaccagtctgcatgtgtcattgctgggtgctccagcctgctaccctgacactgtggtgcagcagggccctctctgctccactctcaggcagaaatccagacattcaagccaccccacccttcgtagacacagatcatagcactggaccctctttgctccatgcccaggcagatctccaggcaactgacgcacccactcccacggactagcaacctgagccctattccacgtggtgcagcaagatgcacaggcagatctccaggcattaaatgcacttgcttgcccagattggcagcctgagccaccccactcttcctttgcagagatccaggttcagaggggtcctctatgcttcatgctcagggagatctccaggcattcagagcagctgcttggctactccagcagcctgagtcacctcacccctctgtgcaaagatcttggtgcaagggggaacctctctgctccatggccaggcagatttccaggcattcagactactcagtcacctggaacagcaccctctgcaccattcctatgtagagatcctggtacagggggccctctctgtttcacacccaagcctatctccagggattcaaaataactgcttgcctggttcagtaccctgaggtgtcccaccattccggtgcagaaatcctggtgtaggagaccctctccatttcacagccagtagatctccaggaatctggaaaacccatttttcctggattaggagtttaggccatccccattcccatgcagagaacttggggctgaggtttcccatcactattttttgtgcccttctccagagcatagaagggagctcagaccaccatgcactacacacatcagcttattgcctgaggcaacagagaacttctcccactaaacaagggtcaagtatatacccagccacattggccaaagcccactcttactcataactgccatccaatggcttgtaggttgaactgcacagcccaatataaaacctgctgacggaagtgtataaagctacagaagcaaagccaaaaggccctacccagcattctctatagccacaccccctatgaagacagggaaagagaaagaagacaaaaaaataataataacattacagagaaagaaaaaaatcttaaaagcatgaaaattattacaaaagttacaagtgtcagcatctccaaagaaggaaccaccacaaaacttcagacaccatgaaaaatctgagtgtggtgacaccatcaaaggatcacactggctctccaaccatggtccataaccaaaatggaaactcagaagaattgacaaataaataattcaaagcatggactgcaaggaagctcaatgatatccaagacaatgttgaaaattaaaagaaacttctaaagcaatccaggagatgaatgggattaaacatcttaaaaagaaatcaatcagagatcctggaattgaaaaactcacttaagaaattacaaaacaagactgaaagttttatcagcagactggacaaaccaaaagaaagaatttcaaagcctgaagaccgatctttcaaatttacctgaacaaaaattttcaaaaacaggttgaaaaatgaaaaaaagtcttcaagaaatataagactatgcaaagcagccaaacctataaattactggcattactgagagagatggataaaaagaaaacaacctggaaaatatatgtgaggaaataattcaagttgctagagatatagacatccaaatacaagaaatctagagaacatcacaagataccatacaaaatgaacatcaccacagcatatagtcaccagactgcccaagatcaatattaaagaaaaaatcttaaaggtagccagagaaaaaggtcagatcacatacaaacagaaccccatcagcctaacagcagacttcttggcagaaaccacacaagccaggagacattgagggcttattttcagtatccttaaaagaaaataaatttagccaagaaatttcatatccacccaaactaagcttaataagcaaaggagaaataaatgtttttcaggcaagcaagcatcaagggaatttgttacctacagaccaaccttacaagagatccttaagggagttctaaacacggaaatgtaagaacaacacttactaccacaaaaatacatgtacgtagcttgcaaaccttataaaacaaccacacaaaagaaattacaaagcaaccagctaacaacttcatgataggatcaaaatctcacatatcaatattaactatgagtgtaaatggtctaaatgcccccactcaaaagacacagaatggcatattggataaaaaaaacaaaactcatccatctactgtctttaagagacctatttcagctgggcgcagtggctcacgcctgtaatcccagcactttgggaggccgaggcaggaggatcacgaggtcaggagatcgagaccatcctggctaacacagtgaaaccccgtctttactaaaaacacacaaaaaaaaattagccaaccatggtggcgggcgcctgtattcccagctactcaggaggctaaggcaggagaatggcatgaacctgggaggcagagcttgcagtgagcagagatcgcgccactgcactccagcctgaatgacagagcaagactccgtatcaaaaaaaaaaaaaaaaaagagagacctatttcacatataacaccactcataggctcatagtacagggttggggaaagatctaccacacagagagaacagagaaaaagagcaggtgtcactattcttatatcagataaaacaaacgataaactatcaagagttaaaaaggacaaaaaatggcattgcataatgaaaaatagttcaattcaacaagaaaacttaattaccttaaatatatatgcacccaatagtagagcaatcagatatataaaacaacgactacgagacgtaggaacagacttagacagtcacacaatattagtggtggatttcaacaccccactgacaggcattagacatgccatggaggcagaaaactaacaaataaattctggacataaattcaacacttgactaattggacctaatagacatctatgggatactccacccatcagccacaggatacacattcttctcatctgcacacaaaacatactccaagatcaaccacatgcttcgccataaagaaagtctcaataaattcaaaaaattgaaatcatgccaaccatattctcagaccacagtgaaataaaaatagaaatcaataccaagatgatctctcaaaaccatacaattacatggaagttgaacaacttgctcctgaatgacttttgggtaaacaatgaaatgaaggcagaaatttaaaaattttttgaaataaatgaaaacaaagccacaacataaccaaaactctaggatacagccaaagcagtgttaagacgaaactttaggccaggcacagtggctcatgcctgtaatcccaacactttaggaggtcaaggtgggcagatcacttgagagcaggagttctggaccagcctggccaacatggtgaaaccctgtcttttccaaaaatacaaaaaaaaaaaatagctaggcatgatggtgggcacctgtaatcccagctactcaggaggctgaggcaggagagtcacttgaacctgggaggcagaggttgtagtgagctgagactgagccactgcactccagcctgggtgacagagcaggactgtctcaaaaaaaaaggaaattttatagcacatagcactaatggcctaagtcaaaaagctagaaagatctaaaattaacaatctaacatcacacctagaggaactagaaaaacacaaactattaaccccaaagctaccagaagaaaataaaaaataacaaaaatcagagcagaactaaacaaaactgagaccaaaaaaaatccatacaaagaaccagcaaaacgaaaagctggttatttgaatggataaagaagactgatagaccactagctagattaaaaaaaaaaaatccacatacaagcacaatcagaaatgacaaagttgatgatacaaccaatctcatagaaatacaaaagatcctcagagacaattatgaacacctctatgcacacaaactagaaaatctataggaaatggataaattcatagaaacacaaaatcaggaagaaattaaaaccctgaacagaccaggattgagctccgaaactgtatacctgcttaaatttggcagtgaatttttctggtccaggaattttttttttttttttggttacctactaaccaaaaaaatcctagatgaggtaaattcactgccaaattctagcagatatacaaagaagaggtggtagcaatcctactaaaaatattcaaaaaacttgagtacaaggaactccaccctaacttattttacaaagccggcatcaccctgataccaaaacccagcagagacacaacgaaaaagaaaactacaggccaatatccctgatgaacacagctgcaaaagtccccaacaaaatactagcaaaccaaatccagcaacacatcaaaaagttaattcacgatgatcaagtaggcttcatttctggaatgcgaggttggttcaacatacacaaatcaataaatatgattcaatacaaacagaattaaaaacaaaaccatacatttatcccaatagatgtggaaaaaactttcaataaaatccagcatctcttcatcataaaaatcctcaagaaaccaggcatagaaggaacatacatcaaaataatgagagccatctagggtaaacccacagctaacatcatattaaacagacaaaaacaggaagcattcctttgagaactggagcaagaaaagggtgcctactcttaccactcttattcaacatagcactggaagtccttgccagagcaatcaggcaagaaaagggaacaaaaggcatccaaataggacaaaaaaaattcaaactctctctcttcatgacaatataattctacaactagaaaaccctaaagactcctccaaaaggctcctgtgactgattaaatgacttcagtacagtttcgggatataaaattgatgtataaaaatcagtagcatttccaaacaacaaccttcaagttcatatccaaatcaagaaagcaattccttttacaatatccatgctcaaggattggaagaatcaatattattttaatggccatactgcccaaagcaatccacagattccatactattcctacaaaactacgaatgtgatttttcacagaactagaaaaaaactatactaaaatacatacggaaccaaaacaagagcccaaataggcaaagcaatcctaaacaaaaagaacaaagctggagtcatcacaatacccaacttcaaactatactataaggctacagtgaccaaaacagcatggtactggtataaaaacagacacatgtgtcaatggaacaaaatagagaacccagaaacaaagccacctacctacagccctctgatctttgacaaagtagagaaaaataagcaatggggaaaggactccctattcaataaatagtattggaatagctggttagccatatgcagaagaatgaaactggacccttacctttcaccatacaaaacttggccaagtgtggtggttgacacctgtatcccaacactttgggagtctgaggtgggtggatcacgtgagcccaggaatttgagaccagcctaggcaacgtggtgaaactctgtctctacaaaaaacgcaaaaatcatctgggcatggtggcacatgcctgtaatcccagctacctgggaggccaaggtgggaagatcgcttcagatgcagaggcagaggctgtagtgagctgtgatcgtgccactgcactccaacctgggaaacagagcaataccctgtctccaaaaaaaaaaaaaaaaaccttttagctcaagatggattaaaggtttaaatgtaagccatcgaattagaacaatcctagaagaaaaacgagaaaacaccattctggacatcagccttgggaaagaatttatcactaagtcctcaaaagcaattgcaatacaaacaaaaattgacaagtgggacccaattaaactaagcgcttaggtacaaagaaactgtcaagagagtaaacagacaatctacagaatgggaaaatactgacaaactgtgcatttgacaaaggtctaatatccagaatctataaggaacttaaacaattatacaagctaaaaacaatcccattaaaaaatgggaaacgccacaaacagacacttcttaaaagaagacatacaagcaggcaacaaacatatgaaaaaatgcttaattaacatcgctaatcatcagcaaaatgcaaatcaaaataatgagataccatctcagaccagtcagaatagctattactaaaaagtcaaaaaacaactgattctggcaaagctgcagagaaaaggttggtgggaatgtaagttagttcagcctctgtggaaagcagcttggagatttctcaaaaaactttgaactaccattcaactcagcaattttattaccgggtacatatccaaaataaaataaatcattctaccaacaacacatgcactcgtatgtgtattacagcactaatcacaacagcaaagacatgaaatcaacctaggtttctatcaacggtagattggatagagaaaatgtaatacatatacaccaaagaatactacacagccataaaaataaaccaaaatcatgtcctttgcagaaacatggatgcagctggaggtcattatcctaagtgaattaatgcaggaacaaaatgccaaatatcacatcttctcagttataactaggagctaaataatgggcactcatagacataaaaatggcaataatagacaatgaggactacaagaaggagagaaggaagggggaaaaggttgaaaaacttaactattgagtgctatactcagtacttgggtgacaggatcaatcatacctcaaacctcagcatcatacaatatacccatgtaacaaacctgcacatgtaccccctgaatctaagataaaggtgggaattattaacataaatacataataaataaaaataaaaactgtaacacactaagatattttaacgtatcaaaaaactatccttgctatagcttaactcacaaatatctacggttaaaaatcacaatagggctgggcgcggtggctcacacctgtaatcccagcattttgggaggccgaggtgggcggatcacctgaggtcaggagctcgagaccagccagaccaacatggcaaaaccctgtctctattaaaaatacaaaattagttgggtgtggtggcacatgcctgtaatcccagctactctggaggctgaggcaggagaatcgcttcaacccgagaggcagaagttgcagtgagctgagatggagccattgcactccagcctgggcaacaagagcaaaactctgtctcaaaaaaaaaaaaatcacaataattttttcaaaagataaactctagacattgtctatgtactttcaaataatgttttattaggattaataacacaagaagatcaaaagaacctgaaattattctatgaacctaatagttatcctacaaaaaatttttaaattttgaacacttctaaccaaagcagaatcaaactagtttatctgctaaacatcagcagtaaattttgtaaaagttaaatgggcctattttgctttttgaccatagttttgttcttatttaatgcacaaaaaaatactttacacattaaagggaggaaaaatcctgtagtgcttcaatgaaatttatatatttatctaatcataaaacaataaataaatgtttattctctatttggaaataaagaaaagtgtaagggagataacaaaaataacccatgaagaacaatattcaaatctggaaatattttcatgcaatctatttgactatgcttacatgtttaaagaaatagatatggatatttttgaattgaaatatactatggtatgtacagtatattttcaatgcagaaaatataattcaggcaagagaaacgcccaaaaagataatctgaatagtaacatgatttcaatctgctcacagatattaaaaatatgataacagatcattaactagactcaaatattaaaaatttataacaatttaagcagggcatatgatgagactgacactgagtcagaaaacacagtcacttctaaggaaggataagtcttccaagctgttgacctaagttcaatatcagagctaatgtttaaatgatttcatggtagagaaaaatttatattaaataactgaatgtgaaaatttctgtcatttgatgaaaattaaattgtcattccaatttggaaatgttactgatgactatgacacagtttggcatgcctatattatctgtcaccaataaagaccatcccccctccaattttctccacttgagactgtgcttacacccccatttaactttcagttaatatgaaaccttttcttaattcacctctgtttttttcatggtggccttcaaaaattatggttctaggccgggagtggtggctcacgcatgtaatcccagcactttgggaggccaagatgggcagatcacttgaggtcaggagatcaagaccagcctgggcaacatggtgaaacgtgtctctactaaaaatacaaaaattagccaggcatgggggtgggcgcctgtaataccagctactcaggaggctgaggcaggacaatcacttgaacctgggaggtggaggttgaagtgagccgagattgcaccactgcactccagcctgggcgacagagtgagacgctgtctcaaaaaacaaaaaaattatgttactgtatactaagtaccaaggtaatcataaacaggtactgaaattatgtatcaatgtctagtttgaattttctgtctctccccgaccttccaccatctctctttttaaatcatcgaaaacaaaaatccataatttaaaaaatgtaaatactgaatttttggacccaaagaatactttcaaagaactccaattagattgaagggaactatccatcattcaaaaatcattttaaactacataactaatataaacatttaataaatatttctacccagtttaagtaactgaactgaatttaaatgggactaaatcttcacatttctatatactagtccaaattagaaattttttatttcttcacagtaataaataaaagactgagaaagtagcaaaaattaaaacatactataaaagcaaaatagggggaataatgatgctaacatggaagtcagcattttccctccatgaaaaaagacaggaataaaaccgaaaaaaattttcactgaaaaatatttattgttgagaaattgctagaaattcaggtaagaatatcaggagtcagtggccttattaatgagactactcctgtcattaccaccccagtttagttggtaagaactgtagttttaccatttgggggctggcagtaaaaagtagcactgttgctttcaaacagggcaaacctattcagggtaagaaatgaaaactgcagttctccagctaaaagtggcagacttggttacgaatcaatgggagaaaccagcagctttgctagatcagagatacaggcacaattcagggggaacagcagaccagttagatatttactagggagatattaaaagagaaccatagaaagattgagataagtactccacacagacatagctgattgagaaagtacctatatccaggagacacctgggtcactaactgaaaaagggaaggcaagagagactagataagtagccacaactttgaatgcaatccctaaaaatatacagatcaacacagtgggcctaagggctgaaggaattttatcagaacctgtagctaaatcattgactgaactctaagatatatagaaacatggaaaaccctaagagtgctatggaaagaaaaagggaaaaagtaaaaatactgggcagagaaaagtcagagctgtagaccgtggagaaaacacaatctgcaaactaaatgaggcaaattatttaaaaccaaacaaaaaccaacaaccatagaaaaacaaaaaaagtctagagttgcccagttttcaacaaaaattactatatatgcaaaaaaacaaaaaagagtataacccataatcagtaaaagagcaataatcaaaaataacttgtaaggtccaaatgttagattcagcaaatatttttaaggacttgtaataaattatattcaataaatgaaaaaatagtatgttcaaataattgaatgaaacagattaacaatgagttctcaaaaaagtataaaaagaccaaatggaaattctagagataaaaaagtaccatttaaaaatcaaggaattcactataggcattcaacaggagactcagatggcaaataaagaatctgtgaattcaaagataaatcaatataaattatatagtctaaaaaacagagaaaaaaatgggaacacaaattattcaacctttagacactgtaggacaatacagtgttccaacatagatgtaacaagagttccaaaaaaaaaaaaaaaaggcacagaaaagaaacatctgaagaaatagggataaaatcttccaaaatttaatgacgaaacatttacttacagattcaaactcaataaaccaccgaagtgaaagtaacaaagtgagtcaccactaggccgggcacagtggctcatgcctgtaatcccagcacttaggctgagatgggcgggtaatttgaggccaggcattcgagaccagcctgacccacacagtgaaaccccatctctactaaaaatacaaaaattagctgagcacagtggtacatgcctgtagtcccagctacttgggaggctgaggcacgagaatcacctgaacccaggagacagaggttgtagtgagccaagaccatgccactgtactccatcctgggtgacagagggagactctgtctcaaaaaaaaaagtgaatcacaactaaacaaaccacagtcaaattgctgaaatccaaagacaatgaaaaaaaccttaaaagcatcaagagaaaaatgactgatgacatacagagcaacaacaatgcaattcattgctgtcatctcatcagaaacaatggagtccacaggtcagggagatgacagtcaagtgctaacagaaagaaaactgcaatttaagttcttatatccaggataagtatcctctaaaaatggaagcaaataaaagtattctgagatgaacaaagactgagaaaattcattgctagcaaatatgccttgtaagaaataataaagcccaccaagatgaaagaatatactgtaaaaccactaataaaagataacctttaagaagaaaactaaaatcaacaggggaattttgatccaaccaaatggagtcagcccaataaagcctctctgtcccaaatattaataaaattataggggaaaaaaacacaaaaatcaacttcccaagtactctgaagactaaacaaaagcaggtgcattgtgtaggggagttaaaacttggagaattactcatatggatagaagaatcatttttttcctttctctcttctgaatctgcccctgtttcagggctggatgtcagaagctcgggtggcaaaattctaagaaaaactatgcttccagttagagaaatctagaaattaggtcctagataggagaagtgtggggaagaatcctaaatagcagagagtaagagaaaagggttctctaaatctgtgtaaaaacctgtgataaccccaaactcacccaagagacgcatgggtgtgggacaaacccaaatcagaatagacacctttctaaatttaattaccatccaattctcagcctaattcctgaatgaagcatatgtatgtgaggaaaatacaaggcaaactagtctgtctccctggatcgaaggggaaaaaccaaagaatgaaagaaaacccaaagtagggtaagagaggtttgaaaaatgaagggacactggaaacatcatgcacagagaagaggtggaacttgcagccccacccttaccaggttgtctatttgctaaacaacaacaacaaaacatgtgttagaggattataacagggcccagagttatgctctaatgcatccaggacccacaatattcaagacacattagaagattacgcaacatacaaagagccaagaaaatgtgactgtttctcataggaaaacacaaacaacagatgtcaatgagatgagcaaaatgttggacttatcacacaaagactttaaaggagatactataattatgctttagaaaataaaggttaacaaagtctaaatgaattgaaaaagttctccaaaaagaaataataaatgtttgaggtgatggagatgctaactaccctgatttgaatattatatgttatatgcatgtattaatatatcacaatattgcatataatatgtacaattattgtcaatttaaaatattaaagaaaatagagttctcatccaaaaatgaaagcataaaagtgaaccatattgaaattttagacttgaaatgcatactatctgaaacaaaatatgcaagagatgggttcaatatcaaaatgtaaaacacaaagaaaaagtccataaatttgaagatcaagtttattatacatatcaagtttctatgcacaaactacaatctgaaaaaaaacaagactgaaacaaactaaacaaatgcttaaggagttgcctgactctatcagaagatctaatacttatttctttggagacccaaagtgaaaggagaaagatataagtgaagcaaaaattgaaaaaataagaaccggccgggagcagtggctcacgggccgggtgtggtggctcacgtctgtaatcccagcactttgggaggccgaggcaggcagatggtcaggagatcgagaccatcctggctaatacggtgaaaccctgtctctactaaaaatacaaaaaaattagtcaggcatgctggcgggcgcctgtagtcacagctactcaggaggctgaggcaggagaatggcatgaacccaggaggcggagcttacagtgagccaagatcgggccactgcactccagtctgggcaacagagcacgactccgtctcaaaaaaaaaaaaaaaaaagaaagaaaaaaaaaagaacctacaacttctcaaatttggtagtaatcacaaagaaaaccataatgaacctatgaaaggaggaagagagagatggatgcagtcaagtgtgcctgtagtcccagctactgaggagactgaggcaagagaactgcttaagcccaggagttcctgggcaacatagtaagaccccaattctaaaaaacaaaaacctaaagaaaatgtcttgaaagcaagtgcagaaatctagaacattatatttaacaaagaaagatttcaataaccacagatttctcattggaaaccatggacaccagccaacagaagaaaaacacaggaaagaaaggaaaggaaaaaggtaaggaaaaaggaaaggaaaaaaatgattacaaacacagaattctacatacaacaaaaatatccttggagagtgaaggtcaaataaatatattttcagaagaaataattaaaaattgtttctgtcaaaactgctcaacaagttctttttcagcagaagttcttctaaaggaagttcttcaagaataaacagcaaaagaaactgtaaatacctggataaaagtagaaacttttttctctcttcaattctttaagctatatataactagtgaaagtaaaactttaagctatatataactagtaaaagtaaaacttattaactgtctggaggcgcttatgtatatacagacataataaggacaattgaggcagttaaagggatctgagcagttccaagggttctatactttatttgaagaggtaaaatattaacactaggtagactgtgaaattacatacactggcatctctagagcaaccaccaaaaaagttacacaaagagataaactccaaactcaaaatataaattttgagaatatttttaaaattcaaataaaaacaacatagaaaaagagaaacaaggaatatattacactgggataaatagaaaacaaataaaatggtagatgaaaataattacaatatcaataattacattaaacataaatggtctaaacatactgtaaaaaacctgactttgtcagactggattaaaataaataaaacctacaactattctgtgtgtattagctaggtttttccagagaaacagaaccaagaggatgtgcagatagagagagagacagagattgatttcaagaagtttattcatgcaattatggaggcttggtatgtctcaactcagaagagtagaccagcaagctgaagatgtaggaaagaactgtattctcagtacaaaggcagtcagccagcctaatttccttcatccctggggcaggtcagactttgttttattaaggccttcaactgattagatgaggtccagacatattacagtggataatctgttttactcaaagtccaccaatttaacctatttatgtctagtgttccattattggaacactaagcttgtgggagttatttatatcctactgctcaaggtcattgccaagatttgattttccacaaaaaaaaaaaaaattgcaacctctggcataaatggcttaaatgttaatctcatcaaaaaaacactttcaggccaggtgcagtggctcctgcctataatcccctcactttaggaggccaaggcgggcagatcatgaggtcaggtgatcgagaccatcctggccaacaaaaattagttgggaaccaggccacacagcaggcggtgagcaccaggccagcaagcattactgcctgagctctgcctcctgtcatatcagctgtggcattagattctcataggagtagaaccctattgtaaactgtgcatacgaggtatctaggttacatgttccctatgagaatcaaatgataaatataatgcacttcaatcatcctgaaaccacccccaaccccagtttgtggaaaaactgtcttccacaaaaccagtccctggtgccaaaaaggctggggacctctgttttagaatttatgggccatatcatctctgttacaactctttgactctgttgttatagcaggaaactaaccataggcaatatttaagagaatgagagtggctgtggttatagcaggaaagtaaccacagacaatatttaaaataatgagaatgacagtgccacaacaaaattttatttataaagacaaatcattatagaagagtcagccaaagaaagcaataaaaataaaatagaaaaaataaaaatgaatatgatcgagagcaataatggaagggcagccataaacgggaagaagaccttatctactactactgtactagaagtaagtaaacaagaacgtgctctaaaatacacctttggggaaaaaagatggaagttgaaataattccctcctaataggtctaatgaagtagatgaggctgtcactgctgacaggaagagttgtaaaaatttagaattgtatctgaaggaacaaagaaatgtttaacaatgatagaagtatagatcatgaatttataataatttcaacatacaacactgcatgacatttccccaccagccaaggtttagcttagagtgtgcctacctagactaatctaggatcagaattctcaaaagcaaatctaacaggacaagggcagacgggagtttttgttagaaaccacttccagcaaatagccaggctaagaaggaagtaaacaatggcagatatagtatgacacactaggattaaaaaaaagcaagatcacaggacagaaggtaactatgaggctgaagagcattggaaagggcgatattagaaaaagaggagatagatggttttgattaaagagtaagattggaatttaaaatttatgatgtgaaaacatgccagtgataaaaaggtctaggtttttaaaacaggaatggataaattacaaagaatggcagtaagggtagcaaagttaaggaattaaaaaattacaaaatgtgaatgttaagatgagttagtcacaaggacaatgaagttattcacatgtagtgaaactgagataagactgtgaaccaaaaattcacacactaagactaaaagtataaagtatagactttccttgcccagactttcaatagaataattcttcttactagtttttaaatgtctatgatactatcttgcaattatttttttttttaaaagtggtaaaatcctatacagtaaatcacaaaatacactaaagcacatccacacaaatacaggttatatccacagaaaataaggttataaaattagatactctggcaccaaaaagaaaaaaatctgccaagcctttacataaacccttaaatcttttttctgaaattcagttattagataggaaatgtgtacaaagaaacaaacaagtatttataagcctcgtttgttttgtgttaatatggctatcatacgacctatccattacattcctaagtatggtatatactcaagataaatgaaaacatatgtccatacaaatacttgtacatgaatgttcatagcaagcttgttcaaagtaataattattagacagtggtgagggaaaataaagagtactttgtttgacagcaaaactataaataaataacaaactgtaaatttacctcttacaatgcttaactttatgtgtcaactgggctaggccatggtatcaagatagttggtcaaatatttttctagatgtttctttgaaggtattttttggatgagattaacatttaaataagcagattttttgtatgtggaccttatccagctgaaagcctaacagaaaaaagcctaactgccttggagaaagagaaaattcactcagcagactgcctttggacttgaactgcaacatcaacccttccctgggtctccagtcagcctgcctatcctatggattttggatttgccagcttccacaattgtgtaaaacagttgcttaaaataaatctctctcgtgagtgtgtgcatggacacccacgcacacactattggttctgtttccctggagaactctgaaaataaaccccttaagtataatgaataaagacactttttatcttatagagaatgaacattaaaaaataccaaataaagaatctgttatagaagatcaatgtgtgtttgagcctaggagttcaagaccagcctaggcaacatggtgagactttgtctctacaaaaaacttttaaaataagctgggcatggtggcacacgcctgtagtcccagctactcaggagactgaggaaggaggatcccttgagcccaggaggtcaaggctgcagtgacccgtgatcataccactgcactccagtctgggtgacagagtgagaactgtctcaaaaacaaacaaaaatccctgtgtgaatttattataactagataattaaattagtttctgtagctgatgattaagcaaaactagttgctaaacttttcttgcccactttctcattaaacaaaagattttaaacttccttatacgtaaaatagaggtattctgtttttgttgttgatgactgtaatggaccaaatgtttgcatacacccaaaattcttatgttgaagccctatcattagtatttggagagggagcctctaaggaagtaattaaggttaaatgcggtcctaagagtgggtccctaatccaataggagtaacgtcattgtaagaagagacacgagagagctcactcatgctctctttctctctctgctacatgacaacacagcaaggaagaggatgtaggcaacccaagaggagagtcttcaccaaacaccaacccgactggcatcttgatcttagacttcccacctccagaactgtgagaaaccaatttttgttgtgtaagccatccaatctacggtatttgattatggcagcctaagcacacaaatacaatgttgagtcagaagtgggaggtggaggaagtgacattttaaaggaaggatagagagcttgtcttggatttcaattgaacactatttaatactatctaggacctaaagataattctgctaaagaagtcaacaatacagtagctctataatagcactcaccatacaaaatattggaatcatttatctgtcttcacaaatcaaatagtaacaaatagtaacacagcctctataattaaagattcattgaaaaaaaatgcatgattataaatgggtcttaaatcttaactcatttcatgctataaactcatttcatatgtaagtttaaataatccttttcatatttaagaagctttcaaatatttccaaactaatcccttatatgaaatagattaaaaactcttaccgtaacccattcctttggtcaaaagcaggaatcatagagttagggtgttctgacattaatgcaacaagcagctgtaggacatccattagattgtcatcctataatcattttagaaattttttttaaaaaatgaggaaaaaacaacttagttgaataatgaatacttctgaaatagaaatttcaacattagaaatataagtagacatatgtgtgatatatacttatttttaacaaattatgttctttaaatgtaaacattcacctctgtaactccaaatatacataaaatagcaaaccaatttctttttttgtgcgggggggcagagtctcgctctctcactcaggctggagcacagtggtgtgatctcagctcactgcaacctctgcctcccaggttgaagcaattcttgtgcatagcctccctagtagctgggactacaggagtgcaccaccacatctggctaatttttgtatttttggtagagacaaggtttcaccatgttggccaggctggtctcgaactcttggccttaagtgatctgcctacctcagcctcccaaagtgctgggattacaagttgagccaccgcacctgacctcaaaacaatttctttgtttttttgttttttgttttttgttttttgagacagagtcttgctgtgtcgcccaggctggagttcagtggcacaatctcggctcactgcaagctctgcatcccgggttcatgccattctcctgcctcagcttcccaagtagctgggactacaggtggccaccaccacgcccggctaattttttgtatttttattagagacggggtttcaccatattagccaggatggtctcgatctcctgacctcgtgatccacccgccttggccttccaaagtgctgggattacaggcgtgagtgagccaccgcgcccggcctcgaaacaatttcttcatcaaagaaataaaataccttttatgttatattgaatcaagattttgtaaaacataacctttagaaacagtatatccaacatgacttttttttaaggaaggcttatatatcaagaaattgtggggaagggttattctctattacagaaaaatatattagagcttctaaaatgctactaaatgttgcaaatctggtggtagtggtagggctaagatattatgtatcatttcttaaacttatctgatctggaatgttttattcactgtgcctctccagaaactagttctaaaagaacactttgtgggaaatgataaccggatcattttcatatacggtattatctattgtccctataaagataaagataaccaataaatgtttactcggtcaacataccactaatatgtggtagtatttgataacatttacagaataccagcacaagaaacgagttctagacccccaaaaaaacttcatgaaaatccttcactacctttgttgcatataccaatatgtatgcatatcattagagccaacttggacaatactgacccaaaaaggaaaaggcaaacagctaacagagtttagttaacttggttgccctgactctagttttccttcactgctttggaatttttgctgtggaagctacttgtataccgaattttcattaagttaaacagatgatctggagctaggacactgaatcattgaaagtgttatttagaggacctgaaactttcctaacaataaggaatcactgtgacttccagtttatctcatataaagtactttattcagtcccttagggttaataaaaacaaaatcacatatatagatcactatgaaattcacctgaaaacttcaaatattatatttggtcagaaaaatctaaaaattaatagaattgcctattcaagaggaaaaaatatcataatcattaatgattttaagtcaaatattactcaatcacaaaatttaagccattcttttatacctgaattaacaaagagatccaatcattatccctcatttaaaaattaaagaaggcactactccattctaaaatatatttattaattcacaaggtattaattataatataggagtataaattatcatttaaaatgctgtgatgtattatattccatcaattcctaagttttactaattataggtaaaaatctaactaaaaatagatgatttagttagattgcaactgacatatattgcattttcctggtgctaaaaaataaaaacagatatttcaacctatttaattttctttttatttttttttaattacacttcaagttttagggtacatgtgcacaatgtgcaggtttgttacatatgtatacatgtgccatgttggtgtgctgcacccattaactcgtcatttaacattaggtatatctccaaatgctatccctccccgctacccccaccccacaacaggccccggtgtgtgatgttccccttcctgtgtccatgtgttctcattgttcaattcccacctatgagtgagaacatgtggtgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcactgttggacatttgggttggttccaagtgtttgctattgtgaatagtgccgcaataaacatacgtgtgcatgtgtctttatggtagcatgatttataatcctttgggtatatacccagtaatgggatggctgggtcaaatggtatttctagttctagatccctgaggaatcgccacaccgacttccacaatggttgaactactttacagtcccaccaacagtgtaaaagtgttcctatttctccacatcctctccagcacctatttaattttcaacctccttttcaaacacataattttaaataccattataaatgagctgtttaatatctgaacatgtaaagtcagtaggaagattgtgttatgaatttttaaaacctaatcatttttagtcattttcgtaatctattttttcatttgttacactggtttctggaaatacactgaaagtatgctttggtatactttattattaattcaatgaaatctaatgttagtactttttaaagcctttcatgatgattctcaagattcatcttgtggtaataaaggatatttaaataaagattgctagggcttagttcctaagtagacacatttactccccattacagttacataattactgaagatttctttaaatttttacttttaaaaaagtctaatgtagcttcaaaaattaaaatttcaaaatataaaattcatatattacctcatgcatagtcagtaggtaattaagaatggcctgtaattcatcttcctttactccagaatccttcaaaaacataatacaggtatcttacgtttacatgtaaaaaaatgtttaaagagaaattatacacatagatttgtcaagttggtcagctactataaatataaaaatataatgtaatagacaatctaaatttaaaacaaaaatttggggaagcactaaagacatcagtactccagaacatgtagaggtcaattaacatcagcttcctgttttcaacaccttatataatatgacagcctacttactaaagctacagaatcctgaagtcagcaaaaataataagtaatgataacttaaaaagtaatatccacacctactactcctctaaatacagaagacatcttttcgactgaaattaaatgtggagaatacaatgaacagtttctgaaattatcaagttaaaatgtcaagtacctaaaaattaaatagtaatctcactcgggaaaagaaaaacacactgcacttctaaatatgagctcgttatgaaaattttcaacctactctatcagtatattaatcactaaaaaagctgcaatctaaaaaaaaaaaaacaccacaagaagaaaagaaattggaaaacaaaaaacagtatgcatcaggaacgagcaacaaaacaaagacaattcaaaggacactttttttaatacatggaaataaggtatctgaatctgaaaggtatactaaaagttaggttcacttgccataatcttatgtgacaactaataaagcattataaaatcatataggaaaatactgaaaaaatattggtaacaattacatttatatattgctatcttataaaaccaaaatgccttttttagaatattaaattttactttacctgtaatagaatgaaaagggacaaaatgtgaccacttctaaaggctcatacacctacctggtacatttatacagaaatactatttctcaaaatctgaatgtcagttacaaggagcctgctaaaaatgaaacctccttcaggagtttagtgccaaatactaacagaaacatagtaaatatttgctgaatgagtgaacacacttgagctactatacaaatttatataacataaaatacaactaccaatccctaattctgcaataatttacatccatataggctccaaaaaagaaccaaaacaaacatggaaatatctttcaaagtattttccaatgtgtaaccacagtaaccaagcaaagaataaaaaaaccaagattgtatttcatgtgaaattataaccttcaatacacggtatgctatggaataagcaacgtgaactcaccttcatcactaattgcttaatgaacatcaacaagaatgctcgtagagaaagcatttctttttgattaggtcgcggtccatcttttaaaaaaatatacacatacacatttagtatttaaaggacctcaaagctgtcaaagtataaaattctcattcccaacagcttttccatgtgtttgtaagaaatataaaggtaggtctcctacagaatgaccttttatgcctctagaaagacaagtgtttaatcttacatgcactgtatacacaatatttcaaacatacaaacaggttatgttgaaactactatgaagaagtttgtactttgaataggtcaaagaatgtccaaaacataaaaatgaggtaacaaataaaatttgtattcaataataatatacgtattttaagactctgagagtattagtaaggtaacagaagtttacaaagaaaaaaacaaaggaaaatctaaactttcaacattattattatatgtgaattcagtatgacaaaatttttctactgttatcattatataagctaatacagaaatctcaaaaagaatgcctcactacacgatatcattcatgaagaagggaaatattatgttaactgcctctgacatctccttctctgcttagaaaagtccttggtcacacatggctcacattaaatcaattttcatgtctcaaacatataattcccaagtagaaagcttttgaaaccaaacactcattgttctaagatcctaagttagggacctgttttctcatatattttataatttttccaccactaatcactatttatagatagttcttagaccaccaaagcataggaccaccatgactttgaacagatcaatgaaaataggaagaaaattgtttaaaatttgttccatgtgattcctagacaaaaaaaaataataagactagagttagaagaggatcacaaaatttgtccagctctctcatttgaagaatgagactttcccaaggtcactaatcagttataaaaggcaggcgagaatacaaaactagcacctaggacagtacatgatacacctacagcaccatgaaatagtcatgagaaaattctgacccggttctggatctgccacaaccttgccagcttaaaaagttcatagcttgctaaattataggtaccagattctctgaggctaaaccaagcttattttgaaagtgatataaaaagtagtatgcaaattgaaaatctttgtaaatcactaaacaaccaaagcctcttactgcaatcagaatgtatgttattgactccccagcatctatttcttaatttcaagcaacagctcttaatttttaccaagtgactgaagtcatcttcactttcagacaatgtctttcaacttaggggatgcctccatttctaagcaatcagggcaactacaaccacaaaaatgggcacatgatacaatcaaagccaatgagcaacagagagactaaaagagactttcactggaaatacattatataggcagatgctcttacactgaatttaagttgttacggatgtgaaaggggaccggctgcttgctactacaaaggaagcgaatatgtgaaaacagccaacacagaagaattggcaagtgcagtgagacaaattcagtcctatggtcatactcagaatacctttatcaagttgtatctggaactgccagtttatatgagctgattacctccctttttgatgtaagccagttccaaggagactgttatagttacaaccaaaagagccactatatgtcaaaagttttattttgaccccttatatgaactgctagacatgatgaatgaatattaccctttcagcaagttagtcctcattatgtaagaaaataattgctaacattttgtaatttcattatctctttaagagaagcagataactcctacttctgcaagaaaccaccatattcccaaaacaccattttcaaggaatctcattgtgacaatccatctcagcatcaattactaaaaactaattaagaatttcttggcattttcagtgtcttacaacaaccatcctagtcatattagctccccaaacaactcacaccagcacaagtagtattcttccacacaagtagcaagttattaaactctagaaaccacaatttaggacaaactattaacattatcaatgagattaaaataaaattttgccataatggaatatagaaaaactgcccaaatatatgatagtactggttaaaacaaaaagaaaaattaaatcctgatttgcatttgtgtaaagtaatatacagacagaaattatatacctaatccttttggggtgataccacttcgatcctgaggattcactgcccagtagtagtacttcagcgtgtgcatgatgagaagcactgttccaactctccgaatggtgttatatatgttgactgtaccaatgaattccgtggacagataagtatagagcatcagttgaacctacagaataaaaatgaagaacttagagaaccccaccagcattttatctgtttccagtaacacttccaggctgttttattttcaccacgcttcttccaaaaagtaagatgctgagcctgataataatatccatattagacaacacatactcactgacacacaagcacatgcacacacactccttataaaaccaaaccaggtaatttcttcttttatagcagcattatcaaatatggaaactttttgctgcattattccatgaaaataactttgtgattcctatttagcaatcagcaattattcctaagcatgtgtaacttctttataatagacttattacttatgctatctatgcatagttgtttgaaaaagctagaatttctttcaaatacaacatttgcagaaaatcaggagctaaaatgactcaaaagaaaaagtactagtaactcaaaaggaaaaaataaatagaacaaaaccaaaagaaagaaaaccacagaaaaagatatagagtttaccttgaagaatattagaaaaacagaattctattacagtagctcattacaagaaacattccaatctagcattttaatcataacattataatctctcaacatgtatatcatgtcccccaattaggaaaggattctactaatctcattgaaagtaaatagtctaaaaaaatacataagaagttatatatgtttatattaacttcgaaatatctcctcttcatatgtaagagaaagaaataatacaagtgctaccccaccactgcacatttcatcttaacaaaaaattggcccaccccagtgattcacgcctgtaatttcagcatgttaggaggctgaggcgggcagatcacttgaggtcaggagtttaaaaccagcctggccaacatcgtgaaacttcgtctctaccaaaaaatacaaaaattagccgggcgtgatggtacacacctgtagtcccaggtactcaggagactgaggcaagagaatcgcttgaacccaggaggtagagagtgcagtaagccgagagagcaccactgcactccagcctgggcaacagagaccctgcctcaaaaaaaacaaattttttttcagtgaaattatgggtctgaaactcatcaactataatccattacttaaagcagcaaaaataacgactgcttttgctctactctcatgttgaaatcaattcattttattgctagagggtatattttataagctgaacaactgtaagtataggatatatattcttcccttgaccatagaccaaactactgatcatttataactgaacctttatgttaccttcctggacaatgagggcattttccttttcaaacctgcaaggtacctcagtgtcacctagggatttctttagagagcaaaaagtaggtacctatcttccaggtgccctgcaaataaacaatcaaggctaaatgaattagagtgtcagtgaataaatctaacatgctaaaaagtggcaggttctgaaccacttaaaagcagggcttggaagatcattataattcacaaaaccatatatgtatctatacacatacaatacattgtgatctactgacctgccgcaaaatgttattttgatgtagctactgctgttcaaattgataggcccaatccacttgtcattgagacaatacgacatgcctcaaattcttaaccatgttatttcagtctcttagcaaatatttacatctaactatatgcataacactgtatcatggaaatacagtggcacatatgctgtccctaagtagctgaaatacagttgaaaagattaaaaaaacacttatatttaagcaaaacaaatcaaagacaataaatatgcctaccaaaacatgaaaaaagtcatgaagcaatatgtaattgagtgacatagagctatgaaatattattaattcagaggacagataaattattataggataaactgaaatagtaaagaaaagcttcactaataaagtaggcattaagataggctttgaagatgagtagtagaatagacagacagaatacaagaggaaatttcaagctagaaaaatgatggttgaaataaaggtttccctagagttagaacaacagttctcaatcttgactgcacattaaaataactgaaaaacttttctttttttttaatactgatgcctgagtcccatcccagtgaggcaggagaatagggtctggaggcagcgaacctaaggacttcctagaactaaatcaaatggaaatgctacagctatgacaggaaatatcctctccatttacatagggcatacaccgagtaaatgactttgtaactttactgtatcctcttcatttacatagggcatacaccaagcaaccaatggaaacctctaaaggttatttaaaccccagaaaattctgtaacagggctcttgagcccctacgctcaggcctgctcccacagtgtggagtgtactttcattttcaataaacttctgcttttgttccttcattcttcccttgctttgtgcattttgtccaatcctttgttcaagacaccaagaacctggacactctccacggataacaccagattgatgaaatcagaatctgcagtggaagtggtgggattctatttttgcttgtttttaaaaacctaccccaactgattctatcagcagtcaagactgagaaccaccactgtagggaaaccttttggtacctccctatccactgaggatatttccatttttaagctagaaaatctagaaataagaattgacatgaaatccttagataaaggactaactacttcgttctgagaacaatgggaaaccattaaaactgctggggctaagaaattataagagtcatatgttaggaaaatattggcgttgggcatggtagctcaagactgtaatcccaacactttctggggctgagagaggaggattgcttgaggccggaagttcgagaccagcctaaacaacaaagcaagaccctagtctctacaaaaaaatttaaagagttagctgggaatggtggcgcacacctgcagtatcagctactcaggaggctgaggcaggaggactgattgagcccaggagtttaaggtcgcactgagccatggccatgaaaagaacatgttggaattctggcagaatagttataagttagacaaagaaatggaaaactggagaaagtcagtctattgagaatgatactgtggtaaaagaaaaatgaacagaggctgggcctgatggctcacacctgtgatcccagcactcttggggggctgaggcaggtagatcacttgagcccaggagttcgagaccagcctgggcaacatggcaaaacatcatctctacaaaaaaatacaaaaattagctgtgtgtggtggtacacagctacagtcccaactactcaggaggctgagatgggaggatcacctgagctggggaggcagaagttacagtgagctgagatcccaccttagtgacacagtgagaccctgcgtcaaaaaaataagtaaacagaatttagtagcaacgtatagagatgaatgaaagacctcaagattactcatatgctaattatgaataaaccttccctcattcactcattatgtactccaatagccacacaaattgtgtgttaacatctgtctttcccactaaatctaaattctatgagggcaagtatcaagtctatcttgttcatcaccatatccacagtgcccaccataaagtagtcactcaacaaatatttgttgagtaaatgaaggaccatggtagacaagaaaattcatctctcctgctaggtcattaaaaagatgttctctgaacagatctaagataaatggaaattataaatcgctggtagctcccttttccaaaagcaaagcttttcacatccacacatccagaccttcaacttttaaccagaggtggattgaccacgaagctgataaagcttcaactttatgaccactgatctataaatgtttcttccaagaccctaaacctaattttgtatgcattatattgtattcttcttcttaaaaaatttcccacatgataaacatttgaccttcaagtcaaacaaaatttggatctgcccttttttatgactgtctttacaataaaataaaagcagataaaaccccttgtggatacataaagcagatggctaaaacaggagaaaatgctaatattatcaactcaactgcaaattctaaaaaggaaattgagaaaagttattaaaaagtagaagataagaaatagagtataataatactaggaaactaagaaaatcataagatgaattttttttaattcccctccaactaagtatctaataagaggctttctgaccacatcaaaagagacacaaagccttacaaatatgctgattagtaagacaaaaaagtatctagtaaaagattttaaaagtaacttgaaacaatcctcaaaaagaagtaagactgagggtcatggaagaaaatgaggtcaaatttgacctggagataaaaagctacaacctccaactgcctgtttcgattatttccaaatggcaatcagagtcagcagctgtttttctctttaacatttgaaaagaccagctgaaaataaaatattaagactctagaaaagcaaaaaagtctgcagacttttttctgacaactagaataagtaggtgctattccaacttaaacaatgataaacactgcaagtgggccaaaaggcagaaggggagagaggaaaactgggcttgaaataacacgacttctaacaaaaattgtagataagacggatacaattatgcaatttaataaaatgatctgtttcaagttatgcttaatactgccactactgaatttttaggacaatgtattacaacactaggatttattaaagattttgttcatataccttaccacaaattcatttacattcacatagaactaattggtttgttgttacaaaactgaaaaaaaaaatttgtacaaatgttttcataatttgaattaacgtgaaattaaaatgattacgagactagtatatcatgccttcaaagaaaaagtgacatttcagtggtacctataagaatgaaactcagtagttcatcatgttggaaggcaaaagtgtgaagtaaaaaagagagagagcaggagcagggtgagttcttaagaaataaaaaaaaaagaaaaaatatatatggatatttacaatggaacaaagctacagttactaggaaacattaataattacattaaaactgtctaactttgatttatatttagtaaatgaagtctctcccaaataaaactttatttcatttaatttcagaaaacaaagactatacctgtatcttttaaaataatgatattgtttacaaagaatatattctttgtatgtatgtatatattatttgtatatattcatacacacacacacacaatttgcaatttttcctgaagagtaaaaaaggatgcttagtcaaaaaaagcaatccactgaagtcttgcataatagtacataaaaaaaagaaaatcctcttaattatcactctcctcacgcacaaaaacagcaaagatagtaaaacaatatcaatatatagatatatattaccttggctggggtatgaatccatatggcaggattaagaagaacgtgatcacacaattgcttgagcaggggcatcccattctgcagattactcagatattttgaaaatgcaaggcaaagttcaagtactgctctgctaacatgagatttggaagactgcaaaaaaagtagttcaaatgttaccacaaattcaagtcaaagtaagtgaattacaggctgtccctaccaggaaaaaaactggcccacaaattatgctcaaagttaaagatgccatgaagctcactatcacatttgtttgatagaggaatggaggcaaggtaaaacaacaaaatgttattttagtttaggtaattttctgtaaccaaggagacattcttgcagacagaattccttagccacttagagaacaaatgtatggcctgtaaattaagaatcaaaaacataaaatatttcatactttaccttttcaaggctatatcctattaccaagaagcccttacaggcaagcatctgttcctgcatagcaattgagttcttcaacaattccatgataaaggccagcaaggttgaactagaattttttaaaaaggcgatgattaaaaaaacatattctattttttttaaattaggttagatagatgtaacccttccattcaccttaataaaaagttctccatttcaaagaaattgaagctccactaaaactgcttccaacattacatcagaactagatttttaatgtaggattaggagttactcagatatttatttcatatactttatctcaaacacattgataggtgaattacttagaaacaatgacaaatgttcatgatatagagaaaaatgagcaacttccaaaaacaaccaataacaaatacttattaaaaatacactaaggccttaaagaacagatataacttagataagcaagtatattcaactttgaagcgttaggggccaaaaggtgagaaaagacagtggagcaaacagagtaaggtgtaaatcctcaaaatgtgttagggctccagacttgcatagtctgaatggagcagagggcacatgaagagaaagatgagacagttaacttggaggcaaacttgagctccttgaacactaatttaagaagtttgttcattatcccaacaacaaaattgtaattctccagtcagtctcgaacacttttaaaactgaataggggctacagccatgctctactacctacaatttttaaagatccccggaaaggaaaggaaaaagatcagttgttactgccttctcagagagaagtcccacaaaacaaaaaaaaagagagagagagagaaagcatgaccagcagccaatctcctcctccacatcagtgctttcactgccagcaatttcaatacggggggaggggggagggagagggagaggggagggagggaagagagaagggggggagaggggagggagggaggagagaagtgggggagagggggaagggagggagggggcagagaggggaggaaggggaagggggagggaaggaagggagggagggaggaaaactgtaagtaaaccctgttagaacacagcacaaaacaattccataaagtattaatatgtcagggtaatttaattttatattttttaaaatataagttgacaaatactagatttgataactttttatttttaaaaaaattgttgcctgaaaataatgaggacaattaccattattatacacactggtggcagacatcaagttatgtataaaagcaaaaatcaaagggagaatttcaaaatgagagaatgtaaaagtatttaaatttctcaagtaacaaatgaaacaataatttcaatacaaatgaaacaataatttcactatacattgtttcactagaatatatagccatgagaaattgagactcctttcctacattttatgacttaccctataacttatatccctttcttttttagactcaggactacaacacaagagacaaaaatgtgctaaatgtacaatctaatttttttcaaaaagactaattcacttcgataacactattaaaattttgacttccaattacataaatgcaatcagtaataaataattaaaatatgaaaagttaagttccataataaatcattaccaaataattttaaatatttcagaaattaaaaatttcttattgcattctgagtaatgggtagtaaaaaaaatttttaatttagacaaaaaaatgtatttatttttgagtaacccattattgccatttataatgttattctaaaaccaatttattgtgtttcttacagcttccatatttcctactgataaacaagaacttaagttaatactgacataattaatatggacttgtaatacagtttatagttcacaagtttaaattattttgacacaacaaaacctgaaaggcaaaatattgtatagctcaacagtgatgaaattaaccctcacagccaattaaagaaacaaataaaggcactcaccatatagtcaaatcaatctcatcagacaaatattgcctgtaatccaactgtgcaaaaagtggaaatagtacttgtactcctccaattgaatgcattgcactttggatggaatgtgttaaaactgcctttacatccttgtaagatcaaaaacacagtaaagagttcaatgattttttttccaaaacaattaaaaataaggcacaacaataaatgcagaaacactataaacgtgacattccatgtgtttaacagaagctaccaaatacatctcaataacacatcaaaaattaccattataaatgttcttaaaagatcacagttagtacctggagcatgagtgcatgtggtgaatgaacaaaaattgaagggttgtccttaggagatgattcaagacaaagctgggcatctgtagcccgtggattgtacgtgaatgcaatggcactagagagtttcccatcgtacaataaaagtttgtgatgctcagcaaggaaaaggtcgctttctgctttgaatttaaatgtaccctaagaattaattaaaaacagttaaatagtatgccacaaagagaatctaagtacaaatcaacacaggtgtaaaactttaaggagacagaccattgataatcttttaacagtattatataagaggacccctcgtttacttctaaaattggctgaatttaaagatataatggaaatcaagtcaacttgacattaaaaccttaccttaaaaatgtagaagtgaccaatagatcatattttatcttttttcgtatattctttttttaaaattgtgatcaaaagcatataatatacaacttaccatcttaagtatttttaagtgtataattgagaaacattaactgtattcatattgttcaacagcaaatctctagaacttttatatcttgcaaaactgaaactctgtagccatttaacaactccccatttcctgctccccaccagcccgactatcacaattctactttctgtttctatgagttggactcttagatacctcgtataagtggaatcatacagtatttgtctttttgtgacccaagcatttcatttagcacaatgtcttcacagttcctccatgttttagctgatgacaggatttccttgttttttaaggttgaatatggtcccgtgtgtttatgtgtgttgtctgtcacattttctttatccattcatctgctactggacatgtgggttacttctatctctgggttatcgagaatattactatgaacatggatgggcaaatatctccttgtgaccctattttttgtgtgcaaatacgtctctgtgatcctcttttcaattattttgtatatatcccataagtgagattactggatcacatggaagttctatttttaattttttgaggaacctcatattgttgtccatagcagctgcaccatttttcattcccctcaacagtgcacaaaggtaccaatttctccacattctcaccaacacttgttattttgttttcttttttaagtagtcatcctaaatgatgaggcaatagctcgctgtagtttaaattagcatttttctaatgtctagtgatattgagcatcttttcatatgttcattggctatttttatatcttctttaaagaaatgtctactcaactcttttatgcatttttaattgttttgttattgttgttgttgttgagttacaggattcatatattctggatattaactccttatcagatatatgattgctaaatattttctctcactctgtaggttacctttccactctgctggatatttcctctgatgcgcagaactttataactttgacaacatcttatttgtctgttttggctttggttgcctgtactttcggtatcacagtcaagaaatcactgccaaattcaatgtcgtaaagcttttcccttgtgtattcttttaggagttttatagttttacatcttacttttaggtctttaatccattttcagctcatttttatatacaatgtacaatatgaattaagtataaaacttttctttcttatttttcgcatctggatatccagttttcccaacatcatgtgttgaacacattgtcctttccccagtatgtggccttgcctcacttgtcaaagatcatttgaccgtatatgcaaaagtttatttccggacactctattgtgttcccttggcctatgtgtctaagcaagtctaacgttgttttcattatgtatcatagccttgtaataaattttgaaaccctgaagtgtaaagcctgcaactttgttcccctttttaaatactgttttggcttctgagaatcccttgagattccacattaattttagaattgtgcttctatttatgcaaaaaatgccattgggattttgataagaactgtactgaatctgtagattgctttaggtagtatggatttttagcatattaaatcttccaagggatgtctttacatttgtttcggtctcttaaattttgtcagcaacattttgtacttttcaatgtacaactcttttgcctccttggtggagtcagggtacagctcttttgccaccttggttgagtttatttctaagtattttatccttgttgatgctattgtaaaagaaattgtttgcgtaattttcaaactgttcattactacttcattattactaatagaaacacaattgatttgtgtgtattgattttgtgccttggaactctgcagaattcatttactagtcctaacagttttcagtgaaatctttaaggatttttagatataaggtcatgccatacgccaacagatgattttacctcttcccttccaatttagatgccttttctttttcttgccaaattgctctaactggatttccaaatactatgttgaatagaaatggaaagaataagcatccttgctttgttcctgattttagaggaaaaactgtcagtttttcactgttcagtattgtgtcagtcatgggcttttcatatacaatattttattatgttgaggtagtttccttctattcatagattgttgagtgttttaggttttttttaaatcaagaaagagtgttgaattttgtcaaatccttttctgtatcagttgatatatgatcatatggattttgtaattcactgttagtgtggtacattgcattgactgatttccatgttgaaccatctttgcattccagaaataaatcgtaatttgacattgtgtataattcttttaatgtgctgttaaattcaatttcttagtattttattgaagatttttccatcaatattcatcagggatattagtctatagttttctttcttgtactatcttgatctggctttggtatcagggtaacactggcctcataaaatcagtttgaaaatgttccctactcttaaaatttttgtaaatttgaggagaattggcattaattcttctttagatgactgagagcattctccagtgaagccatctagtccctggctttctttgttgaaaagttttttattattgattcaatctccttactagctataggtcttttcggattttttaaatttatttttgattcagtctcagtaggatgtatatttctagaaaattgtccatttcttctaaattatccgatttgttggcatatacttttcatagcattctcttataattctttctatttctgtggcaagttataatgcctcctccttaatttctgattttacttatttatgtgctcttcttttttccttagcctatgtaagaatttgtcaattttgctgatgtttaattaaaaaaaaaactgttagtttcactgatttttttctcactgcttttctattttctattccaggggtccctaaccaggtatatgacctgttaggaacaacagcaagaagtgagcggtgggcaagcaagcaaagcttcatctgtatttacagccactccctaccactcacattactgcctgagctccacctcctgtcagatcagatttttatagaagggtgaaccctattgtgaactgcacatgcaagggatctagattgtgtgctccttatgagaatataatacctgataatctgtcactgtctcccatcacccccggatggaaccgtctagttgcagaaaacaagctctgctttgtttcccactgattctacattatggtgagtcgtataattatttcattatatattacaatgtaataataacagaaataaagtgcacaataaatgtaatgcacttgaatcatcccgaaaccatccctgctgcgcccccaccacccgtggtccatggaaaaactgtcttccatgaaactggtccctgggaccaaaaaggttggggactgctgctctatttcatttatttctgctcggatttttatcatttccttctatctgctaacgttaactttatttgttgttctttttccagttccatgttgtataaattaggttgctgatctgagatctttcttttggtgataatgatcagtcattatcaccataatcttctctcttagactgaggtcactgaatctcgtaagttttggtaggttgtgcttacattttgatttctctcaagatattttctaattttccttgtgatttatctttgacccaaaggctgttttaagtgtgttgtttaatttctacattaaacattttctacattaaaaacttggtggactttccagtttttctttggcaactggtttctagtttcattttattgtggtcaaaaaagatacttggtataatttcaatcttaactttgttgacacttgttttgtggcataacacatgtctatcctggagaatgttctgtgtgtgcttaagaaaaatgcaggtcaggtgcagtggctcacgcctgtaatcccagcactttgggaagccgaggcgggcggatcacctgaggtcaggagtttgagaccagcctgaccaaaatggcaaaaccccatctctattaaaattacaaaattagctgggtgcagtgccacatgcctgtaatcccaggtacttgggaggctgaggcaggagaattgcttgaacccaggaggtggaggttgcaatgagccaagatcatgccattgcactccagcctgggcaacaagagcaaaactccacctcaaaaaaaagaagaagaagaagaacaatgcacattctactgttgtttcatcgagtgttatgtatactactgctaaatacattgggctgcattgctgttcaagtcttctgtttacttattgatcttctgtctggttgttctattcattattgaaagctgaatactgaagtgtcctactataatggtgttgctatctacttcttttaattctatcaaagtttgcttcatatatttgagagctctgatgttaagtacatatatttgttctatctttctggtgaactgaccctatcatcataaaatgtccttctttgtctcttttgacagtttttgacttaaagtctattttgtctaatttaagtaagctactcctactcttctctggttaccatttgcacacatctctttatttgtgggtacattttaggtgtatatatttatggggcccataaaatgttttaatacagtcatgcaacgtgaaataagcacatcatggagaacagatatccatcccttcaagcatttaccaatttagttgaaaaccatccaattacactatttcaaaatgtacagttattattgactatagtcaccctgctgtggtatcaaatagtaggtctcatttttcttttttttttttgtatccattaaccaaactctccatgtataacccaccttcaaatcaagctgaactaacattggttaagcacaaaacagtaagcaaactaccttgtatcccaggcccaactgataaatagcaaatatctgagctgcatttagagcttcactgaaaaggtaaactgcagtcatctgaccacagaatactctattagcatctgctgtttctgatgagcccaggaaacatttgtcaaaggtctgtaaaagaaaaaaaaaaaggaattaggaaaaaacaaaaaaaaactccagaaataataaaaacctatattatcataaatgttttgtccattctaaactgtatctaaatagactaacataatttataccataaaaccattagaaagaatgttgaaaaatgtgtatgtaatgacattaggggatatagaaaagtttgaaacacatgtgttctcaagccaaacaacctagatcaaatccctgcatcctatgccactgagtatggcaagttacttaacctctttgtacttcacctatctgtaaaatgaagattataataatgcttatcttgcaaggttgctggagctttttgaaaataaagctatttattacaatgcctggaatacaaaaagcactcagtaaaagttaatgtaagaaaaaacaggttacaaaacaatacttacatatgagcccttttttgtactaaaaaagagctaacattgagcactcattctgtataaggcgcgctgctaatagatttatggatattatctcatttaatcagatgacaactttctgaggtatgaatattttatgtccattttcaggaggaaaaatgctaaggcctaatagattaggtaaggtcatgcagtcaataaatgacagagctgagattcaaacctaagtctgtctgattcaagaccctgatctcttgaggttagcattacaaaatatgtatatatgtgtagcaaaggatatgaaaagaggagttaatggtgtgtgggtagtgtactttatgttcattttcctggtatttttcaagtttttataaaaagaacataattacaggaaaaacattttaaatttcattctaacctatagatttatttttgaaacctgtaaacgttaacaacatactagttaactatagcagttagaattatatgcaagatttataagcatgcatcatttaactcattcagaaaaatgatcagaaccctatagtggagctcttgttcattttgataaatgaaccaatgacccactccccagatatagccactgttagctataaatccttatttctacctatatggaatgattttataacaaggactaatatttcagtgacatattaagttctattaacatgctagccaaattatgtttataaaaatctaccattgtaatactttgaattttatattcaagttgtaaaactttttcttgtttaaaaagctcatgcttttaaaatcacttttttcattgcaacattttgaaactacttacatcgctagtgttgacaaaccatgttatctctccataggaagccagctcaccattcacataacatcgaagttcactattcttccatcggttatagatgtgtactatggtaaccatataccactgcagaagcaaaaaacagttaaaaatacaaagataacaattatcccaataacgcaaccatactgatgagtaaaagttaaatgataagttgtaattcaacctaaaaataaaacaagactacctttgttaaattcaatatttactttctggaacaatatctattcatgggcctttcaactgataagaacttaatcactagatcatttttccagctttttattatggaaattttcaaacataccccaaaaatctgaaaatcaagtacaaacaccccctttttccaccaactagattccataattgtcaattttttgccatatttgcttaatctatctgactacctatctacttatacattttgttgatgaaccatttattaacctctaaattttaaggtacaaaagcaaacacatattaaatttgcaatactaaaataaatgccgtagatatttcctacttgtatctcccttaatctccataaataactaaatttgcaatctttttcatatccaaatcagagaggtcaattattcagtgatttacgcttcatctttttaaacagtaaaaacgaagttgtgctttagcatgttattatatgaataacattaaaacaaagcattttgatgactagcatagcttgttaacataactatgactcaagaagatcatgtaccttttgtggcttgaaatcaaatttcacacagtgttgaaagccttttccttttgactttattgatgttacaatcaaacagcctccaacaaaatgagcagaatagccaagacctttgctggttctgaaactataaagaatagttttcattttacctctaaatattcttctcagtttcaaagtaaggttttaacactaatcagttacagaaatacataccaatacaaatatggtttatccttatctacattgatgttatttacaggatccattctaagccatgtatgaaatgtaaaaccattctggtatggccatttggctataggaggtaatgcaatagcctaaaggaaagaaactttgagttattaactcacgtgaaaacctgtcttattaaaatcatgaaaataagactttgcaatgctacatatatttgtactacatcacattactttatgtcacaattaaaatatctgaggccgggcgcggtggctcacgcctgtaatcccagcactttgggaggccgaggcaggtgcatcacaaggtcaggagattgagaccatcctggctaacacggtgaaaccccgtctctactaaaaatacaaaaaattagccgggtacggtggtgggtgcctgtagtcccagctactcgggaggctgagacaggagaacggcgtgaacccaggaggcagagtttgcagtgagccgagaccacaccactgcactacagcctgggcgaaagagcaagactccatctcaaaaaaaaaaatatatatatatctgaaagaagactctttatctggaagaagactctttatcaggaagaagacttttagtaactttttaattttccctaatacatagtaatgttaattaaatgaaaaaaaaattcagtgtaacctggacacatgaatcttgtattcttcatttcttaaaatgaacgtatccacagagattctaattaaaagagataggaagtgataacaaattggaaatttgatgaaattttaaggtattagaatagagaaagatggacaggaatggaaagagagaagagaaaaactgggtatatgctgcttttataaaactacaaatataaaactgaagaggattagttcataatatttttaaattatattcagaagtcaatatacaaatggctttaccgcttggtttagatttttatttaaaagatcatactacataataaaaggatcttgtatagccaaaacaatcttttaaaaagaacaggccagatacggtggctcacacctgtaatcccagcactttgggaggccaaggcaggcagatcatctgcggtcaggagttcgagaccagcctggccaacatggtgaaaccctgcctctactaaaaaaatacaaaaattagccatgcgtggtggtgggtgcctgtaatcccagctactcaggagggtgaggcaggagaattgcttgaacccaggaggcagaggttgcagtgagccgagatcatgccattgcactccagccagggtgacaagaacaaaaatctgtctcaaaaaaaaaaatgaagaagaacaaagttagaagactcatactaccatttcaaaacctaccattaatataaagcaacagtgatgaagactgtggtattagcataaggccctggtgtcctttggttaggcaaatccttcttattatgtcaccaaaaggacaagtgacaaaagaaaaaaatatatacattggactttattaaaattaaaacctgtgctttaaggaacaccatcaaaaaagtgaaaagacaagccacaagaatggaagtaaacatctgcaaactgaatacctgataaaggacttgtaaccaaaatatataaagtactcttataactcaataataaaaggacaagtaaaattttaaaatgggcaaaagatctaaatatacatatctccaaagaagatatacaaatagccaataaaaatataaaaagatgctcaatatcattagtcataaaggaaatgcaaatcaaaactacaatgagatatcacttcataccaactaggatagctactaatacaatcacaaagacagatactggccgggcacggtggctcacgcctataatcccagcactttgggaggctgaggcaggtggatcacttcaggtcaggagttgaagaccagcctggccaacatggtgaaaccctgtctctactaaaaaatacaaaagttagctgggcatggtggtacacatctgtaatcccagctactcaggaagctgagacacaagaatcgcttgaaccgggaggcagaggttgcagggagccaagatcacaccactgcattccagcctgggtgacagagcaagacttcatctcaaaaacaaacaaacaaaaatagacattaaccatcttagcaaggatgtagagaaatttgacccttatacattgctgtgggatcgtaaaatgttacagctactttggaaaacagtctggaagttcatcaaaatgttaaacaaagaccatatgacctaatctagagattgggacaaattaaaacatatgtccacacataaaattgtacactaatgtccataacagcattattcatactagcccaagaagtgaaaatcccaaatattcactagttgacaaatgattaaataaagtatggtatatccatacaatataataccagccataaaaaggaatgaagtactgatacatgctgtaccatggatggaccttgaaaacattatgataagtgaaaaaagccagtcacaaaagaccagatgttgtatgattccactaatatgaatggtccagaatagggctggggaatatggggagtggctgctaatcagtatggggtttcttttgggtgtgatgagaatgtcccaaaattgactgtggtgatggttgacaactctgtgaacacatttacctactatactatatactttaaatgagttaattgtgtggtatgtggattatatctcaataaagctgttttgtaaaaaattcaaactgcacaagtgtctgttttattgtaacttacatatgcatttatgtatacatattatacatatattcttttatatgtattagataagacataaaacatgaaagacatcatagagccaaacttcagtaataacactattgagacttcaagagtgaacgttgcattaaacgttgcattaatgcaaaaatgaacgttgcattaagaaaaaaggaaaagaataattacaactcacagactgacaaaaaaaaattttaggagaaaaacatatattcagtgcgtacacatgttctctctcaccaaaaacgatagcaaagatgtaaaagctttgcaaaaatactttattcatgactactttaaattcccagtaaaagctatgtttaaggaaaggaagtcactaaacatatttaaaacatctattctcttcaagtttcaaaagctgttcagctcacctgccctactttcaagataaatgcatgcactgcaatctcagaactgtaaataataaaattataacatgaggcatgaaaaaggttaatctcataagaacactttttttaatgttagaggcaatgataggctatgataagaaagtaaaattattctgaaaagctacaaatctaaaatcgactgtaaggaaaaactgtaaaggaaaaaattgggcaataaaacttttcaaagaaagttgtatattgtgtatataacatttaaatatcacaaatgtcatattaaaacatattcttatctttctgcagatactgccaggctacacagggcctaatataagattttatgagaactaacataaaaaaaagaatgaaagataagctcaggaaaagaatagactgaaatatcttttttaaaagtttgtcttgggccgggcgtggtgactcatgcctgtaatcccagcacttcgggaggctgaggtgggtggatcacctgaggtcaggaattcgagacaagcctggccaacatggcaaaaccccgtctctactaaaaatacaaaaattagtcaggcgtggtcgtgggcacttgtaatcgcagctactcaggaggctgaggcagaagaatcgcttgaaaccaggaggcagaggttgcagtgagccgagatcgcaccactgcactccagcctgggcaacaagagcaaaactccatctcaaaataaaaaaaaagtttgttttgcttgtaacagactgaccaatgtaataatgaggagattttagaaacttccataaataacatatatacattatagaatgtgcttctataacattacgaaacattacagatatcactattatacataattgtcttatgtataaactgattaacggcttacaggaacactgagaccaacataatttggaaactcacaagtcaaggaaaacttgcgtagtaagtttcagagcctctatttcttcactatcattctatacacaaggtacaaaaaaaaagacaggtagagtaatgaaaggcaagagaaagatgttcacaaagatagacatgaaggtgttacacacaaatagctacttaagacaacatggctatgtttaaaagaatgaggttcttattccattgctgacccaagctgtgactgggcattttctcaactaatttaagcctctatttcttcacctctaaagcaattacaaaaaagtaacatgcacgactatcataaggattaaagtatgttgagcagaagtttctacctagcacagaacctgtcaggggtgttcacagggctgtactttcagggagcaaaggaaagaagaactgggagtgatttcctcattaatatttacttactgcagcactctttcctggaaagttaaaaaaggcatcaggaccatacttctgaggcatatgctttaacacagacagcaacttcccagcatgtggaggctatgaagataattaacaattcattaaccacattatttaccataagataaaaaaaacacatctttaatatagtcttgctgtaatatatacaggaataatgctataaggttaaaagcatagaaaataatttctaagttattttcaaatatcttaaagaaataatgtactctacaccagtttttgtaatgctgtagggcctattaggtattcaataaatatgagccagtatcattagacacctgaaactcttctccaagctgcagcaaaaatgatcttttttttttcttttttgagatggagtctcactctgccacccaggctggagtccatgtgcagtggcgccatctcggctcaccataaactctgcctcccagattcaagtgattcaccagctgagtagctgggattacaggtgtgtgccaccacacccagctaatttttttttctttcgagatggagtctcgctctgtcactcaggctagagtgcaatggcatgatctcggctcaccgcaacctccgcctcccaggttcaagcgattctcctgcctcaccctcccaagtagctgggattacaggtgcacgccaccacacccggctaacttttgtacttttagtagagacggggtttctccatgttggtcaggctggtctcgaaccaacctcaggtgatccacctgcctgggcctcccaaagtggtgggattacaggcgtaagccactgtgcccggcctatattttttgtatttttagtagagacagggtttcaccacgttggccagactggtctcaaactcctgacttcaagtgatccacctgcctcagcctcacaaagtgctgggattacaggcatgagccaccacacctggccaaaaacgatcttttaaaaatataaactacatcaatcccccacccacccttctttaaaattaaaaatacttaataatttaacaaatacttaaataatgcttactatattccactgttaaaggtacttcaaaaagatacttgcacatgcatgtttatagcagcacaattcacaattgcaaaatcatggaacctacccaaatgcccatcaatcaacgagtggataaagaaactgtggtatatatatatatatatatatatgatggaatactactcagccattaaaagaaataaattatcagcatttgcagtgacctggataagactggaaactattattctaagtgaagtaactcaggaatggaaaaccaaacagtgtatgttctcactgatatgtgggagctaagctatgaggacacaaaggaaaaagaaagatacaatggactttggggacttggggtaagagtgggaggcgggtgagagataaaagtctacaaatatggtgtggtgtatactgctcaggtgacgggtgcaccaaaatctcacaaatcaccactaaagaacttactcatgtaaccaaatactacctgtaccccaataacttatggaaaaataaaattaaaaaataaaaataaacatttcaaaaaatggtacttcaaaaacactaaaatattttaacctcataaccaccctatgggatggtattattatgattatccgcagtttacagaagaagaatctgaggcaggggaacatttccaaagtcacatgggtaataactgtcaaggtcaggatgagaactcaatcttgactccagagtccatgcttttaaacaactatacagatgctcctcaacttacgatagggttacatcctgataaacccacagtaagttgaaaagaatgtaaatcgaaagtatgtttttgatccaaaatattgtcaacttaagatgggtttagccggaggtagccccatcctaagtgaaggagtatactgaatgcatatcactttcacaccatcgtaaagtcaaaaaaaaaaaaaaacaactatactttcaccattaaaatagggaccaaaacctttaacatggactataagatactttatctacttctttagcctcattttgcttcttactctccccttctccctgcactccatccttttttcagtcttcttcccacaacagggcctcagcaaaagctattccttatgcttaaaatgttctcaaaaggacccctgtactcccctcttatccaagtcaatcttacccagcctttagagctcatcttaacagtcacttcctcagggtagccttccttgaaactgagagtggattaaacttccctatcatatttcattctacaatatacctttaccgcatagcatataaatatatgtatacgcatagcatatacatataaaagctgcaacgctgagtttatttgattaatgtttccttggtccacaagtctctaatacatgaaacaaccaacaataaaaatgaaaaatctcatttgcagttacaaggaaaaacaaaagataatcagacatactatctcattttaatcagtttataaccaaataagaaaagtgtggggcattcctccttgttaaaaatgtaaaagttcaaaacagggtcaaactacaaatgaaatcattggtttgccttcatcttatttttatagatgatataaattataattactacctgtgtaaaagagtttggcaacctttcacctaaatattaagtggaagcttcattcttaagtgaacaagaaattttcaattaaccatactgctcaattgtaaaagcataataacaagtaactacaatcacagtgattttttaaaataaattccaaagtaaaataaagtaaccaaaaataactctgcagttaaaaataaaaatacagtattatagcatgtccatctagaaacatcattcctccaaatttcctttcctataaatcagtcaacaaaagaatacattaagataagcactttacttgacagacattgctgggggagtgtatactgtactggtaaagcctttcagaaaaaaatttagtagaccaggcacagtggttcacatctgtaatctcaacactttaggaggccaaggtggagggatcgcttgagcctaggggtttgagaccagcctgggcaacatggagaaactccatctctagaaaacaatacaaaaattagccaagaatggtggcaagtgcctgtggtcccagctgcttggaaagctgaggtgggaggattgcttgacccaggaggcagaggttgcaggcagccgagatagcaccactgtactccaacctgggtaacagagcaagactctgtctgaaaaagaaaaagaaagaggaaaagaaaaagatgtagtagtcatatttcaagagtccgtaaagacgttcatgtccaccaatgcaatatttccacatgtaaaaatctatgctaaagtaatcaccacaagggcagacagagatttagatatagggattttttcactgcactgctataacagcaaacgatagaaataatatgcctaatattaaataactaaataaacgtaatgagtatctgagcaaggccttgctctcattttataaatagttcattattttttccctttatcatctaaaactattctcattctcctccccctccccataggcaactatattaacatgtttaatcttttttatgtagattattccttcaaaaataatgtttggggctgagtgtggtggctcatgcctgtaatcctagcactctgggaggactgcttgagctcaggagtttgacaccagcttggacaacatggcaaaacccagcctctaaaagaaatgcaaaaattagcctggcatggtggcacatgtccgtggtcccagctacttgggaggctgaggtggatctcttgataccaggaagctgagaatgcagtgagccatgatcacaccattgcactccagcctggatgagagtgagaccctgtctttaaaaaaaaaaaaaagaaaagaaaaaaaggtttttatgtgcttacacttatcattgctttctttcctatatattttacatctattcctattactccatgtactgattctgttatagaacaatctaccttctatacattttaccaatccactctcttaatgatgaacatccatgttaacattcactgccatcaaaaataatgcttcagtgaacatcctcatgtattttatggatctatgtgagaatttcttggaatacgcactcagaagtgaattattaaatcactggatacaggtaaaattaacatgactaagtagcactagactcctcttgaggttggctccactggtgttcattctaatgaaaagcgcaccaagtataaaataaccctatatcccaaactatacttgccattttccaactttaaaattcttgagaaactacagatggaaggtgacaatatcaatactgttttaatgtgaatgtctctaattattaatgattttgtgttcatttggttgtggggtttctacctctgtaaataaatattagttcatattatttgctattttcttacctataattttctatgcttatgaatataataaaaatacattacatattcagaataaataatgtgaatataaataaaaaccaaaatcaaatatatactttctcttctggacacgacatattaataggacctggacttaccaacctaccataaacaactagaaaagtgggcaaaatgtatcaaacaaaaacagttttcagtatgcaggaagaggtagctcaagactgtgttccctgagaaaacaaaatgacttaaacctggagtcaatttccatatcattgcacagggaaaccaaacagaacccgaaagtctcagtgagttggaaagaaagtggagtccacagaagatagaagtttcagagaagaatactagggaggaaagaactgaacagacaagaagctccagaaatctgcattgactctttgacttaataccagactgatcatgcttatgataaaactcaacatggtggggctaagatagtaagagctttaagttaaagaattcccaaaactaatacagagctaggaattgttgagaccctactagacacttcggagagaccacagtcttgctacctcctgtcctatgtctgagacttgagagttattcaatagagaccctctaagagacacgcctgaatagtaaaactaaactagccgtagcgtaacagccactctaaaccttactggaaaaaaaacttttaaactagttttgaaggataaagttgatccacaaataacttatctgcctacaaaaccagtctaacaatcttaaaaggaatatgacaaaatccaacactcagcaacataaaatttgctatgtctgatatattgtctaaattcagtagccataagcagcagaaaaatgtgacctacataaaggagcaaaatcaatgagtaaaaaactgacctagaaaatgacattctagaatgaaaaaccaagagcattaaagcaactattcatatgctaaatattgtcaaggatttaaaggaattaaatgagggaaaaaatggaaaatatttaaaagaaccaaatagaatttacagaaagagaccaggcatggtggcttatgcctgtaatcccagcactttgggaggccaagacgggtggatcacaaggtcaggagttcgagaccatcctgaccaacactgtgaaaccctgtctctactaaaaatagaaaagttagccaggcgtggtggtgtgcgcctgtaatcccagcaactcaggaggctgaggtaggagaattgcttgaacccaggaggtggaggttgcagtgagcagagatcgcaccactggacgttagcctggcgacagagcaagactccgtctcaaaagaaagaaaaaaaaaaaaaaggccaggcgcggtggctcacacctgtaatctcagcactctgggaggccaaggcgggcagatcacaaggttaggagatcgagaccatcctggctaacatggcaaaaccccgtctctactaaaaatacaaaaattagccgcacttggtggcatacgcctgtagtcccagctacttgggaggctgaggcaggaggatggcatgaacccgggaggcagagcttgcagtgagccgagatcatggcactgcactccaggctgggcaacagagcgagactctgccttaaaaaaaaaaaaaaaaaaatttacagaaagaaaaatatactatctgaaatttcagtggatggaattaacacactgctgaagaaaagatcagttaacttgagactacagcaataaaaactatctaaaataaagcacaaaaagattaaaaaaagagttaacagatcccagtaacctgtgagaaaatatcaagaggtctaatatatctgtaattggagtcccagaaaagacaggaagcggggacaagaagacagtatttgaagaaacaatgactaaaatgtttccaaattttgtgacaattatcttatacccccacagaagcaaaaactctaagaagataaacacaaggtaagctagaaccagaaatataatcaaattcaatgaaaattagtaaaaaaaactaaaattagacagtaaactggagtttgagagaaatatgctaaagaatctaaattttaacataatgaaaaagagtaattgtagggcacagttttagatacatttaatgaaagctagattaaggatcagctggctgagctgttgctgtgggcaatgatctctaaagggcactaaaataagattggaaatgcaacaaaaatggagaaaatatttactactcctcttcaatgggacagataactatatggtggaagaaacagtttgataaggcacctggggttcaaaataagttcacccccatcactacccattgcaaatgactcctaagttgcatctcaagagggtagatccaattaactgcagaggttttgttcacggagtgagttactcaagtttaagccactcagataaaactagatcaaaaagaagaaaaggtaggtactactacctaatacttttctttctctacatttatctttttttctaataaatattgaatgtacatttaaagaacaacattttgaagaagaattaaattaccagtttgcctgaaacaccattatcttagtgcatactcttagtgtccaagtatggcacgagtagccacagggatctcaatgctattttaattaatctattcaatttgacaattatcccatgtataataatatcagttactttacaagctacgaatgtgtttgggaggagcatactttaaaataccaaagagtacttaagtttttttacccatcgtcctttatctccttgaagtttactgaagaaaagctttagctcgcgaactgtcaaattatagctagccagcactcccaacatgtcaaccaaaagatctggaaacaaaagaaaacgataaaataactcagctagttatatttctcgaatatttaaaataaactgtgcttatttaagggcttggacactaaagttctaggtgcatgctacatgctcaaatatttcttaaatattgctaaatggaataagaaaaatatgtatttgaaaatcaaactttatttctttgcatatattgtactatagaaaaaatcatacctgctatcatattgtcaactttttcaattttcccaagcactttttcaacaaggcctacttcagtgcagacttgaagattccgtatgcttttcttcagaatggctgtaaacatgctccagacttctgcttggcacgtaatgtcacatttttccagtaggtccaccatgcagttaatactctcaccttcttggataatgaaattcatttccagatcaaactgtcctcctaccaacttacaaggaaaaaaaaaaaacacattaaaagcattagtatcctcaatatcactatagcatgttcctaaacattagattaacaataactactcacattcttcctccacatcaaaaggttcattaaaaaacatgcagctcaaaaaactgaagtttctgaagtaatctccaaatttagacagcaaagtaagagaatataaaaattaaaatatttttcaacaaaaacaaatataggatgtcttaggtaaattgctatctactaacctgttaccaataaagatctaaatcaactctacaattgcttctcatccagtctttcatttatgaagtatcaaatctgtgaactacactgaataatctaaaggtcctttgttacccaaacaacttatgagctcacggtaaaactgaaaagctgaaaaaggctcagagtggtcacacattggagtttatattagtcaaatttttggtttattaagcctattcattttacctctcctctgtagataatcagtataacttacatataattagtcacatatccaaagtcagtaaccaagaaaatgtatttcactgatattactatcagaacgctatagctatacaggccttgtcatctcacccagagcctccccatacagagggaaggttcgtaaattttaaataaatcgtaattgtgtaaaggaattaaaatacttttagaattacctttgtagagctatctcatttaactagattttttaaataaatttttttaaatttaaatttttttaatttaaaaatacatatatttaaggtatacaataatgctatcaactagattttttaaagatctctgtcagaaatagctacacacatgattcacctacgcttctttctgaatacttcttgatttttcattatgcatttccaaactgcatacccaaaaggtatgcaataattagaagaaagtgaactttaaaaaacaaatccggcagggcgtggtggctcatgcctgtaatcccagcactttgggagaccgaggcaggcggaccacctgaggtcaggagttcaagaccagcctggccaacacggtgaaaccccatctctactaaaaatacaaaaattagctgggcgtggtggcatgcgcctgtaatcccagctactcaggaggttgaggtaggagaatcacttgaacctgagtggcagagattgcagtgagctgagattgtgccactgcactgtagcctgggcaactgagcgagactccgtctcaaaaaaaaaaaacaaaaaaatacaaaaacttagccaggcatggtggcatgtgcctgtagtcccagttacttgggaggctgaggcaggagaatcacttaaacctgggaggcagaggttgcaatgagtcaagatcatgccattgagctccagcctaggcaacagaccaagactccatctcaaaaaaaaataaaaataaaaataaatccaatggctcttataaagaataacagacatgaccaagtggagtttagtccaggaaagcaaggaaggttcaaaactaggaaataaattaaaattccattcagcaggatcaacaacatgtatcccaggttctgacaaaaatatacacaggcatgagactgaaaaaaatggaaatgaacaatgtgaggatctgtacctgcatgcagagagacaagaactcctggcaagcacagtgataaagacatttcatctttctcagaaagctctggtagagatctcagcatacaatgctttgtatcatcactaccaagcagtgttaggagatgacagctgggattttgctaaaacagtctctccttgtgatggagtcaattctcctagttacatggccgtagctaaaaagtatacgtgcttggttccctagtcctcctggataaacgctataagctatctattatactatgaaatattccattctacttgaactggttgaattagattatattgtctgtaaatatgttgtttgtaaattttaaaaatacacaattcaaataagaactttaatatagctgttttggttttgtttgtattatttcctaatattgtctgtaactttttattttgaaataatttcgaacattcaaaaaaagtacagaattcctttatactcttcatccagcttccccaatgtatatatattacataatcatagtacagttatttaaaccaggaaattaacatttacaataccattaaccaatctacagatatcactcataaaaagatttaaaaaaaggcatgtatatgaataaggtgcttattattaataatgcttggctgacggtggtggttattgttattataagttttataattttataattacatatctatatttatatattattatatgataaaagtgacatgcaaatagaacaaagatcatttcatcaaaaggttagtggctgggcatggtggttcacacctataatcccaaaactttgggaggctaagacaggaggatcacttgaggcctggagtttgagaccagtctggcaacacagccagactctgtctccatattcaaaaaaaaaaaaaaaaaattacccaggtatggtggtgggtacatgcagccctagtactcaggaggctgaggtgggaagattgcttgagcccaggagttcaagactaaagtgagatcacaccactgcactccagcctgggtgacagtgcaagatcctgtctaaaaaaaaaataagtttagggatagctatattcaaatatctgggggaaaaaaaatcatcaatcaatccctcataccataaaaaaatttccaaatgagtctaagatttaaatgtaaaactgaagtcataaaatgagtctaaaataaaacttataaaagcactaaatgggttaggcgtggtggctcatgcctgtaatcccagcacttctgggagaccaaggcgggagagtcatgtgagtgcaggacttcaaggctacagtgagctatgatcatgccactgagccctagcctgggtgacagagcaggacatgtctctaaaaataaaaattaattaaataaaagcactgaatgaaatgatacaaaaaacattttatcacttcaagtggtaaaagcttttctaactaagagtttttaagatttctggacttcatattgacatatttaactacataataatcagaaactctatatgcaaaaaaaaatcaaaaagtaaattaaacacttagaaaaatcatttgcaacccatatcattacataagcacaaatagcttcctgaaaaaaaatttttaaaagaaaatatatctgcttgtgggaactagggtgttaaaaaaaaaaaaaagaaaatttaggcaaaggcaatgaacaaaaaggtaaataaaagtggcactaaaacatgaaacccaactttgcttacaaaatgaatattaaaaatacactaatataccatttttacatatttgattgacaaattccaaatctctaacaacatataaaaataatacatagtatgtgcaagaacatgaggaaacaggtactgtcatacattactgttgttgaggaaacaggtacaatatgacttattaagagcaatttggggctgggtacgttggcgcacacctgtaatcccgggactttgggaggccgaggcaggtggatcccttgagcgcaggagtttaagatgagccaaggcaacatagcaaaatcccatctctactaaaaatacaaaaattagccaggcgtggtggcagacacctttagccccatctacttgggaggctgagacacaagaatcacttgaacccacgaggcagaggttgcagttagccaagatcgcatcactgcactctagactgggtgacagagtgagaccttgtctcaaaacaaaaaaaagaaaaacaaaaaaatagcaatttggtaatatctatcaaaattttttatttttgaaacagcaatcaaactactagaaatgtatattatagacacatttatgtatctaacataatgatgttagatacaagaacttcattgtattgactctttttaaattacaagataaaggttaatgacagcctggcatgatggatcactcctgtaatcccagcactctgggaggccaaggtgggtggatcacttgaggtcaggagttcaagaccagcctggtcaacatggtgaaaccccgtctctactaaaaatacaaaaattagccaggcatggtgacacgtgcctgtaatcccaactacttgggaggctgaggcacaagaattgcttgatcccaggaagcggaggttgcagtgagtcacctgggcaacagagcaagactctgtctcaaaaaaaaaaaaaaaaagttaatgaagttgtatacaactatacaatgaaatatgatgtacatatagaaaagaatgaggccactccacatgatatgaaaagatctctaagatactgtgagaaaatcaaggtggagaaaagtgtgaacagtaggctacaatttgagtgtaaatcatttacacatagacctatgcatgtgctaaatatgtctaagaatgaactaaatatcgattgtctctggaaaagatctattgcatagaaggcaaaaaaaagattttagtacatacacttttgaacaatttgaattttgtgccatgaacacatattacttatttcaaaaaaaacaatttaaaaagaagcaaatgcagccaggtagggtggcttatgcctgtaatcccagcactttgggaaaccgagagagcagatcagttgcactcagagagttcaagaccagcctggggtcttgaaccaacatggcgagaccccatctctaccaaaaataaaacaaaaaattagctgggtgtggtggcatgtggctgtagtcccagctgcttggaggctgaggtgggagaatggcttgagtccgaaaggcagaggttgcagcagcccaagattgtgccactgcactccagcctgggcgacagggcaagaccctgtctcaaaaaaaaaaaagcaaatgcacaaaacaccactgatgtgaactgtagagcttatgaaatcatcataaatacaaatggtattaatacaaacgtttgggatttctcaagtaacctatttctaacaaattactcactgagtcaaaaataattcagcacaatataacaatgacattgcagaggcattattcaaatatttaacaactggcacagtgcaggcaccatgcaatcagaacacatacaaaacctatcaagatgggctcaagctgtaaaaatctcatacttacatattgaggcacattggctagctattggccttcatagaacatacttaagtaaaaaataacagatacaacacatctgcagaaaacaatcacaaaatacaaacctctactatataataaatttataaactcattcaacacacttttactgaatgcctacagtatgccaggccctgaggaaatagtggaacagtgatcaataagacagaaatagcctacccgtatttgcaggaacactgtgtcttatatcctacagaaatcttttttaattgcttatttagaaaatggctgggtgcggtggctcacatctgtaatcccagcactttgggaggcaaaggtgggtggatcacctgaggtcagtagttccgagaccagtgtggccaacatggtgaaaccccagctccgttaaaaatacaaaaattaggccgggcacagtggctcacgcctgtaatcccagcactttgggaggccgaggcgggcaaattacctgaggtcaggagtttgagatcagcctgggcaacacggcgaaaccccgtctctactaaaaatacaaaattagccgggcatggtgacacatgcctgtaatcccagctactcgggaagctgaggcaggagaatcgcttgaacctgggaggtggaggatgcggtgagccgagatcgcgccattgcactctagcctgggcaacaagagtaaatctccatctcagaaaaaaaaaaaaaaaattagccaggtgtggtggtgcatgtctgtggttccagctactcaggaggttgaggcaggagaatcgcttgaacccaggaggtggaagctgcagtgagccgagattgccccattgcactccagcctggtcaacaaagcaaaactccgtctcacgaaaaaaaaaaaaaagaagaaaagaaaatactagacttctggtttccaaactggaaatctctttctccatgaaaatatataatataggaatgacaccaagtagtaacttcagctcaaaatgtcattttgtataaatataaaatatataacattcataagttttcctaaatacctataatatctaacagaaaatacaagagttttaaaacaacatttctgataccaactataagtataaagtatctaggagtgtattaaaacatacacaagacttgaaagtaaagaaatttttttccacttttgataaatgaacagacctgtttctggatgggaatattaaatcagttcaagttgttaacttttcacaaattaatctataaattcagcacattaccattaaaattccaatatgatttttttctgaaacttatagtgattctaatttctatctgggaattaaatatatgaaaaaagtgaagggaaattctatacaaaaagaatactagaatcattaaacaaatggtataacataattattaaaactgtatggtactagacagaaaataatctaattaaaataaaaggttggtacaaataacttcaatataggattagagtgtcatcacaagcattaaatggagctatgaaattttcattttaaaaaattaagactgaatccttatcttacaaaatatgccaaaataaattctagataacttaaaatatcaaaagttaaattagaagccacaaatataagaaattctcaaagagtacaaaactcattaagctgtagaaataaaaagtggtacagaaataaagtattttcaatttggtgaaaaaaatgtttaggaagacatgaacagtcaattcacaaaaaaaaaatccaaatgacacttgcaaaaaaaaaatactaaatgaatttaactttgtttgaaattattaatgctcaaagtaggtgagaacaagattaaacagatactttcatacactcctgttgaaatatttccagaaagcaatatggtaatactaactaaacatataattgtgttaagtcaagacaatcttttattaaatgtgaggaataacaatcagcagcagatgccaatgattaagaaaaattaagaggaaaaattcaaaactgagaaaattaattccatgaacttcaacctgtaaatttggtaaagataatttttaatcaattttagcagtagaaaggtctggtccaggtccaagaacaccagtattctcaggaagataatttaaaagaatccacacagaagaatgtaaaattaaggagtgacagaatcttcagacacaagaaaaccttcttgtggaaaagaattgcagtgattcagaaaagtagcagaaaaaaacaaaaatctctaaggccatacaaaactagtaattccataattatataatgattataacttcaaaataactttttagtgaaaggaaagctcaaagagaaaatattttatgaaaatcatctagatacaacaataaaaaagacaaactcttcaacagtattttctagaagacagaaactaaaccttgtccactgaatacaataaagtacttcttacaacacccacatacaattgtacatcatttcatataagggaaaccaaccaataaatctgaaacaatttactgccaagaagataatgtctggagagagttttaatagtgtgaaattttcttctaacaattacatatcctccatgcgatctaaattggtcaaaaacctcgttacaactaacataagagaccttaccttcatcttaatattacttacatcaatcattcctataagtaaccaccctttcaagaagctatagatttttgaaagtaatttccaaaaaaagccccaaatatttcaccagcttttaaactgagattataatggtgagagcaatatccagacaggtgttttaaatattcctccattgctttaaatactataaaatatgcctttcaaggagaaattgatggcagaaatttgtacatacaaatgtgtggcatatttgatatactatatgtatgcatatctattatacctaaaaaacatgcacagggtctacagtatgtcatgttaaccctttctaatagttatttgaagctgatcaaccttcaaaacacaaatttgtttccaatgacagggatcataatccaggtacaggcattggctagttattatctgagctgtagtaatggctctgcactacaaaatgtaatcttcccaaatgtcacagtaagttatgaatatctgagcagcctaatgcactttactagccatgaaatgtgaaaatgtaatcttattaccttttttatggttgtatttttttgaataatgtagcatggaaactgatgtatagtctttttctacattttagcatgatttggtctcctttgctatatagaacatttttcaaaactctccatttcaacatattttagtcttggcctgaacttcataaacaatttttatagcagccttcagggtggcataacatgctttctataggttatactttaatgcataaggttatagaaattttaaagcaacttattcgaagaattcaaataaacctttataagttttgtatgaggactttaattgagcatgattatttttcttctcaatagtgatactaataaaatactttaagctgacattagtcactaatctaaattacctgtatattcggaaaatctaaagaccaaacatggagatcaaaaataattatcttctcttcaaaagattaatacaactggaatactgtgtgactcacagaaaattcaaatacttcaaagtaaagctctgttctccctggacaactcactggaaacttgctaaatttttcctcaaaggtggggcaggagtatggtatagtttaaaaaaaaaaaaaaaaaggacagggtgtaatcacagcttctgaccctaactagatactttcttgtgacctatctattatgacaggtgtagttaacacctgtctaaaaatgtcaaaattgcttttttctctgaacctatttatttataaaattaactaagagtaagcttcttttatttatctgcatccttcagaaacatattcaggttttaaaagtgtcaacctcaagatatccaatttttctccaggaatcctttcctaagtgaatgttaccttgtatatgtttacagccactggaaacttactaataaggagaagttgagggaaaattacaaagctgtgacacagactgcactgactcccaggttatatttccttcttccataataataaagagtttctagtttggcacacagagcccaggaaaaagatctcactctccagcttttcttgaatgaaaagcattcctgatcagccatgtgaccaagttctgaccaacaggcagtaaatacgtgcaacctctaggtattattctttaaagaaagaaacctgacccctttttccagctacgctccttcctactgcttaagatgcagaatagtggcaagagctacagtagccatcctggaattgaaggtgtcttatgttgaagataaaagagcaaatcgatctatggatcctggcaatcatagaactgccacactagcccgctacccagactttcacctgaaggacaaatacatttctgttttgcagaaaccactgttaatttgggcctctctgttctatcagttaaaagcctatattctgactaatatagatgctattcactgcattttctcagaaattaaaaaatatatattatctataactatctcaaatgatgtatccttattccccattcttataccatagcaggtgttagttcaccaaaagtgtcttttttgacctacttttgatagttggttatgtgccctggtaagttgagaaaccacagaacagcctattccctgactatattcttactggatagcttcatatatgctctacactactgtgccactatgacactttgccagatgccccattacaggttgaattgtgttctccaagaggacatatgttcaattcttaacctccagtgcttcaaaatgtgatcttatttggaaataggattgctacagatgtaattagttaagatgaggtcattagggtgggtcttaatccaatatgactgttacccttataaagagggaaaatttgtgctcgacacatgtacacagagaaaatatcatgtgaaaatgaagatagagattacagtgatacttctatatgccaaagaatgtcaaagattgccagcaaatcaccagaagtcaggaaagaaacatgaaacagattctcacaattctcagaaccaaccatgccaacacacttatcttagacttctagcccacagaactgagggaataaatttccattgtttcagcaacctaatttctagtactttattacacagccctaacaaactaatacatcccaacatctcccaaggtttatttttgatgttacccactaaattccccagtaagcattgtcaagaactcttagaaaagccaaaccacgacccagagactctgttcagcttatcttcacccagaccttcctacaacaccgtactctccttagagaaagaggtttgcggaatggatacacacagacatacagagtgaaataatagacactggagactccaaataatggaaaggaggtgagggtgaaatatcacctattgggtacaatgtgcactattcaggtgatgggtacactaacaggccagacttcaccataactcaatatatcaaggtaacacactgaacttatacccctaaatccataaaaataaaaacttcaatgtcaaaaaataggtttgtgattggtactcagtttttccaaaaagaacaatatattgctgaggaatatatacgtagataataaacttaaaaaaaaaaacaaacaaaggaatgactcacatcaaagttagcaaaagagctgggcatagtggcttatgcctgtaatctcagtactttgggaggctgaggcaggaggactgcttgagcccaggagttcaagaccaggctgggcaacatagcaagacctggtctcttaaaaaaaaaaaaaaatagcctggcaggtggcacatgccaatagtccaagctactcaggaagctgaggcaagaggactgcctgagcccaggagttcaaagctgcagtgagctatgatcatgccacagcaccccagtctgggtgacagggcaagatgctttctcaaaaaaacaaaacaaaacaaagttagaataaagataattgttttagcaaagaaaaagagattccaagtaaaaatattgttctattgttaacctggtattggatatatgcaggtacattttaatggtttttaagtacttttatatactttacacatatctttttaagtactttttaatacttttaagtacttttatatattttacacatacatttttaaaatacaacttattttgtatttgctatctccttgcctctctctgctatcttttggaaatttccccagtgtttcagttaccacattctttattcaattctttctaatctacttttcaatctgtctgttgagttaatttctatgtctttttatttaaaagttctatttgttgttatttttcaaatctgcttagtaatcttctctctttcctacataatcttttaagtgccttttttgttttccttctttttgttttctttctttcatgactttttgacatgaaagggcctctatttcataatttattataattttctaaattttatagtttgaaagtcttgaagatctaatcttgctttcagtgtatctactgactcctcatgctgtgctgcttttttaacgggtttttaaattttagattgtaaatttattttcaatggggctttatctgagagactctcgtgcagcctgtgcctctctaggttgaattaggtattctgctacctgccctagggatgtcttcagcatggaatgacttaaaaatatatatatatattttgagatggagtctcactctgctgcccaggctggagttcagcagcatcggcttactgcaacctccacctcctgggttcaagcgattctcctgcctcagcctcccgagtagctgggattacaggcgcccaccaacacgcccagctaatttttgtatttttagtagagacagggtttcaccattttggccaggctggtctcaaactcctgaccttgtgatccacccaccttggcctcccaaaatgctgggattacaggcgtgagccaccgcacctggccttaaaaaatattttttattgtgaaatgtttcactgcacccagctgccaagctattcttagacaaaatttaacattacagatatcgtggtaatacaatccagactttttttggaaatatcatattttctttcggaacaaacatttcttatatagtgtctggctacaatggctcatgtctgtaatcccagcactttgggaggcagaggcaggtggatcacctgaggtcagaagttcaagaccagcctggccaacatgggggaaccccgtctctaataaaaatacaaaaattagccaggtgtggtggcaggcacctgtaatcccagctacttcagaaactgaggcaggagaatcacttgagcctgggaggcggaggttgcagtgagcagaaatcaagccattgcactccagcctgggcaagactctgtctcaaaaaaaaaaaaaaaattcttagtaatatttgtctctactgggattctaaatctctgtaggtaaagacagtaaagtgtttttcttgcaggtaaagaaaattatgagttcgatactatataaaagaaaaagagtaagtttaatatgatttacagttaagtgtaaatgtagaatgtcactagaaacaaatataaattttcaacatatcccacccaaagaacttcacacaaatatgagtccaaaatatttcctaattatcaggtactagaaatcaaatctgctgttttaggacccaatttgaattctaaaatgttttcaccgaatacaacaatatgggttgggtagacaaaatttcagctcactctggttttcccctgtcccttctctaagatcataattgtaaaaaactatgtccatgtcccaggaatcacagaacatttagtctcgtataagaaatttctcatttcagaaaattaggttaaatttggtattctctacaattgcctttcctctttcttgcttcttttaaagaactataccttaacgttttcttaaggcccagctcaagaaatatctctctgagaaccattttgacctctccagccgacagtaaactagaatgatacacatcatattaccaatacaatatagtcatttaatatgctgaactgaaaatattccctttgaagtttttgttctccttctacttactatattctgggtctttcactatttcttagaatgcacagaagccctagcagtttcagcaatattatcaacaaactcacaatcatataagatttccatttctactatcataactaatccttacaagaaccctgtaagtcatacagattagtcaattatcacatctagctgataaaggaacaaaaaaaaaatgtgtccattcatagccaagactacaaatcagactatctgactcatagtctcatgtttccttacaccttcactaataatctattatttaagttagatttttttttctttaaatagtgagctaagtatttgaaaaatttgtgaactttactatctatacaaaaattagtcaaagtatatgttactgaaaataaattagaagtatcatctttatatttatttaaatccccaaacatactacaaaatagtcgaaatctcctctcattgtttattgtacccttcataagagttagaaattttcacagaataatggtatgtctacaaaagtgttaagaaaaaaggttccatgatcaaataagtctaagaaataatgaattaaacaatggtaaagagatgtttatatgatagaattaccagagctttaatatgcaactgtgcagtagacatcttgaaaggaagatatacaaccaatgcatggacttcccaaaagttatttcacaatggaacctcttttcctttttatttgatttagagatagggtctcactatgttggccaggctggacttgaacttctgtgctcaagcaatcctcctgcctcagcctcccaggtttctgtttgaacaagagattttttcataaatagcattcttcaacagctttttcaaaaaacatttgatgatgtaacatatttatgttcttgaagcttattattgtaagcttcacccagacccctaaatccataaaaataaaagtgcttgaagtcttagataggcagctggatgaataaatatcacagaattaactatgttttaagcaaacatttagtaggcacttcagaagtttttcaggtaagtagtttaactcaacctgtttgttttttcacagatttccttttatgacttattgaagttagtaagtaaacaaaaaagacatcttcaattaagattactttaggaaaaaagaaaatatgagcaaataaaatcacactaacccctcatccctttctgaaccagtcagtccaaaagtcaagcaacatagatatcctcccacatttggctggtctgtgtgcccacagaagtaatgtgtgacttacgaagttaggtcattagagcttcatggctccctttacatcattcattctaaggaaaatcagtcaccacaaatgaggatattcaagcagctcagtgagaggctcacttagagaggaacagtcctccagccagcagccagcaccaacttgccagtcatgtaagtaaccctgaaagcaagtcctctagtcccagttaagtctttagatgactacagctccagccaacattttgaatgcaacctcgtgacagaccctgagtcaaaactatctagccaacctactcccaaattcctgacccagaaaaactgagctgataaatgtttatcactgttttacactgtaaggtttgggggtaatttgtaacacagcaatacataactagtacagttacaaatcagtaattggggaaaactttattatgctatttattcctgtatcataaattttttaattcaaatattctaataataaaaatgcacagaataagtgattgctgtcagctacataggcactttacataagcactttacatggattatcatatttaattacctcttgtaaacatgaaacataagtaacttctgaacatgggtttcaacactacataatacttgtatttaattatttgtgacagttactgcagactggcttacccaacaccaattcctcaaagtctatcagacaaaactgaaaagaaagtataaatgagaaaaaaaaaatagttcatatggcaagaagacagttttggcaatgagaaaaatgaaacaaaaagatatagccaggctttaaaatcatactctatacctatgtattaagaagagaaaaagcagtgaaaaaaattcgagtggctaacagtttgtactctggcatgactctatacatctgaatactggtgatatggtttgtctgtgtctccacccaaatctcatcttgaattgcagctcccataatccctacatgtcgtgggaaggacccagtggtgggtaactgaatcatggggtggggggttctcatgatagtgaataagtctcacaagatctgatggttttataaagggcagttaccctgcacatgctctcttgcctgccgcatataagacgtgcctttgttcctccttcgccttccactacgactgtggggcctccccagcaatgtggaactgtgagtccattaaaactcactttctttataaattacccagtctcggttatttcttcacagcagtatgaaaatggactaatacaactggaaagttctttttttccatctcaaatatccaagtcagtctgaaatgtggaaggtatttagagttcaaggaaaaaaaggcagaatcaaataattcgagtacctatataaatatcttctataaaattacgtatagaaaataagatataaagatatctattgcagcactatttgtgaaactgaaacattagatatagcctaaatatccagcaatagagagatacttataaccagctgatggccatgtaatggaatattgtacagcctttaaaaagaatataaatcaatatgtgctggcatgccacgatgttcaagacacaatactaaatttttttaaaggtgcaggacagtatttacagtatgaccacatttccttaaaagatacaattatatttaaatcagagataagtgaaactgcagtttcagcctaggtagttgccaaaacatattgcttggtttcagctaagtgcccacttatgcactgcttctgacattcctaaagtgtaggtgataaataattgtattatcaagtatattaacatcatatataatcagtatgacaatgtcagtaatatagataaggcaagtcattcggatatagtatctgaatattcactttcaaatgcagacaaatttttgaggaaaaatctccttatgtgctttatatggtaaaagtgaggaattaaggcatatttctttttttttttttagatggagtctcgctttgttgcccaggctggagtacagtggcacaatctcagctcactgcaacctccgcctcccaggttcaagcgattctcctgcctcggcctcccaagtagctgggactacaggtgtacgccaccaagcatggctaatttttgtatttttagtagagacggggtttcaccgtgttagccaggatggtctcaaactcctgaccttgtgatccacccacctcagcctccctaagtgctgggattataggcgtgagccaccatgcccagccggcatatttcttattataagaataaaatgctacaatatttatttattatgaaataaacagtattatgaaagctactaattttatcttacaaaagtaactgtgccttcctcaataattggtagaaataaacagaaaatcagaaaggattaaaagaactcaataacactatcaacaaagaagaactaattgacatttatataagactccacccaattatagaacaataaatattgtttacaagggcctatggactagagattatattctgggacataatacaaactcaacaaatttaaagatattgaaagtatatggagtgggttctctgaccacaatgaaatcaaactaggaatcaataacagaaagataaagatcacagaaaaatgtgcgaacacttggaaactattacactcctaaatagtttatgtgtcaaaagaggaagtctcaaataaattttttaaatacgatgaactgaatcaaaataaaaatataatatatcaaaatttgtgggccatacctgagagggaaatttgtagcactaaaaccagaagtctcaaatcaataatctaagtttccattttaaagaacctagtagaaaagcaaaataagcccaaaacaagcagaaagaaggaaataataaagacaaaagcagaagtcagtgaagtagaaagtaggaaaacaataatcaatgaagagctagttctttgaaaagatcaataaaattgacaaaccttggcaggacttaaaaagcagcaagaaataagacacaaattactagtatcagggagaaaacactatcactacaggccttagaggcagcaaaaaaaaaaaaaatagggaatactgcaaacaactctaaacatataatgtgacaacttagaggaaatggaccaattcctcaaaactggaagctaccactacttgcccaatatgaaataatttgaataatcctataattattaaggaaattaagttcataattttaaaattcaaaaaagaaatctcaaagttcacatggtttctctggagaattcttctaaatattttttaaaaaattaatgccaattttaaatttctcaatccattttacgaagctactattttactaaaaccagacaaagacagtaccaaaaaaaaaaaaagcctatacaccaatatccctcatgaatataaacaccaaaattcttaacaaaaaattagcaagtagaattcggcaataaataagaattttacaccatggccaagtagattttattccaggaatgcaacactgttttaatatttaaaaatcaattaatgtaatccaccatattaataggataaggtaggacaatcacacgatcatatcaactgatgcagaaaaagtatttgacaaaaattcaataacactattgaggataaaaactcagaaaaatggaaacaaaaaaaaacttcaacttgataagcaacatttacataaaacctacgactaacattatactcaatgataaaagaccgagtattttctctcctaaagatcaggaacatggctaagacatgcactctcactacttttattcaaattagtgctgaaagttccagccatggcaattcagcaagaagaaataaaaggtatgcaggtgagaaaggaagaaattaagctgtccctatttgcaccaaagacatttccaaaaacagaaacctcctagaaataatgagttcagcaaggtaacgggttaccagataaacatttaaaaatcaattatacttccatatactaccaaggaacatgtgggcaatgacatttaaaatataccatctataattgctcaaaaatatgaagttcttagatgtaaatctaacaaaatatatacaggacttgaatgctgaaaacaataatatgatgatgaaagaaatcaaagaagatctaaataaatggagaggcacactgcattcatagtacagctgtcaattcctccaaaactgatatatagatctaacatagttcccatcaaaatcccagcaagacttttgcagatatagaaaagattattgtatgatttatatggaaaagcaaaggaactagaataccaaaaacaatcttgaaagagaaagataaagtagaaagaatccatctacccaatttcaaaacttattatgtagctacagcaatcaacactgtgaggaactggtggaggggcagacacataaatcaatgagacagaataaagaacccagaactagacccacacaaatattctgaacagttttaacaaaagtacaaaaagcaattcaagggagaaagaagagtctttaaaacaaatggtactggaacaattacaaatgaacttttctttacctaagtattacaccttacacaaaaactaactcaatattgatcacggatttaaatgtaaaatataaaacttttttaaaaacataggagaaaatcttcagaatttagggttaagcaagaagtttttagacttgacacaaaagcaagatccatacagggaaaactgataaattaggctttattaaaattaaaaattctgctcaccaaaaaaccttttcaggaggatgaaatggcaagctacaaactaggagaaaatatctgcaaaccaaatatctgacaaaagaataatatctaaaaaatatagtctctcaaaagtcaagagtaaaaaaaatccaattagaaaatgtgcagaagaacgtttcaccaaagaagacataaagaagacacataaacacacacacacaaaaagtctaacatcattaggcattaaagaaatgcaaattaagaccacagtggatatcactatacatcaatcaaaacaactaaaaaaataatgacaacaccaaatgctggtgaggatgtggagaaactggataattcgtatgttgttggtgggaatgtaaaatgacacagccactatgaaaaagtttggtaatttctatttaaaaaaaaaaaactaaatatgcacctactattcaatctagcaagtgcactcctgccatttttcccaaataaataaaaacttatgttcacacaaaaacctgtatataaatatttacagtagttttgttggtaatagccaaaaagtggaaatcactcggatgtccttcaacagctaaatggttaaacaaactgtagtacatccataccataaaatactattcaacaataaaaaggaacaaactattgacacacacagcaatctagaagaatctccagagaaccaattggtttttttctcaagttcgtacagtcttctggagattcttcaactgacaaaaatatagaaattgagaacagattggtggttgccaggggttaagatggggtagaggaaagtgggtatagctgtaagagggtaacaggaggaaactttctgcacctcgattataccaatatcaatattgttctagttttgcaagattttcccattgggggaaaccggataaagagtacaaaggatttctctgcattatgtcttcaactgcatgtgaatcagcaattatctcaaaatagaagacctagttttaaaaaataagtaattctatgtgaggtataaattgtcacaggattaattttccaccaattatttcccattgaaaagaaaactatattaacctaaatgaatcttcaattggtagaaaaatgagagccaaattaagcggcaaggaaactcgtaagttcaaattctgaagccacctacagacatacataatcccagcttctttacttatccctccctccctactccagccaaaaaaaaatcagtatatttaattacttgccctacacctgaaaaaatgtttgccatatactatacaaaaaagatgaagcatatattgatatcacacagagtttaactatatatcctactgactcacatctaatacttgcattatagaataaatatgcaaatttgaaccttcaaacaggaaatgaaattttctaaatccattacataacttcagattcatgtgtgcactgaaggctaataaatcatctaaaccttcatacagagaacctttttaaatttgcatttatctacagtaaattctgtcatgttctttaatagcttgctggttcaatctagcaaactagtgatttatagcagtgacatatttcaaaaatcagaaatctctcactatgtgacaaccagtcaaagtccactgaacttacattacttgaactcaaacatcataggatatgaaagagatagcaaaatgtcatgaatttcatattcaaatcaatttgagtttatgtttataagtgtttaaaactatagcatcacatacattacttaatacttcagtaccccaaatattttatgtcatgattccctcaatgtgtccaaactacctgtattttaaaatacatttttaaatttgatagttcataatttgaagactctacaaatcttactttgaagaacaccaaaatttagggtacatgaaagaaagatctatatattaggttttctccaccaaaaaaaaaaaatgtacttttagatctttataataatttcataccaatatccttatgtagggagatttatcagatgtgaaaatggagattatattaacaatagggaaataaactggaaattaccaaaatgttcactgtaatagacaatgttgtttttgtctgtattgtatttactcttccttccatcctcttccatttatggaattctgacaagaaagtctcagtacctcacacccaggtcacagagaggtcacttaagtcaggcctggctaaatatatacttcccccttctactggccacagtgattaatacaagactgagaatgtgagctaagtcaggccaatcaaaatcattaccaagactgttttttaatttataaggtgaaaaagaagggctcttggtctttgggtcaaaagtaggagaaatatgtaaactgaaggcttccagcagatatgttccctgccatgtggacagaggaggcctagctgcaccataaatggaagaagaatattctggtgacatcaattccctgtttccagggtttccctggttcttgcagcttcattcaatgatgtagcctggtcctatgaaccaatcattcccttttatacttaagctactttgatgtaagattctatctcttacaatgagaaaatcccggattaattccaaaaaaagaaggaactagctgaattatggcacatacgtatagttgtatataacacagcaattttttaaatcattttcattcatagttctccactgacagtctacgttagactcaacatcatctttttacaaaaaaaaaaaaaattctttgtgacacccctatactaacctgaaataaaagtgacacattccattttatcaattattttaaaaagatcagagatcagaatgtgtcttataatcaatggcatctaaaattacaattgcagggttttttcctaatgctgcataaaaataatgacaaatcttacaacttggcatcttagacttgaggaaacacaatagataataagacctacctataaacaacaacaaaaatctacaaagtactctaaccataataaaagaaaaataattaaaatacttttcagtattttttccatatataaatccttgtaaataaccaaataataaagtagttaggtcctggtaactatatacagaatctacattaatgtatgttacagaaacaaggcacagtgattcaggtgtgtattagatattcaaatactattatattccaattagacgtgatttttaattcttcataaagttccaaataaaacaaagtatgatttttttcttctttaaagcttacttatgtttctaaaaaaactcagcatatgttaaaagtattcaaaaagtttatgctgatatggaaaatgaaattaaagtctaataagttcaggagaacagaggatatcacaccttgctgtttgcaaatgtatcttccattgcaaggtccttagcagccttagtccagaacactaagtgtccactaccaactccaaatcattctaagaaccaaaaatactcaccaaatttcctaaacacctccaaggagcagtactggtctcactgagaactactcatgattggacaaggaaagatgtttaagatacatgattaaaggaaaaaaagcagatatgtacaaaataacctgttgtatatgtgtgtgtgtgtgtgtgtgtatgtctatagagagagagataggtagagacaaatgaagacagatgctgatacatataaaaatgtgtaggatgtatatgggtgtgtgtgctgcaagaagggcagacaataaactattaacaatggctacctcaaagaagtgggttgaggagagggaaattagacagtcagtctttcattttcacttcatacttttttaaatgagcatatactgctttaaacaataaaaaaaaggactttaaaaaatccaagtagtaaaggccatgtccaacatcattcccaagagcctgtctctttgcctgtgtctgtcaatgtctgcctgagcctcatcctgaccgtctataaggccgtctgtttctctctctctttctctctgtgcgtggggtgggcggggtggagagggtttctgtacctatctctctctggttcttggtatctgcatatctcttctttgagtgtgtctctcttgaaattatgtgtatctgtgctttactctctgagtatctgtctctctgtgtatgcatgaatgtcttcctcccggagcacagacggaagcatgggccttgacctcctcccagtcttaatgcattcatctttatatctctgtgtatgtgtccatcttccactttctcacttacaattattttgcttcctttcctcttctgtttccctgacccctcatctccctccatcaagcccttcgcccatcttgtcttcctctactacctccccaactgtttccatataagcaaagttcacactgctagagtgttaatgtgttcatagccctgataaactctcttcaactggatcacaaatgatcatttctatctgaagagcgtatctgaagagttctgttagttacaaaataacatgctaactaaattaaaattagggtaactaatccttattttaataatagaacaactcagcagaagatcaacatgaaaaacagaagaggtgaacaacactataaaccaactaacctcacgaacatctataggatatttattctccaggatagaccatgttactcatccataaaacaaatctcaataaatttaaaagaatagctccctctccctctctccctccccctccccctcccccccctctttgcacggtctccctctgatgccgagccaaggctggactgtactgccgccatctcggctcactgcaacctccctgcctgattctcctgcctcagcctgggagtgcctgggattgcaggtgcgcaccgccacacctgactggttttcgtattttttggtggagacagggtttcgccgtgttggctgggctggtctccagctcctaccgcgagtgatctgccagcccgggcctcccgaggtgccgggattgcagacagagtctcactcactgagtgctcaatgttgcccaggctggagtgcagtggtgtgatctcggctcactacaacctccacctcccagccgcctgccttggcctcccaaagtgccaagattgcagcctctgcccggccgccaccccgtctaggaagtgagaagcgtctctgcccggccgcccatcatctgggatgtgaggagcccctctgcctggctgcccagtctgggaagtgaggagcgcctcttcccggccgtcatcccgtctaggaagtgaggagcatctctgcccggccacccatcttctgggatgtggggagcgcctctgccccgccaccccgtctgggaggtaaggagcgtctctgaccggccaccccgtctgagaagtgaggagcctctccgcccggcagccaccccgtctgggaagtgagaagcccctccacccagcagccgccccgtctgggaagtgaggagcatctctgcccggcagccgccccgtcggggaggtggggggcagcccccgcccggccagccgccccgtccagaaggtggggggcccctctgcccggccaccccgtctgggaagtgaggagcccctctgcccggccgccaccccgtctgggaggtgtacccaacagctcattgagaacgggccatgatgacgatggcggttttgtcaaatagaaaagggggaaatgtggggaaaagaaagagggatcagattgttactgtgtctgtatagaaagaagtagacataggagactccattttgttctgtactaggaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatactcgttaagagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatcctcctctctgagaaacacccaagaatgatcaataaatactaaaaaattttttaaaaattaaaaaaaaaagaacctagactcagaaatcaaaaaaaaaaaaaaaaaaaaagaataaaaggaacaccaagtatatcatttgaccataagggaataaaactagaaatcataacagaaagaaattttggaaactcaacaaatatatggaaattaaacaacacactcctaaatagcctatataaaagaataagtgaagaaaaaaaattaggctaggcacagtggctcacacctgtaatcccagcacttcaggaggccaaggcaggtgcatcacttgagcccagagttcgagaatggcctgagaaacatggtgaaaccctgtctctacaaaaaacagaaaaatgagccaggtgtggtggcacatgcctgtagtcccagtgtctcaggacacctgtgaggatcacctgagcctgagaggtagaatctgcagtgagccaccatcacaccactgcactccagcctgactgaaagagtgacacactatctcataaaagaaaaaggaaaggaaaaaaagaaaatagaaaatacactgagatgaatgaaaatgaagatacaacatgacaaaatgtatggaatgtataaagcagtgttcagagggaatttatagctgtaaatgcctactttaaaatagaagaaagatactaaatcaacaatataacctttgaacatgcataaaaagaaggagccaagccatgtccggtggcacccacctgtggtctagctactcaggaggctgacgcaggaagattgcttgagcccaggagttcgaggtcagcctgggcaacacaaggcaaacccccatctcaataataataataatgacgtaggccgggcgccgtggctcacacctgtaatcccagcactttgaaaggccaaggcatgcagatctcctgaggtcaggagttcaagaccagcctggccaacatggtgaaaccccatctctactaaaaatacaaaaattacccaggtggggtggtgggcgcctgtaatcccagctacttgggaggctgagacaggagaatcacttgaacccgggaggcagaggttgtggtgagccgagattgtgccactgcactccagcctgggcaacagagagagactccatctcaaaaataataataataatgtagccttccatcttaaaccctacaaaagaagcgcatagtaaacctaaagcaagcaaaaggaataaaataataaagattacagaagaaatgaatgaaacaaatgagaataaaatgaaattaacaatataaaattagtggtatttttaaaaataaaatcaatacaacctggcttctttggtccttcaacaacaacaacaaaaaaatgaaattgacagatttttagttagactaaccaagaagaaaagagaagactcaaattactaaaatcagaaatgagagtgcattactaccaaccttacataaatgagattataaagacacactatgaacaattgtatgccaataattagacaacttagataaaaggagcaaattcctcagagggatacaaactacagaaactgactcaaaaagaaatacaaaatacaaacagacctacaacaagaattaaattagtaataaaaaaatcaactcacaaaaaacaaaacaaaaaaaaaacttaggcccaggtggcttcactggtgaattctacctaacatttaaagacaaattaatacaattcttcacaaactcttccaaaacactgaggaggagagaacacatcccagctaaatctatgaggccggtactaaccttatgccaagatcagacaaaaccatcacaaaaaagaaaactacagaccaatatatcttatgaatatgaacacaaaaatcctcaacaaaatactagcaaaccaaatccaggaacatataaaaacagttatacactatgactaaatgagatttattccaggaatgcaagctcagtttaacattcaaaaattaataaatgtgatacaccataaaatgaaaaaccacatgatcatctcaatagacaaaaaaagcatctgacaaaatctaatacctttcattattaaaacacttaacagactaagaatagaaagaaacttcttcaacctgacaaagggcatctatgaaaatcccacagctaacatcatacttaatggaagtatcactatgaaccaattaggtattttatcttaaaatacatatacacacacatatacacatacacactcacacataaatatgtaatgtgtgtgagtgtgtgcgtgtgtgtgtatgtgtagttttatcaactggaaaggggtacaaacaatgaccaacacaataacaatgaacatgcttactgcccagattgtggtcttgaaataccatttctcactaaaaatcagggcttcttgaaggagtagcttgtattagtctgttctcacactgctaataaagacatacctgagactgggtaatttataaaggaaagaggtttaactgactcacagttccactccccagtggaactggggaggcctcacaatcatggctgaaggtgaaggtggagcaaagacatgtctttgcaggcaagtgagcatgtgcaggggaactcccctttataaaaccaccagatctcatgagacttattcactatcaagagaacagcacggaaagacctgcccccatgattcaattacctcccactgggtccctcccacaacatgtgggaattgtgggagctagaattcaagatgagattttggtggggacacagccaaaccatatcattctgcccacggcccctcccaaatctcatatcctcacatttcaaaaccaatcatgccttcccaacagtccccccagtcttaacccattttagcattaactccaaagtccacagtccaaagtctcatccaagacaaggcaagtcccttctgcctatgaatctgtaaaatcaaaagaagctagttactgcctggatacaatgggggtacaggcattgggtaaatacactcattccaaataggagaaattggccaaaacaaaggggctacaggtcccgtgcaagtccaaagccagtgggacagtcaaatcttaaagctccaaaatgatctcctttgacttcatgtctcacatccaggtcacactgatgcaagaggtgggttcccacggtcttgggcagctccgcccctgtggctttgcagggtacagacccactccttgctgctttcacggctggcgttgagcatctgcagcttttcgaggtgcacagtgcaagctgtcagtggatctaccattctggggtctggaagattgtggccctcttctcacagctccactaggcagtgccccagtggaaactctgtggaggcgcttgtaccccacatttcccttccacagtgtcttagcagaggttctctgtgagggctccacccctgcagcacacctctgcctggacatccaggtattttcatacatcctctgcaatctaggtggaggttcccaaacctcagttcttgacttctgtgcacccaaaggcccgacaccacacataggccatcaaggcttagggctttcaccctctgaagcaatggtgtgagctgtatattgcccccttttagccacagctgggatgcagggcacaatgtccccagactgcacaaagctgcaagtcccggaggccagcccacaaaaccactttttcctcccaggactccaggcctgtgatgggaggggcttctgtgaagacctctgacatgccctggagacatttccctattgtcttggcaattaacatttggctcctctttacttatgcaaatttctgcagctggcttgaatttctcctcagaaaatgggtttttcttttctattgcatcattaggctacaaattttccaaacttttacactttgcttcctcttgaatgctttagcacttagaaatttcttccaccagataccctaaataacctctctcaagttcaaaattccacagacctctagggcaagggtaaactgccgcaagtctctttgcatggcaagaatgatctttactccagttcccaacaagttcctcatctccatctgagatcacctcagcctggactttatcgtccatttcaccatcagcatcttggtcaaagccattcaacaagtctctaggaagtttcaaactttcccacatttccctatcttcttctaagccctccaaactgttccaacctcttcctgttacccacttccaaagtaacttccacattttcaggtatctttacagcagcaccccaccctaccattaccaatttactgtccgagtctgttctcacactgctaataaagacatacctgagactgggtaatttacaaaggcaagaggattaacggactcacagttctacatgcctggagaggcctcatagtcaaggctgaaggcaaaggaggagcaaagacacatcttacatggcagcagccaagagtgtgtgcaggggaactcccctttataaaaccatcagatctcgtgagacttatccactatcaagagaagagcaggggaaaaacccacccccatgattcaattacctcccactgggtccctcccacatgagacctacaattcaagaaagattttggtggggacacagccaagccattatgatagctggttcaaggtctggaactagaaatgaaaatatgagcctgaaatatcttgccataaaaatagcagaaacatgatcaaagtctagtagggttgtaccaaaaggactcaggaatcaacctgaagaagtgcctactggccaaaaataaaagtttgaggttcaataaagtaataataattgccatcaaatatgtttaaatcctttaattcataatatttcaaaaagacaataacaacgaattggtctcctgtagaggataagaagagaaatggctgttacttacaaaattaatgaataaaaggaatgaaactgttccaattacatatttatataatatttatataatatgtaacatagtgtaaatctaatatacttattatattatctataattatatataaagaacatataaaaagtatataaatatataaaagaatgtaaatacacaaagaatatatttataaatctatataaagtatacataaatatataaagtgtgtgtgtgcatgtacgtatacatacttttttttttttttaagaaacagggtcttcccatgttgcccaagctggccttgaactactgtgttcaaggaatcctcctgccccagcctcccaactagctggggctaccggtgtgtaccaccatgcctggcttatctatgtattaactgtgccactggataactaaatacaactggataattaaatacatcttttcatagaactattccatttaatacatgaaaaaatatatataatatcatcattattcagactccagtgatttaatggatctagatgttgagaatcaacagctgataacattataaaaagagacaacctgacataagagcctccggatgacagaacacagcaccacctagagtctagccaaaggtatggaagccaaatcttctggaatcaacttccaatttgcaggaaatacggaggacacaagaacatgttaaactacaccatgaatatgcacttaacaaaatccagaccatgggaaatgctaaatgtcaaaaggtccaggttttttaaaaggtccaggtttttttaacagatagaatgacctgagacttaaaaaacgtgttttttaaaactaagaaaaactaaattatagataagggatgtattattagattacataattacaaataaataaaagaaagtgattactgtaaaagtcaagatagaggttccatttgagggagagaggcagttgtaattagagggattctaagatgactggcaaaattctatttcttgacctacatggtggtttaaaggtaattatttgccctttagttttatatttgttttggtttggtttttcaatagttacagttttacaataaaaatttttatgagaaagttctgtcaatggttaatttcatattttaaaacatctatattcaggcaatgcaattccatcataaaattagtagtttcagtttttgtaaacttgtaactcacagcctgtattaaatacatataacacatttctttcagtgactcctaagaagcttctgatgcataactaacctccatatgtaagtcacctcaaaacagtaacagtgctctcaagctgcctcagggaacatggcgccacctctctgctgagttatgtatagccactttggccgcccactgcatcctgatggtgatgggggagacaggctttgattgccagtcacacccctctatcctcaccccatattggctgtggctgtagatgagattcagctgtgggtggcctcagctcaccaaccactgccttggttttgagggtcaaacccaggctcaaacaggtgggggaggaggataaacagccatattcacaaatgcattcttgaatcactgaatctatgtgaaataattaaacaaaagagaatgtccttaaaaagaactcatatttgcaggcctaatcttcacccaagagatcttaaaatgctatcaccttatgcataagagctaaagagaaatactgcaaggcatcatgatatcctgagaaaacttaaagctaagacagaagaaacagagattagccagaaaaaaacaaagtctagaaaaatcaacattgatatatttcaaaagatttaacagctgcagaaaatgagtttcaaaaacaaaaaatactatttttaaaaataccagtcttattatttttattagaaaggttaggaggatagaagagaagcaagtagacaagctgactctaaatttctctaggaaaagtaagcaaacaggaatagccaggaagctgtgaaaaagaagtgcaacaatgggaagctagctccatcagagattaaaacataatatgaaataaaataacttttttaaaaagcggtagcagtagatgaatgtctgctagatgaagaagagaacagaaagtccacacatagtgccaaagacaacaggaaattatcacaccataataatagcaatttttagagcacttacttgtgccaggcactaagaatcttatgtatattaaatgtctgactactccatgagataggtacaattattgtatttttatttgaggaaactgaggcatagacatatgaagtaacttgcccaagatctcagaggcaagaagtggtgctgctagaatttcaacctaggtaatctagctacaaagtccacactcttaacctgtacgcactatggtttttctgtttttcattcaggtgacatctcaaatcatggaggaataataaacaattcaataaacagcattaaattggaattcaatttttttctacatatgttcaaatggacatttgtagaaaaaataaattggcccatatttcaaatcaggaaaaatttcaggccagacacagtggctcacacctgtaatcccaacactttgggaggctgagataggaggattgcttcagtccaggtgtgcaaaactggtctgggtaacatggggaaaccccatttctacaaaaaaatgcaaaattagctgggcatggtggtgctcacctatgatctcagctactcaggcagctgaggtggaaggatcacttgagcccgggaagtcccagctacagtaagctgtgatcacaccactgcaatccagcctgggtgacagagtgagatggataaataccagagtgataaataccatcaaaataatacaggaaagcatagaactttaaggaagttctgagtaagaaaagcctttctatgtatgattcaaaacccactaactataaaagaatagcacaataaattcaagctacataaaaataaaaagcttttggctgggcacagtggctcgtgcctgtaatcccagcactttgggaggctgaggtggacagatcacttgaggtcaggagttcgacaccagcctgaccaacatggtagaaccctgtctctactaaaaatataaaaattagccgggcgtggtggcatgtgcctataatcccagctacttgggaggctgaggcagaagaattgcttgaacccaggaagcagaggttgcagtgagccgatatcacaccactgcactccagcctgggtgacagagccagactctgtctgaaaaaaataataaataaaatttaaaagaaataaaaataaataaaataaaataaaaagctttttattaaaaaaaaaaacaccactagtcaagtcaaatcaatccctttaaaataagaagcttctagaaaataacaaaaacatcaactcaatataaaaaggggcaaagtaacatgttatttaacaatgaatttaatccctctccctctcactctgcctctccccctccccctcccctttgcacggtcctcgtctcccctttgcacggtctccctctgatgccgagccgaggctggactgtactgctgccatcttggctcactgcagcctccctgcctgattctcctgcctcagcctgccgagtgcctgggattgcaggcatgcgccaccacacctgactggttttcgtattttttggtggagacggggtttcgccctgttggccgggctggtctccagctcctgactgcgagtggtctgccggcctcggcctcctgaggtgccgggattgcagacagagtctcgttcactcagtgctcaatggtgcccaggctggagtgcagtggcgtgatctcgaatcgctacaacctccacctcccagccgcctgccttggcctcccaaagtgccgagattgcagcctctgcccggctgccaccccatataggaagtgaggagcgtctctgcctggccgcccatcgtctgggatgcgaggagcccctctgcctggccgcccagtccgggaagtgaggagtgcctcttcccggccgccaccccgtctaggaagtgaggagcatctctgcctggccgcccatcgtctgggatgtgaggagcccctccgcccggccccccagtctgggaagtgaggagcgcctcttcccggcagtcatcccgtctaggaagtgaggagcgtctctgcctggccgcccatcatctgggatgtggggagcgcctgtgccccgccgccccgtctgggatgtgaagagtgcctctgccctgccgcgaccccgtctgggaactgaggagtgtctctgccctgccgccaccccttctgggaggtgaggagcgtctctgaccggccgccccatctgagaagtgatgagcccctccgcccggcagcctccccgtccgggaagtgaggagcgtctccgcccggcagccgccccgtccaggaggtggggggcagcccccgcccggccagctgccccgtctgggaggtggggggcccctctgcccagccaccccatctgggaagtgagaagcccctctgcccggccgccaccctgtctgggagatgggggggcccctctgcccagcagccccgtctgggaagtgaggagcccctctgcccggccgccaccccgtctgggaggtgtacccaacagctcattgagaacgggccatgatgacgatggcggttttgtcgaatagaaaagggggaaatgtggggaaaagaaggagaggtcggattgttattgtgtctgtgtggaaagaagtagacataggagactccatttcattctgtactaggaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatactcgttaagagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctctgagaaacacccaagaatgatcaataaatactaaaataaaaaaattaaaaaaaatgaatttaaaaatgagcaaaggatacaaatggataattcaaagaaaatatggtcaaccttagtcataagggaaatgtaaatttaaattctgattaatcatcactttttcacctattagactggcaaaaaccacagctgctaatactgttggagatgctacagaggcactttcatagagttctggagggagaataaattaatataatccctgggaaggcagtttggcaatataaaccaaaattataaaggaataaaacctttgacccagcaattatatctctaagaatctatcctatagatacaattacattaagtatgaaatagtatatgtaaagattatttattgaagtattattagtaataacaaaatactggaaacaacccagtaaacaggggtcaagacaaccatggttcatctatgcaatagaatacttatatagctcttttaaaaatacagaagctctgtataaaatgctttagaaagacaaataagaaaaattatcagcaaagaaaaagcaagatgtagaacaaggggtacagcatgccaccttctgtacaatgaacaagtgaaacatacaagtatttacattagtttataaaagcctaagaaaatttagaaggatacatgagctgctaataatacttttcaggttttctctctatcgtctatatatcaatcattcatccatctacctatctatttatttgagacagggtctcactctgttgtccaggtggcagactgcagtggcgtgaacacagctcactgtagccacaacctcctgggctcaagggatcctcccgcctcagcctcctaagtagctgggactataggcacatacgaccatgcccggctaatttttttttttttttttaatacagatggggtttcaccaagttgtccaggttggtctcaaactcctgggcttaaacagtccttccacctcggccttgcaaagtgttgatgttacaggtgtgagccactgggcctgacctaggttttcttaagcagtgactaaattaactgaaggagagagatgagcaagggataatgtatgctggaaacaaggagaaaagaggtcatagagagagatttcattaaatacattcctatttttgacctgtgttaaaatgtttcaaagtcatatatttgacagaccagaaacaataccatcccacaggtactggatgagataccccaaataatatgttaatatcaataaagatagtgttttgtacatgatccatcttcattttcgtttttgactatggtattatgtgaaattttgcccctggagaaagggaagtacatattggagactgcagtggaagatggtagaaaagaagtgaatcagcaacttatgaggcaaatgcattaaaagcaaaatacccaagtggtatatttgtagctcattctcttaagtgctacatcttactgcttgttttgtattgctagttcattcttttttttttttttgagacggagtctcgttctgtcacccaggctggagtgcagtggcatgatcttgacatactgcaagctctgcctcccaggttcaaagccattctcctgcctcagcctcccaggtagctgggactacaggtgcccgccaccacacccagctaattttttttttttttttttttttggtaatttttggtagagacggggtttcaccatgttagccaggatgatcttgatctcccaacctcgtgatccgcccgcttcggcctcccagagtgctgggattacaggcgtgagccaccgcgcccggccgctagttcattcttaattattcaaattaactaaaaggcaaatcaggatgctttctagataattttttgtattataaaaccaagaaggtaaacagtgctagtttaagcatttggctgagttaacagatttttcccaaacaagagcacactgcagcctgtatttctcaaaacatctattactattgcatgtcatccatcagcataaacaaatggaagttcaaaaaatagggctgaaacaagacagctttggtaagaattaatatttaaatgtcttcctcagtgtcgtgtcatcaggaatcccaggctgaggcccagagacaacctcatggccttgaaatctaaacaacatagaaacataagccttcactatctcttattagttatttgagatctactatttactccataaacttaaaatatcaagtaaacactggtttttaataaaagtctaatttaatttgttttaaatagtagttaaaaaaccattaacacattaaggacataaaaaaaattcctccttgaaaaataactccaatttaattcagaactctaatgatagcacattattaccaccacctcaagcttctcaagaccattttaactatgtaataacccctgaacaaaaatcatcatggcttctcatcacctacagaataaaattttaatcacttgggcaacaacgcaaaatgtcaaaaagtctcacttcccatgttgtccctatacaatccagtccagactatttattatatccagaaggagttttaatattctactcccttgcctttgctctccctccctaaaattcaaagtttagctctagccccacttctacaaaacgacatttccagataaaacttgtccattgcaaaatatgctcagttcatagatactgctttgaatttttagtctcccatccaagtacagacatacatcattttatggcacttcatgttattgttctttgcagatacagcattttttacaaattgaaggtttgtggcagccctgcatccagcaggtccattggcaccatttttccaacagcatgtgcttgctttgtgtttctgtgtcacattttggtaaatctcacaatatctccaactttttcattattattatatttgttatgatgatctggaatcagtgatctttgatgttactactgtaactgttctggggtatcataaaccatgtccatataagatagtgaacttaataaatgtggtatgtgttctatagctctaccaagagactattcccccatctctcttcctctttttgggccaccctattatctgagacataacattgaaattaggccaattaataaacctacaatggcctctaagtgttcaagtgaaaggaagatttgcacatcttttttttttttttttttttgagacagagtctcactctgtcgcccaggctggagagcagtggcgcgatttcggtttactgcaacctccacctcccaggttcaagcgattctcctgcctcagccgcccgagtagctgggattccaggcatctgccaccatgtctggctaatttttgtattttagtagggatggggtttcaccatgttggccaggctagtctcgaactcctgacctcaagtgatcacccacctcggccttccaaagtgctgggatcacaggcatgagccactgtgcccggccgcacatctctcattttaagtaaaaaactagaaatgattaagcacagaaaggcctacgtcaaaggttgaaataggccaaaagctaggcctcttgtgccaaaatccaagtgtgaatgcaaagggaaagttcttgaaggaaattaaacgtaagcaaaacagcttcatggctgatatggagaaagttttagtggtctggatagatcaaatcagtcacaacgttcccttaggccaaagcctaatccagtgcaaggccctaactctcttcaattttatgaagtctgggagaggtgagtaagctgtagaagaaaaagtggaagccagcagaggcttaaggaaagaaacagtctccataacacaaaatgcaagataaagcttcaggtactaatggagaaggtacagcaaattatccagaagatctacctgagataactgataaaggtggctacacaatagatttttaatgtagacaaaacagccttctattgcaagaagatgccatctaggactttcctagatacagatatgaaatcaatgcctggtttcaaagcttcatagaacaggcagactctactgttaggggctaatgcagctggtgactaagttgaaggcaatgctcacaaaccattctgaaaatcgtaagatccttcagaattatgttaaatgtactctgcctatgctctataaatggaacaacaaagcctggatgactgcatatctgttcacagcacagtgtactgaatattttaagccaactgttgagactcactgctcggaaaaaaagatttcctttcaaaatattattgaccatttacaatgcacctggtcacctaagagctctgatgcagatatacaaggagattcacgttgttttcgtgcctgttaacataacatccattttgcagcccatagttcaaaatgtaatttcaactttcaaatcttattatctaggaaatacattttgtaaggctatcactgccatagatagtgattcctctgatagagctgagcaaagtaaacagaaaaccttctgaaaatgattcaccattgtagatgccatgaggaacatttttgattcatgggaggaggagtttggaagaaatggattccagaccccatggatgactttgagaggttcaagacttccatggaggaagtcacagcacatgtggtggaaatagcaagagaactagattgagaagtggagcacccaggctggagtgcagtggtgcaatcacaactcactatagccttgacctcccagactcaggtaatcctcccacctcagccacccaggtagctaggactacagatgaacgccacaacacccagctaatttctttttatttttggtagagacaaggtctcaccatgttgcccaggctagtctcgaactcctgggctcaagttatccacccacctcagcctcccaaagtgctgagattacaggcgtgagccaccacacctggccaaagcggtttcttgagatggaaatctacaactggtgaagatgccatgagtattgttgagataacaaaggatttagaatcttacataaatttagttgataacgcagtagcagaatttgagaggactgactccaattctgaaagaagttctactgttcatagaacactactgaacagcattgcatgctacagagaaatttttcaagacaagaaaacaaagatcagtcaatggggcaaaacttcattgtggtctgattttaacaacttttcacagccactgagcaaccaccaccctgatcgaggcaaaaccctccaccaccaaaaagattaggacactctgaatgctcagatgatcgttagcatttttaagcaataaagcatttttttaatgaaggtgtgtgcattgtttttttagacataatggtattacacacttaacagactaaagtaggctgggtgtgatggctcacatctgtaatcccagcacttagggaggctgaggcagacagatcacttgagcccaggagtttaagaccagcctgggcaacttagggagaccccatctctacaaaaaagtaaaaacttagctgggcatggtggcctacacctgtagtcccagctacttgggaggttgaggtgggaggatcgcttaagcccaagaggttgaggctgcagtaagccttgatcacactactgcacttcagcctgggcagcaaagcaagaccctgtctcaaaaaaataataataatatatacttgtgtgtgtgtgtgtgtgtgtgtgtgtgtgtgtacacacacacacacacacacacacacacacaaaagtatactgtaaatgtaactcatatgcattggaaaaccaaaaaatgtgtgactcatattcactactttattgcagtgctctcaaacaaaatctgcaatatctccaaggtatgcctgtactaatcaggcctaactccgcttagcttcaaagatcagacaacactgggtgtgctcagggtggtataactgtgtctagagtattagttatctttatatgagtcttgtttccatcagactgtaagcttctgagaaggaaaactgcatttggtgagcacctactatgtgctgggcattattttcaaatattccaagagccctatgaaactggtactgttattctcattttaaagatacagaaactaggtcagaaagattacacagcttgaccaagatcataagcccaagaactgacagacctgagtcaaaccaaaagtctacctgattccatgcaagatactgcctctcaaaaagaaaagaaaaattcaaaacaaaactattagaaagctatacagtatatagaatatgtcgaagtgtgctcactcatttcatttttgttgcaacccttagaggcaatgtattagttatggttgctactacttttctctggcaagcataatttcacatttccctttctctggttcctttgaggaactttttccttacttcaaagtagtcctggcagggacatgaatcatggtgcccaatttcatacagagtggcacacaacaaagataaggcaatcagacacatactgtcacatataatgattgttttagctataaggtcatcatgtaagccagcccagtcaaaatccttcaggggtctaggcattttcattatgttattttgaataattctgcttctaaccttcatcccagccaccttctctttcctcaactcaacacaacagaaatttgataaaagttcaataattgcaaaaggaatatttggcataagggtgaaaatacacagatatacttggttcctcatgtcttaataaaatctatagtgaaataaagtcaaagaacaatgctttcagtacagagtacttagataacaaaatatcattctctttctaatcataagatatatttaatactaaattttatgtaacaaatagctataaacaaatgaaacattaagagctctgatttttatttactatttcacaagggttccaagcttggcccaaagaggaagggaaaaagaattcacatgctataaaaaacaggtatgcaatctgaagcttgtgttaaagaaagaaggtaaaaatggagatgcctttaatgtatcatcatttgaaaacttacagcaaattaatgtagtatattagccaacacacagattagggagaaaaaatgcataaatgtatgccagtataatgtacctccattccataactactgagaaaataattagaaatttacagcacaatatatttatagattctcttataagtaccttaccaaaaaaatcaatgctacaaaaatgaaactaatgagcaccatctcatgggcatttgaagtaatatatgtaaaaccagcctttgcaagagctttaaaaagccaagttacttagtaaaggattaatcataaaactttcttttaaaatttcaaattttgtacatatatcctaaaaagttaacaagggttttaaacaaacagatatactatttaagccagtatttaaatagcttcaacaaatataaggggaggagatgtaaaatgattctcacaaaacaaactctgtagaagagttaaatagaagcaaaatccaaaactgttaaaaaataaaataaaataaaatagtacttaacaagaaaaaacaggattttagatagatttggcaaatctgaaagtaacataaatcaactctttctcatagtgactaacagattttccattttaaaaaccctgacttgatcattatacattctacgcatgtaacaaaataccatatgtaccccataaatatgtaaaatattacatatcaatttttaaaagtcagaagaaatgcttaaaaaacgtatttcacatttcctctaatggtgtacatttaaaaggaaatgcatttcccattcaaagaaaaacatgtactactttaagactaaagcaatctttgtcagcttcctggctcttcatttaagtttattttctaaaggcaatcaagtggaatatattaactagactatctgatactaaacaaagcagttatttcctgcctgaaatttcatccagtagcaacatacactcactgaagcacttcagtgtcacattctctcttggttcagattacatgaactcactttctgtaaattaatagtcagatcaagtatcttcttacagtgttagaagaaatggcaaactttgagaacaaaaattgtcctttaaaaaaaaactatcaataattagtcttggccgggactggtgatgggcacctataatcctagcactttgggaagccaaggaaggaggatcacttgaggccaggagttcaagaccagcctgggcaacagaatgagaccctgtctctatttttaaaattaaatattttgtctgtctgtttgtttgtttgtttgtttgtttgtttgtttttggagacaaagttttgctcttgttgcccaggctggagtgcaatggcatgatctcagctcactgcaacctccgcctcctgggttcaagcaattctcctgcctccgcctcccgagtagctgggattacaggcatgcgccaccacgcccagctaattttgtatttttagtagagacggggtttctccatattggtcaggctggtctcaaactcccgacctcaggtgatctgcccgcctcagcctcccaaagtgctggtattacaggcgtgagctaccatgcttggcctaaaattaaaattttttaaatgatattaatcagtctagttatcaagtccaatcttgttctacattaatatttcaaaagaggcataatgtatagaatcaaatgtgtacaatatagagtaaaatcttctaataattctgttctaataactgtgtgattacatataagataaaaggatgtctaaataaaaacttgtgtggatttttgccagttaggctattgattctgtttaaagaaaccaactcatgaccagacatggtggcttgtgcctgtaaccccagcacttcacgaggctgaagcgagaagatcacttcagcccaggaattcaagaccagcctgggcaaaatagcgagaccctgtctccacaaaaagtaaaaagcaaaagaaacttgagcatcagcagtgcagtaaagtttaaaagagcacaacacaagaatgcatcactgcaaatgaatctatcaacacacattaatcaagcagctattacataaaagatcaaatataagacgcactcgctgattcacaaaaatattcatgttcagcaggcaaaataacaatgagtacggtatgcaaagtactgccactggctataaaagggtaatggacaccagatttaatctctcaccataaagtggaaaactaaacaaaatacataaaacaattctttggactgtgatcactgaaagcacaaaaacaaacaaggtctcaactcagtgacaccttgagacaatgaaaccattgagttgagacaaccatcattctaatgagttgaagagacacagatcagagttcagagagaatgagatggctggaattcaaggagaagagtaccagagaagaaggttacctgagaaattgctctagaaatcttagtagtggtccctttgagtatttggatgaatactaaactgcatgggcattgggtgagaatcagaacaccatcaagagaagaacaactaccgagattgttgtaagctgaaaaattctacaggtcacacagggctgagagaagtctgaattctattcaaagtggaaagatctcaaacatccaaggctttggactaagctttagttgtacaactaaacaaggactagaataaaggctacactatatctaccattgcaatatttaaaaacaagctttgagtctgccttgaaagaactgtatagcagataaatagaagcgctggctacagtgctgacagaaaccttgtctttcaagccagacaaactggaaaaaggcaggagagggtaggaaagtcatggagagaagaaaagttctctatgaaccaatacaagactcatccctgtgcaaagcatatgacagacccaaaccagaaaagtaaaagctttgagaatcgaactcaaatctcagactagcccctgagtggcatatacacaggacaaacccaaaaaaaaagcaaggcaaagcttttgaaaactgaactgatattgaaaccactacatatagaaagcaggccaaaacttgtggtctgaccctaataaaggttgattgcctgctaaacaaacaaaataaatcagccttctccaagaaatataacacagctcagagtctaccaacataactttcacaaaatcaggaatacaatccagaaattacttggcatacaaaaaatcaaaaaactatgaatttcaagagaaacaacaataaacagataaaaacaaatctctactaatcagatgttggaattaccatggaaagagtttaaagcagctattaatattataactatgcttcaggaggtaaagataaaggtaaagtagccaggcacagtggctcacgcctgtaatcccaacattttgagaagccaaggcgggtgggatcacttgaggccaagagttagagaccagcctggccaacgtggtgaaaccccatcttaaaaatacaaaaattagctgggtgtggtggtgcatgcctgtaattccagctactcaggaggctgaggcaggagaatcccttgaacccgggagacggaggttgcagtgagcccagatcgcaccactgcacttcagcctaagtgacagagtgagactgtgagactctatctcaaaaaaaaaaaaaagaaagaaagaaaacaaaaaagaaaaggtaaagaaaaatgaaatgaatggaaagacagaatagaagtattcaatggagaaaactgagaagtaaaaaatctattaagaaattatttaagaagtaaaaacctattaagcctagatgggcacattagcagaatggagatgacagaaaaaataatcaatgaatataaaaataaatcaatataaattatttaacctgaaaaacaaagaaagaggtaagattgaaaaaaatgaataatctaatggaaatatgggacagtatccaaaagtctaacatacatgtcactggagttccaaaaaggagagtagaggccgggcgcagtggctcacgcctgtaatcccaacactttgggaggccaaggtgggcagatcacttgatgtaaggagtttgagaccagcctggccaacatagtgaaaccccatctctattaaaaattaaaaaaataaaataaaaacttagctgggcgtggcagcacacacctgtaatcccagctactcagaaggctgaggcaggagaatcgtctgaacctgggaggcagaggttgcagtgagccaagattgtgccactgcactccagcttgggtgacagagtgaaactccgtcttgaaaaaaaaaaaaaaaaaaagaacaaaaaggagagtagaaagagactgaggcagaaaaatatttgactgactagacaaatttgttgaaatatataaattacttctaatatagcctcaccataaactcacacgtcatacaagctaacagaagagctgtcccccaaacaaatacatttcactaatgatgcagagctcaaatagcacaaaagaagtaattcatcctctggataaatgatttccaaacagttgattacatactcctactggcaaaaaattaagtagtcagatcacagatatattaacgtataaattatatatgggttactgaatactaatctgttatttaatctaatatgttatatatgttactaatctttattaagttattttttaaaagaaattagaggacagagaaagatggccaaatacaagccttcaccgatcatcgccgcgacagaaacaacaaatttaacaaccatgtccacaaaaaagcaccttcataaaaaccaaaaataaggtgagcaatcacttcgtatcacagaaaggggcactgaagaaggtaagcaagacagtcttgaattgctattccccccaaaagcagctgtgtgtcatggagcacctacgcgcctgggagtgggagagtgcagcgactgtgggatcctgcattgaacagtgctgccctgtcacagcggaaagcagaacaagactaaaattagccaacgtccacctacagagagagtattaagaccagccctagccagaagagaactgcacatcccagtggctggaaacagtattgacaagcctcaccaccgtggcttaaagtgcttggggcctctaaataaacttgaagggcagtctaggccacaaggactgaaattcctaggcaagtcctagcactgtgctctgagtccactggctctgaacatgaggggcatgtgacctggtaagaccccagctggggcagctaaggaagtacttgcgccactcctctccaacccctggcagcgcagcttgcaacaacaaaagtgactccttccatcagcttgaggagaggagagtgaaaagttaaaaggactttgtcttgcatcttggatactagctcagccacaatcgaataggaaaccaggcagtcatgaggaccccattccaggtcccagctcagtcatgaggaccccattccaggtcgtagctcgggcaacatatatacacacacgctgggccagaagggaacccgctgccttgaagggaatgacccaatcctggcaggattgattacttgctgactaaagagcccttggaccctgcagaaccagaagcaacatccaagtagtaagccatgggccttgggtgagactctgaaacgtgccggcttcaggaatcacctcggacacagtggtgtaaagcaccaaaagggctcctgagatccccgattctaggctttggctcttggacagcatttctggacatgccctgggccagaagagagcctgctgcccaaaagggtgagtcccaggcctggaagcattcaccacaagctaactgaagagtccttgggccttaagcgaacattggcagtaacctggcagtattccccatgggtctgtggtggtggtggctagtgggagatgctcctctacctatgtaaacaggagggaagagtgggaaagactttgagcaacatcttagccacagaatagagcaccagtcagatttctaagagtttttattccactccttggctcctggatggcctctctagacctgccaagggcctcaggaaacacgctaccctgaagggaaggacataagccttactggcttcgccaactgctgatggtagagccctagggccttgagtgaatatagagagtagccaggtagtggttatagcaggccttgggtgagacccagtgctgtgctggcttcagatctgacccagcacagtcccaatggtggtggccacataggtgcttgtgtctccctacacccagctccaggtggttcagcacagagagagagagagcaacataccatttgtttgggacaaagtaatggaagaaaacaagagtctccacctggtaaccaacagaattcttccagatcttatccaagaccaccaaggcagtacctctatgagtctacaagaaccaaagcattatgggcttgggatgccccctaatccagatacagcttagatcacaatagccagtcccttcaaatacctggaaagccttcccaagacagatgggcacaaataagcccagactgtgaagactataataacagtccagacactgacaaacatccacaagcatcaacacttcctaggaaaacatgacctcaccaaaaaactacataaagaaccagagaccaatcctggagaaacagagatatgtggccttttaggcacagaattcaaaatagctattttgaggaaactcaaagaaattgaagataacacaaagaaggaattcagaattctatcggataaatttaacaaaaaagatgaaatattaaaaaagaatcaagcagaaatttgagaattgaaaaatgaaactgatatattaaagaatgcatcagagtctcttaacagaattgatcaaacagaagaaagaattagtaagcttgaagacagcctatttgaaaatacacacttagaggagacaaaaacaaagaaaagaatacaaaagaatgaagcatgcctacaagatctagaaaacagcctcaaaaggacaaatctgagagttattgtccttaaagaggaagtggagaaagaaataggggtagaaagtctattcaaagggataataacagagaactttgcaaacctagagaaagatatcaatactcaagtacaagaaggatacagaacaccaagcagatttaacccaaagactacctcaaggcatttaataatcaaactcccaaagatcaataataaggaaaggatcctaaaaggggcaggagaaaagaaacaaataacgtacaatggagctccaatacatccggcagctgacttttcagtggaaaccttaaagccacatgagagtggcatgaatatatttaaggtgcagacggaaaaaaactcttaccctagaatattatatccagtgaaaatatccttcaaacatgaagaagaaattaagacttccaagacaaacaaaagctgaggtgtttcatcaccatacctgtcctacaagaaatgctaaaggaagttagttcctcaatcaaaaagaaacagatgttagtaagcaacaagaaaagaaatcatctgaaagtacaaaattaattggcaacagtaagcatacagaaaaacacaataacaccataacttgggcatataaattactcttaagtagaatgactaaaagatgaacacagacactacaataaaatataaacagaaacaacaaaaagttaaaaagcagggagataaaggtaaagtgtagagcttttattagttttctttttgcttctttgtttaagcaatcagtgttaaactgtcaccagtttaaaataataagttataagatagtatttgcaagcttcatggtaacctcaaatcagaaaacatacaacctaccaatattgaaccaggaagaaatccaaagtctaaacagaccaataacaagtaatgagattgaagccataataaagtgtctcacagtaaagaaaagtccaggacctgatggctttactgctggattctaacaaacatttgaagaactaataccaatcctactcaaattattccgaaaaataggggagggaatacttccaaactcattcaacatggccagtattaccctgataccaaaagagacaaagacatatcaaaaaaaggaaaactgtacaccactatctctgatgaatattcacatgaaaatcctcaacaaaatactataatagcaagctgaatttaacaacacatgaaaaagatcatttatcatgaccaagtgagatttatcccagggatgcaaagatggttcaacatatgcaaatcaatcaatatgatacatcatattaacagaatggagaacaaaaacaacaagatcatttcaactgatgctgaaaaagcatttgacaaaattcaatgtctcaccgtgacaaaaaaaaccctcaaaaaactagggagagaagaggcatacctcaacataataaaagccatatatgacaaccacagatagtatcatactgatgggggaaaaactgaaagtctttcctctagatctggaacacaacaaagatgcccactatcaccactgttattaaacatagtactggaagccatagctagagcaatcagacaagagaaagaaataaagagtggtggcacttgcctgtggtcccagctgcccaggggagagggggctgaggcaggagaatcgcttgaacctgggaggcggaggttgcagtgagacgagatcacgccactgcacttgggtgacagagtgaaattcggagagaaaaggaaggggaaggggaaggggaatccaaattggaaaggaagaagttaaatttcccttgtttgcatatgatatgatcttatatttggaaaaacctagagagtccaccaaaaaactattagaagtgattaattcagtaaagttgtagaatacaaaatcaacatttgaatatcagtagcatttctatatgccaacagcaaacaatctgaacatgaaatgaaaaaaagtaatcctatttaaaatagctacaaataaatacctaggaattaaccaaagaattaaaagatctctacaatgaaaacaataaaatactggtgaaaaaaagtgaagaggacaccaaaaaatggaaagatattccatgttcacggattgcaagaatcaatactgttaaaatgtccatagtacccaaagcaatctacagattcaatgcaatccctatcaaaatactaatgacattcttcagagaaattaaaaaaaaaaaaaacattagctcggcgcagtggctcacgcctgtaatcccagcactttgggaggccgcggtgggcagatcacaaggtccgaagttcgagaccagcctggccaacatagtgaaaccttgtctctactaaaaatacaaaaaattagccaggtgtgctggcatgcacctgtagtcccagctactctggaggctgaggtgggagaatcgcctgaacctgggaagtggaggttgtggtgagctgagatcacaccattgcactccagcctcggcgacggagtgagactgtctcaaaaaaaaaaaaaaaaaaaattataaaatttatatggaaccacaaaagacccagaatagccaaagctatcctgagcaaaagaacaaaactggaagaatcacactatctgacttcaatttataccacacagctatagtaaccaaaacagcatggtactagcacaaaaacagacacacagaccagaagaacagaacagacaactcagaaacaaatccatacaactacagtgaactcaattccaacaaaggtgccaagaacacacattgggggccggacacggtggctcacacctgtaatcccagcactttgggaggccgaggcaggtggatcacgaggtcaggagatcaagaccatcctggctaacacggcgaaaccctgtgtctactaaaaatacaaaaaattagccgggcgtggtggtggcgggtgcctgtagtcccagctacttgggaggctgaggcaggagaacggtgtgaacccgggaggcggaggttgcagggagctgagatcatgccactgcactccagccagggagacagagcaagactccatctcaaaaaaaaaaaaaaaaaagtaacctgtttcatagtttaataaataatgttttctgtttcttagttgtacaaaaaatgatgcatcttacaatagcatcttatggagtcaatgaaaaataataaatgtacaggccaaaacacatcaagttttcttcatccaactaactagaaaaatagaagacccaccatacacactagattaaggctacttagagatgagagacagtagtatgatcgatctggtcttcaagtaattgggacttcagttattaattgttccttaagtctcattctataataaatgtgcttaattataattttaaaagtacttacgtacattgtgaggaaatcaatatatagctattaaaatatgtaatgttttaaatgggctttaaagcttcaaaaactaaaatgccccttgaaaactaggtttagagggaactaaaaactactaaattatttaataggtgatcatccaaaataaaatgtgtaacaaaaggaaacaatgtaaggttacagtaaatatgggatttaaatacagtaagaagacaattcaactgtcagtaaactccctgtaatgctaggaaaatgaatgctaggattatcagagattttttaattttgtttcatttgtatttgccaaaaaaaaaaaaaacacccatagaataaaaaataccagtttctcttgtaatttgcattttttaccaccacatttccccttctggaaggaattaaaggaagattactaagatgggtcaagtaacaacagaggacaacaagtaaacaaagaagccacagaatgtagggcaatgcttatcagtttaaccaagtgaatcaggagactatgaatgtaatggaacaaatttagccataaattcactgagctgggacaaccatctgaaaacctacactgtgatctatggatttacacaaaaggtgcagaactggaaagtgggagaagaaaactgtataccaaattatttcctaggaattatccagtctgatgatttttccactttaaaactttctgatcacctgagcccaggaggtcaaggttgcagtaagcagtgactgtgccactgtactccagcctgggcaacagagcaagaccctgtctcaaagaaaaaaacaaaaagaaaaagaaaaaacaacattataaaactcaaatatttctaccacaaaattaaataagagattagaaaagtgaagtttttagccaggtgcagtggctcatacctgtagtcccagcatttgggaggctgaggcaagcggaacacttgaagccagaagttcaagactggcctgggcaacatggcaaaaaccatctctacaaaaaatcaaaaattagccaggtatgatggaacatgcctgtagtcccagttactgaggaagttgaggcagaaggaatgcttgaccccaggaggttgaggctgcagtgagctgtgttcatgccactgcaagccagcctgggtgatgaagcaagcactcttttttttttttttttttttttgagatggagtctcgctctgtcacctaggctgtagtgcagtggcacgatctcagctcactgcaacctctgcctctgggttcaagtgattctcctgcctcagcctcccgagtagctgggattacaggtgcccgccaccatacctggctaactttttgtattttttagtagataaagggtttcaccatgttggccaggctggtctcgaactcctgtcctcaggtgatccgcctgcctcagcctcccaaactgctgggattacaggtgtgagccaccacgccaggctggcgagtactccgtcttaaaaaaaaaaaaaaactacaatggctgataaggtaagaattagagaccagttaccatctgaactctcaagatacttacatgtaaaagaagagttgtatggtcatactcacctttctaccagaaatacttctgggatgtttttattcatgtatgcattcatttattcatttatttaacaaatatttattcagttcctatgatgccaggctgtttccaacctctgaaggcacttgattcaagccacaagcccaatttcctctactgcccacccccaactccaacagctcaagggcagttagttcaaatctttctgaataagaagataagggtagtaaaccacaaagaaccacactacggcctgccaataaaactagctaatttcattcaacctgttaaaatccaatcagaaagaaaaataaaccaaacataagaaaatttttgcgatctacagaactttagggctgggcgcagtggcccacgcctgtaatcccagcactttgggaggccaaggcgggcggatcacctgaggtcaggagttcgagaccagcctcaacatggagaaaccccatctctactaaaaatacaaaattagccgggcatggtggtgcatgcctgtaattccagctactctggaggctgagacaggagaattgcttgaacccggaaggcggaggttgtggtgagtggagattgcgccattgcactccagcctgggcaacaagagcgaaagtccgtctcaaaaaaaaaaagaactttaggatttgatagcatatctaatattccaaaataaatacatataatttcttaattgacatgccatctgtcaataaaagatttaaaaggtaatctgctacaagtcttcattcttatcactaacctttcttcatgtgctaacatgtacatttccttctttactgtgccttgactttccaaataaatttgtgtgtgtgtctgtaacagaatgagagacagacaaacagagacgcatttgggttttattataacgtattcacaccttaaggaaggagaaaggctgaggtagcaaaggaaaggaaaaaagtaaatggaattataaaagtgatggcttaaaaaaaacatacatatcacaaaactgttcttcctagcagcaattctctaacactcaaatttgtctatctagctatctaactcttaagaaagtaattaagcatttttaaataagtcttaaaaagcacggtggctcatgcccgtaatcccagtactttgggaggccaaggcgggtggatcacctaaggtagggagttcaagaccagcctggccaacatggcgaaaccccgtctctactaaaaatacaaaaaattaaccaggcatggtgacaggcgcctgtaatcccagctactcgagaagctgaggcaggagaatcacttgaacctgggggtggaggttgcagtgagccaagatcgcatcactgcactccagcctgggtgacagagctagactccatctcaaaaaaaaaaaaaaagcttatattttaaattaaaaaataaaacaaaagctcatgttcccttctaaaataagacctatgagaaaagttccaccatggaactagtaaaatcaaaataactattttatgttagttcagtctatgtaaattgtactgtaaagtttttgtatttagcattttagccaagataaaaatttaataaatacaggttgaaatctagaattgcacttttttttaatatatagtttttttttttttaattgagatggagtctcgctctattgcccaggctggagtgcagtggcaccatctcggctcactgcaagttccgcctcccgggttcacgccgttctcctgcctcagcctcccgagtagccaggactacaggcacccaccaccacacccagctaattttttatatttttattagagacgggatttcatcgtgttagccaggatagtcttgatctcctgacctcgtgatccgcccgcctcggcctcccaaagtgctgggattacaggcgtgagccaccgcgcccagttgaattgcacgtttttaatggtcatatttttatatcatgttgttaggaggaaaaaataaaatacctaagaatgatagttaaaaatccaaatgattctttactatcctactactctaattttaaatcaacattaaatttttcccagtatatttaatacatattataactaaaacattttaaatgtataaaagtgctttttttttggtagagatgggggtctcactttgttgaccaggctggtcttgaactccttaaaagtacattttttacagtcacacaggcaaattcacctaaataatttacaatgtagaattgaacatagtctgttaagggtgctttcaggtcatcagaatctgaaaattatacattaaaatagcagtccccaacctttatggcactagggaccagtttcacaaaagacaatttttccacagaacgggggtcagaggtgggtggatggtttcaagatgaaactgttccacctcagcgggagatgaacggcaggcaagcgagcattaccacctgagcttcacctcctgtcagatcagtggtagcattagattctcataggagcacaaaggagggatctgggttgcttgctccttatgagaatatgtacatagacctgaggtacatagacctgaggtactacagacttggtcaacttttggcctccttcttaaccatcagaggatgctaaaacatggtctgaaacagaatgtagacaaatctgacaaaatctgtcaatctggtaagatggttaaaataaagggaaggaagtagactgctatcccaactgtttccaaaccaatcactgaaatctccaatacacaaatcaaagccatcatgctaatttttgtcattccataaagggtagcaaacgtaccataaaaacaaaacagagatctactcatgttgtggtgactgaaaacaaagattttacaggcctttttacttgacacaggatgccaaggaagcttctaactgcagaagaacagaatacagatcccaaggaaaagcaacagcccaaggggcaaggaagtgagggggaaggcagtaaagaaaatgatactcgtgcgataggtgaaaggagagaaagggaatctgtggaaacttccaccttctgctaaagaacagaaaaaaatcataggatattccattcgaccaacaatataccctctggggccagggagtagagaagctagctgaaaacagcctcattagagtcaaaatttgacatgtctcaggcaaaatcattcttaaagttttgttccatatcaagttttcatgtcttcagatttacataagaagggttttcctcatctataaccaattaattggcatttccagctagaaataagaacttaaattacacagtggtcccaatgattaaaagctcccaggattgtaaacagactttgatttgcaattaagaatattttactcctactccagtaatgacaagagcaaaacaaaaatacatcaagtctttctcaaagccaatacagtaagtactgaagaaattgtgctaatgccttaaaggttactgaaaataaggtacttacagaagtatgcatataaatctctactagaaaggataaaagtgccagtcagcaagttcattcaggccagatgtggtggctcacctgtaatcccagcactttgggggactgaggcgggcagaccacttagtccagtcaggagctcgaaaacagctgggccaacatggcaaaaccccgtctctactaaaaacacaaaaattagccaggcatggtggcaggcacctgtaatcccagctactctgcaggctgagacaggagaatcgcttgaacctgggagacagaggtggcagtgagctgagatcgcaccactgcactccagcctgggcgacagagtgagtctctgtatccaaaaaaaaaaacaggccaggcgcggtggctcacacctgtaatcccagcactgtgagaggccgaggcaggcagatcacctgaggtcaggagctcgagaccagcctggccaacatggggaaaccctgtctctactaaaaatacaaaaaattgccgggtgtcctggtgagcggctgtaataccagctacccaggaggctgaggcaggagaatcgcttgaacccaggaggcagaggttgcagttagcagagatcacacaacttcactacagcctgggtgacagagcaagactccgtctcaaaaaaaaaaaaaaaaaagtgcattcgccttattgaaaactcttcttataatatcaaacccaaatcagcatccatcatcatagattattagacttctatctcaaatacacaagaaaaaaataataaagtcaaaccctatgtataaacccatggtgacctcaggcaattttaaatccaaaattattcaaaattatttgaagggataaagaatcaaattgccagcaccctcaaaatagaacagtacaggacacactggatcccattattgagcatggtactactacattcaacacaccatggatattatttcatcaatttcatataaactttggcagcagactttaagttcctagaaaattgttccccaaagttttgtaaccttaattaaagtataataattccaagaaacaaatcacagagaggcaaagaaaacaaacatatagaggccatgatgtcattagttaaaatgacatatgaaaaaatgcaagaatgttgataatgattaaagctggctgatgagttcataggttttcttttcgcttttgtgtatgtctaaaattttctatgagaaacagaatatcaaattttttttttttgagacacagtctcgctctgtcaccaggctggagtgcagtggtgcaatctcggctcactgcaacctctgtctcccgggttcaagctattctcttgcctcagtctcccgagtagctggaactacagctgcgtaccaccatgcccagctaatttttgtattttcagtagagacagggttttcccatgttggccaggatggtctcgatctcttgaccttgtgatccacccacctgggcctcccaaagtgctgggattacaggtgtgaaccaccgtgcccagccatcagattttatgaacagtatatcaaactcaccaaaatgagtttttattggctgtttataaattgggggtgggggggacacggtaattatcattaattaagtgcctataaagtgtttgtttttttgttgttgtttttttgttttgagacagagtctcactctgtcacccaggctggagtacaatggcacaatctgggatcactggaacctctgcctccagggtttaagcaattctcctgcctcagcctcccaagtagctaggactacaggcacgcaccaccaccccgcctcactaatttctgtattgttagtagagatggggtttcgccatgttggccaggctggtctcaaactcccgatctgaagtgatccacccaccacggcctcccaaagagctgaaattacaggtgcgagccacagcccccaagtaggtgttttaatatataagaactctgtggccaggcatggtggttcacacctgtaatcccagcactttgggaggccgaggcaggcagatcacgaggtcaggtgttcgagaccagcctggccaatatggtgaaacctcgactctactaaaaatacaaaaagtagccaggcatggtgacacacacctgtagtcccagctactcaggaggctgaggtgagagaatcgcttgaacccggaaggcacaggctgcagtgagccgagatcacgccactgcactccagcccgggcgacagagcgagactccatctcaaaaaaaagaactctatgagatagaatcagcccaattttacataaaagaaaattaagaatcaagagggtaaacttaatcttcctcaagatcatataggagctgaactgagacccacagccaaagaaagaaagaaggaaataaaaaaggaagacaatgactggtaaagggggtaaaaaaaaaaacctttttggcactaatatacaaaagaaacaatcagagaaataagccaggcatgcatggtggctcatgcctgtaatcacagaactttggaaggctaaggtgggataatggcttaaggccaggagttcgagaccagcctgggcaacatagcaagacccccatctctatgaaaaaaaatttttaattagaatttaattttttttaattagagaaatacaatttccagaaaatatcactaggtaaaatattcttatagaagtatgcaataacaaatattcaagcaaaatgaaagaaaaaatagaactgtatttagaaatctacactgtaagggtggatatcttgaggattagaatccagaggagaaatcccatttcagccatgatgttaaccagttgtgtgtgtgtatatatttacatatatatgtaaattcacatatacatatccatatcaaaacttccctaaacctgaatttaacatacaacttagaatagattaagaaaatgttctaaaaagtgtcattacatatttaacgtggtagtctatatttatcatccagaagaatttagcatataatcctcatatttgaagttcactgtacaaatacattactccaacactccagtgttaaggcaagcatctaaaagtaatattttgctgggtatcgtgactcatgcctgtaatcccagcactttaggagaccaaagtgggagaactgcttgaggccaggagtttcagaccagcctaggcaagacaacaaaaccccgtctctacaaaaaaaaacaaaacaaaagaattagccaggtgtggtggcatgtgcctatagtcccagctacttgggaggctgaggttggaggatcacttgagcccaggaggttgaggctacagtgaactgggatcacaccagtgtacttcagcctgggtgacagagcaagaccctatcacatggccaggcacagtagctcatgcctataatatcagcattttaggtggccgaggtgggcggatcacttgaggccaggagttgagaccagcctggccaacacggcaaaactctgtctattactaaaatacaaaaagtagctgggcatggtggtgcacacctgtaatcctagctactcaggaggctgagaggcacaagaatcacttgaaccagggaagcgctgaaccagggaggcgctgaacctcggacagggaggttgcactgagctgagattgtgccacagcattccaacctgagtgacaaagtgagactctgtctccaaaaaaaaaaaaaaaaagaagacgaagaagaaaaagaggaggaagaggaggatgaagaggaggaagaggaagcgtaagaagaagaaacaacaacacaattaaacaccactacaaacttactagaatgactaaaatttaaaacactgataataccaagtgctgacaaggatggagaacaactacagcaactacattactggtaggaatgcagcatgctacagccactttggaaaacagtttgacagttcttatgaagttaaacatacatttaccataccaagcacactcttcagtattcacccaggagaaaggaaaacatgtccaccaaaggcctataggcaaaggtttggggcaacttacccaaagtaactggataaacaaattgtaattacatccatagaatagaatacttctcagcaaaaattaaaaaagaaacaagcaacttaattatgcaacgacatagaggaatctcaaatgcaatttgctgagtacaagaagctagtcacgaaaggctacttgctacatgattccatttttattcaacattctggaaaacaaagtgacagggacagaaattagatcagtggttgccaggggatagggatggggaagagagaaatgactacaaaggggtaaaagggaactttttgaggtgggggaaatatctcatataccaaatgtgatggttgttatatgaccgtatacatcaatctacacaactcaaaagggtgaattttattctatgtaaatcataccttaataaacctgacttttaagatgacaaagatgtaatctctgccttcaagctcatgatctaatgagagaaatatatataaacacataatttgaacaaggtaaatgctatagtaagttatgaacaaagttctgtggtagaatggaggaggaataaagtctgtctcagagtgaggcaaaggattctcagagaaaataacatgtaagctatgtcttaaaagtaacaaggctgggcgcagtggctcatgcctgtaatcacagcactttgggaggccaaggcaggtacaatcactgaggtcaggagttcgagaccagcctagccaacatggcgaaacccagtctctactaaaaatacaaaaattagctggacacagtagcgtgcgcctgtaggcccagctactcgtgaggctgaggctagaaaatcgcttgaactcgggaggcaggggttgcagtgagccgagactacaccactgcactccagactgggcaacagagcgagactccgtctcaaaaaaaaaaaaaaggtaacgagcatgatgatgacagaccaagaagaaaaggacccaagcagagagaacagttgagagaaaaaacacagaggtatgtaaaggcaagattagccatgtgagagacagtaaacgaagtgtaggatgagttagagcatcagaggtcatgccatacatgataagatttgtgttttagaaagataagtataaatatcatgtgggaaaatatatggaggtatagaatgactggcagagaacaagaacagttttgaagggtgttacaataatcctagaaagagatacctggggtctgaattaaggttcaattaaaaggctatttagtgaaagactacttatgggaataaggaagaaaagacaagttaaggttaattgaaatttctgcaaagaacaagtgatcatcaataagatgagaaacataaaaggaaatacagatttgtttgataatccaagttggggggagaatcatctggcttccattttcctatctactaactctcttccttgtaggcatgccttctctaactaaaactgatatttattatgacttatctacttgaactattttataaaataactataagaagtaaaggcaacacagcaaaacctcagcaaagtttttacagtatcttagatatagcagaatagttattttaaaggtaaaaataaggccgggtgcagtggctcacacctataatccacgcactttgggaagccaaggcaggaggattgtttgagcccaggatatcaagaccctagcctgggcaacatagcaagactccatctctacaaaaaaataaaatttaaagaaattaaaaataagttttaaaaaagaaaacattgggcagtttggctagagcataattattagaacagataattagatttcctagtttttcaaaaatttgaattgtaataaaaggaaatttcaatgttctatttcaattttcagcagcaaataaatgtgtacaaaaaggaacttaaagaataaaaaataaatgaaaataggagaggaaagaataaatttaaatactgcatcgccaacttatgtaataggttccaaatttgtctttaaaaagcaattatgtgatggctaggcatagtaggctcacacctgtaaccccagcacgttgggaggccaaggcaggtggatcacctgaggtcaggagttcaagaccagcctgaccaacatgataaaacctcattgtattagtccattttcatgctattgataaagacatacaaaagactgggaagaaaaagaagtttaattggacttacagttccacatggctggggaggcctcaggatcatggagggaagcaaaaggcatttcttacatggtggtggcaagagaaaaagaggaagatgcaaaagcagaaacccctgataaaaccatcagatctcatgagacttattcactaccacgagaacagtatgggggaaactgcccccatgactcaaattatctcacaccgggtccctcccacaacacatgggaattatgggagtacaattcaagatgagatttgggtggggacacagagcaaaaccatatcacccatccctactaaaaatacaaaaattagcctggcgtggtggcaggcacctgtaatcccagatactcagtaggctaaggcaggagaattgcctgaacctgggaggcagaggttgcagtgagccgagatcataccactgcactccagcctgggcgacagagcaagactctgtctcaaaaaaaaaaaaaaaaaatcaattatgtgaaatttagaatatattgccccaaagaaacaatgtgacactaaagcatagctaaacaatactagggtattacaccaacctgctgaataaccaaccccaccaccatcaccaccaccaccaccactaccactaccactaccaaagtacagtgttgaggagaacagggtgctctgaggctgcctgaggttcaacatcttttgtgacctcgactggggtaattaattctacaagtctaatattcctcacctttaaaatggagatgataaaatcacctgctccacacgagttactgtgaaaattaaaagagggaacctaaagcacttagcacagtcatccatccaacatgtatttattaagcacctactacatgttaggtacaaggccccaaggccctggcaatgaaacagtaaacaaaaaaagtaagtccctacttttatggagtgtgtattctaataaaagaaaacacgcaataaaaaaaatctgatggagttaatgctatgaaaataaagcaggatataagagataaagagtaacaaggagaaggatactattttggtagtggggaaaggttctctaataaggccacaaattttaacaaagaccataagagaatgaagaagagggtcatacagagaactgggggaagaaatcagatccatttctggcaatatggtagactagatgcccagaaaagtacttgtgattcagaatttcttaaaatgctgaatattaaaacaaaaatagtatttttcatgagtggctgagctgaaagaaagaaaaaacaacaaagcattggtgagcactgaaaccagcctctcccctgggagcatccatcaattccccagtggcttagaagtcagtttaagggactggtgagaaggacataaaggttggggcctaaacaaggtgggaaatctgaaaagcaacactcagtggatgaactgcagaggagggtaaacaacatgctaaacagagatcacagttggcatgtttgcctttcccagtctcggtggaagagaaaaaacgaagtcacccttcgctcactccagtttaaggacaaaattcatactacctatgtggtctagaaaaactcagactaaaaattcagtttcgagagattctgggttggaagagactagagcatgacagaagcaaacaccaatccagccaagaggagtacactaaacccaagccttcagtgatattcacaaataaaaatccatggaagattatctcacaattaaaaagaaattcacaaaataatgaaaaaagcccccaagaatcagcagaacaagcctttcaggaacagaagaaacgatgaggaacatgaaaataatcagatatataatataaaaatgttaatgtttaaggaaataaaagagatatagaaagtatgactgaggaaaagaaactgtaaaaaacatgaatatgaaaaaatcaaacaattgtaatgtttctggatagaaacattacaattgcttattgatagtcatacaataattggatatttgagaggagatcattctaggcaaaggaaaaaataagttcaaaggccctaaggtaagactgtgcttggcttgctttaggaagtacaaaagggccatggcatccagagttgagtaaacaaggaagaaaagtgggaagaaatgacgaccaagaactggtacttaataggtcacaaaatacctcaataaatattatttattatcccataatttctattggaaaaatttggatattagaaataataatttcttctttaccatttctgcattaaatatagaagccagagcagagctacagaggatctcaagtaggttcagaaggaaataagaaaatattccttttctatgaagtagggagagtcttcagtagaggtcccagtgccaaggaagacatctgggtcttgtgtgagcaaggtagaaatgaagtgattcagaagatacatttctggaaataataatgatcaacaacaaccaaaaaaaaaaaaaaaaagtcaagatggaattaccatttcaaagtaggagacatttcaaacttgggcattaattggtaatcaggacatcctcagagtactcaaaaatttcacggttcaagtgaacgtttacatcctatgacaatgagaatttagcataaatgaaactcccaaagatatgccaaactttttaactatctggtttaattctcaactttttctaaatattttcaaaagacactaacaagtagcaaaatagtactactctgatttttcttttcttccatattcctaccctcagactaaggtattgcctaaaaaagccatgaacaaaacacaagtaatacaggttaagaataatattcataagccacaactagaggtataatcaatccctaaatattaaagagttggtcattccattttttcctgattagcaaaataacagaaaattgactggtggatatcttaaatacatataaactaccatgcaccatttgacacatgaagaaatagatgcaaagaatcaaagtatgcattgttaaatcaatgataaaagttttaaaataattcattttctcaaagcttatcactcttaacaatgtttctaattatcataacctaatacaattcctgacaaatttaatcaaattaggttctaatacaagaacacaacttatattaataatcacacagtataacatggtacacacaaaattcaaaatcaaacaacctgagtccaaatgccatcttactaactatgacacttgagcatcattgaccactccaatcctgttttcatgctataaatcaagtttaataaagtactgccccatggagttgttacatggaaaaaataaaataatcccgtaaaacacttatgtttatcagcagactcagatatacaccctgacttacatctaggttccattctattataactggatcataaagcaaagcattaatttctttttttatttttattttattttaatttaagttcaggatacatgtggcattaatttcagtctttccttctgaagcaccacttaaataacttgacgtgactgttctcacacagtgcattcagcactatagaataaagtcagtgtctaacaataaaaactagaaagatatttgtgcaatatgttatgctaaatgtagaacttggctaaattgaaaattttctgaaatactttatgtaaataaagaaacagagcagtccctacaaatagaaatgactcctgaaatttttatgtcaaaagtcattgtgtcaatttatgtgtaatattcaagtgactaccaaatggtcatcatttgactcactcaaactattgtgtttcaaaagttcatccccatgcagataaacatgttaaagatagtataattcactaaaaatagtcaagttctctattgatacaaatgggatttctatgcaggttacttgtattcaatctaaatgactaagaacttataaagacttaagacgatcctgcaagaaagatgcctaaggggaaaaaaaaagaattaagataaagtagtattttgctctaggttgtttattttaagtgtgtagcggttggggaaaaaaacatgactcctttatattatcctaaaacattctacaattctttttttttttaataatcctttttgagacagagtctctctctgtcgcccaggctggagtgcagtggcgcaatcttggcttactgcaacctccgtctcccgggttcaagcgattcccatgcctgagcctcccgagtagctgggattacaggcgcacaccaccacgcccagttaatttttgtatttttagtagagacagggtttcatcacgttggccaggctggtctccgactcctgacctcaagtgatccgcccacctcggcttcccaaagtgctaggattacaagcgtgagccactgcacctggccaaacagtctataattgtaaaagctatgaaaactcttttttttttcttttttaagagatagggtctcggccgggcacggtggctcatacctgtaatcccagcactttgggaggccaaggcaggtggatcacatgaggttgggagttcgggactggcctgaccaagatggagaaaccccgtctctactaaaaaaatacaaaattagccaggcttggtggtgcatgactgtaatcccagctacttgggaggctgaggcaggagaatcgtttgaacccagggggcggaggttgcagtgagccgagatcacgccactgcactccagcctgggtaacgagaacgaaactccgtctcaaaaaaaaaaaaaaaagagagatagggtctcattctgtcgcccaggatagagtacagtggcataatcatagttcgctacagtctcaaactcctgggctcacgtgatcctgccacctcaccatctccagtgggtaggactacaggcacacactaccacgtagacctgatttttttgtttttttgtagatataggatctcactatgttgccctgggtggtcttgaactcctggcctcaagcagtcctcccacctgagcctcccaaagtgtcgggactataggcatgagcaaccgcacccggcaggaaaattcacttaattactaaaattttaaaacaccacctccacacataaaatcccccatgaataaatctatattttgttttggtaatacaaggttgctttctaagataacaattgctcatctgcctgtatgtataaatacatgtaagcatttgggaaagaagaaaaatgactaattttatcttcctacaatttcttcagtgatctacactagaactccattatctgaaattatctaaggtattcctaagcagaaaaataagttggtcaattgtagcctaagttggtcctatatttattcaatggctatcacacattcatcacttcgttataccttagacttccagcagataatgaatataacctttaaatccatcactttacaaatgcctacaaatattaggtaaatataacaaaaaatacttttcaatgtagaactgagcttgagtttgcaaagaaagaaagaaaggaaaatccccgagcctaaagtgaagaagaaacagaaaaataagtatctgaacttccattacaactgctgaagaggcaagaaagaggaagctagtactagggggcttgaattttatttcctttttagaaacaaacaaaaaaaaagtattcactcaagatggggaagtagagataaaatctctatataaatatgggatcctcaaaaggttgaccctcaggaaaaagtagattcttcctctcccccacaaaaaaacttccctggcacaggaaattacaaataattagtctttggctgggctgctgatttcctttttttttttaattctatagagataaggtctatgttgcccaggctggtcttgaactcctgggctcaaatgatcttcctgcctctgtctcccaaagtcctgggattacatgcatgagccaccgtgcctggtcactactgattatttttaagtttcctctaagatagtaaaattctgggatttcctctaagatagtaaaattctgctattcacataggaagtccaaatttacactactggcatgaacaacaaaccccagaatgacaaatttaaaaaacaaaacaaaaaaaaaaacaatttcaggtataatataccccctgaggctccaggcaaacttaatccatacgttctggtaataaacatttcctaagcacatactatgtgtcaagtactcttctaggggctagggatgcaataagcaaaacagacaaaaatctctactcttatgaaacataaacagtagtccctcttgatctacagggtatacattgcaagacccctagtggatacctaaaaccacagataataccaaatgctatatacactatgtttttttgtatacacacatacctatgataaagtttaatttataaattaggcacagtaagagattaacaacaataactagtaataaaatagaacagttagaacaatacacagtttccaatttttgacagtttgacttacaatttttcaactttatgatggtgtgaaagcaataagcattcagcacaaacctcaatttaacaatggagttacatcccaataaactcattgtaagttgaaaagtcaaaactaccataaatcaacaagtattttcaacttacaatattttcagctttagatgtaagtgcatcaagtcaaggagcatctgtgtaattcacaattacatggatagaagattcgtacatactgcaaaccttagcaacctcagcacatgattttttttccttgtaagtcaagaacttccacctattcacttaaaaaaagtgctttacaatgtctctgtgtcacatccaaattgccaacatcactactcttgtcccgaacattattaagtaaaataagggttacttaaacactgcaataccatgacagtcaatctgatcgtggagagggtagtcacttagtaaagtgactaaaggacaggtagcatatacgtagagcatggatacgctggacaaagggatgatttgcatcctagtcaggatggagcagaatgcttgagatttcatcacactactcaagagctgcacacaatttaaaacttaggaactgtcaagggcttcaagatggctgactagaggcatctcctacttgcctcctccactaggaataaccaaaatagtgagtaatcacaccttgaatagataatccaagaaagaacactggaattcaatagaaaaatgacaagaaacacctaaagaaaggaaggagagggaaacaagacagcctgctcggctgggagccgagagacaatccccactgcggggaaacagtaagtgggagactccctgtggtccacattcccactgtggactcctgcaattctagccattggggagcccctaggacctcatgggctctgaaactaacataaggatctgtctggaaatggtgcaacagcaccactccactgaggaaaattgcactgggtcccataatccccctaagtcctaagcagctacaacaaggcaccattttgacaacccagcccacaacagactgagcactatcctggggcccagcagctggtgcacagacagaagtaagaaacaggctgccaccaccaggactgaggcacaagcggggcatgtgtccccgaccgccgacctaggctgccaccattaaaggcagcctcatgttccccagtagcagcagcacagcacagccactgctgcccctcacccaatcattccagggcctgggaaccaccctgtcccttcttaccacagtaggtgtctgcacatattgttggggggcctgatgacatgccagcccagcttaaccaggtccccatgccaaagcgtgcagactaggggcctggggattgtctccctcagcccactaccattggcacctgaacacaacacctatcctgaggatagggctaccccccacctgccgctaccaccacagctggcatctacctgcatgaacaacctgcaaatctagagactggcaggcctagaccatcacacccaccgccaatatacacacacaccactcaggatccagtgggtcatctctgcctttacccatactatgctggctacccagaagactgagagtgcacccacccacacagcctatcactgccactaccagaatcacagcaatccatctggaagcccaggaattggttcacctcaacccactgatactggtgccagtgtatgctgccctagagcccaaggacaggcattctcagcccactgctgtcaccactgaggcctgaaaagtgccaaacatggcacctcagtccccagcaaaacttcaccacagcctccattaatagtccgaaccctaaggcccccaaaaaatcacagacgccactgacactgtttatacctgaaaaaaaatcacagagactatactaccacacagacccagaatcaaagccaatgcactctgcccaaccaacatcatagatacgtcttcaaataaaaagtcctcccctatgaaagcaagttcaaataatttgaaaaagtcattactacaccagaggaaagatatcaatgtaacgacagaggaaacataaaacagcaaaaaaaaaaaaaaaaaaaaaaaaagggcacctccaaaggaacataataattctccagcaacatatcccaatcaaaaacaaatttacaggccaggcacggtagctcatgcctgtaatcccagcactttggaaggctgaggcagatggatcacctgaggtcaggagttcgagaccagaccggccaaaatgatgaaaccccccccactaaaaatacaaaaattagctgtgtgtggtggtgggtgcctgtaatcccagctacttgggaggctgaggcaggagaatcacttgaactcaggaggcagaggttgcagtgagctgagactgtgccatcacactccagcctgggcaacaagagtgaaactccatctctcagaaaaaaaaaaaaaaaagaataaataagctcagtgagagacacaagagaataatgaaaactactacaaaggaatcagaaaaataattcagaatatgaataacaagtttaccaaagagatagatgatattaaaaaaaaaaatctggtactgaagaattaaatggccagatgcagtggctcaagtctataatcccagcactttgggaggctgaggtgggaggattacttgagtccaagagttcgaagccagcctgggcaacatggtggctgggcaacatggcaactacccccaaaaaattagctgggtgtagtggcacctgcctgtggtcccagctactcaggaggctgagatgagaggatagtttgagcccaggaggtggaggttgcagtgaaccgagatcgcactactgcactccagcctgggcaatagagcaagaccttgtctcaaaaaaaaatatgtgtgtgtgtatgtgtttgcgtgtgtgtgtgtgtgtgtgtgtgtgtgtaccaacatcatttttcacagaaatagaaaaaaacaatcctggtcaggcacagtggctcacacctgtaatcccagcactttgggaggccaagatggacagatcactttagttaaggagttcagatcagcctagccaacatggtgaaaccccatttccactaaaaacacaaaaaaattagtcaggcatggtggcgcacacctgtaataccagctacttgggaggctgaggcagaaggatcgcttgaacctgggaggcgaaggttacagtgagccaaaatcaagccacttcactccagcctgggtgaaagcatgagattcggtttcaaaaaaaaaaaaaaaaacaaaatcctaaaactcatatggaaccaaaaaaaagccaatagtcaaaggaatcctgagcctaaagaacaaagctggaggtgtcacactacttgacaagatgtatatcacgtctatcataaaagaaaacagcatggtactggcctaaaaacagagcgcataaccagactgggcaacatagtgagacaatccccccagcccccgccccttctctgcaaacaaaattttaaaattagccagctgtgatggcatgtaccatagtcccagctactcaggaggctgaggtgggaggattgcttgagcccgggaggctggggttacagtgagctgtaatcatgccgctgcactctagcctgggcaacagagcaagaccctgtctcaaaacaaaaagaaaagaaaaaaccaacacatagacgaatggaacagaatagacagacaatccagaaatgaatatgtgtatctatagccaactgctgtgtgtgtgtgtgtgtgtgtgtgtgtgtgtgtgtgtgtgtgtgtgtgtgacagtctcatgctgccacccagactggagtgtggggtacagtgacacaatctcagctcaatgcaacctccacctcctgggttccacaaatctcctgcctcagcctctccagtagctgggattacaggcatacaccacgatgccaggccaatttttgtatggtttgttgatacagggtttcgccatgctgcccaactgggttcaagcaattctctgcccggcctcccaagtagctgagaatacaggtgcctgccaccatgcccggctaatttttgtatttttagtagagagggggtttcaccatcttggccacgctgttcttgaactcctgaactcatgatccaccagcttcagcctactattatactttggggccactattaggtacaaatatgggtcacttgaatataatcactgcaatactgccgcaatcaatctgataacggagacggcaactgactaacaggcaggtagcatatacatacagcatgatgctggacaaagggatgattcacatcctggtgggacagagagtgatttcatcacactactcagaacaacatgcaaattaaaacttactaatggtttatttctgaaattttacatttaatattctcagaccatggttaacggaaggtaatagaaactgggaaaagctaacatgtgactaaggcagggtactcttgtaatggacagaaactgacaaaaagcaaaatatattaagttacataatatattagaagataaatctgttaagaaataaggtaacggctgggcgcggtggctcacgcctgtaatcctagcactttgggaggccgaggcaggtggattgcctgagctcaggagttcaagaccagcctgggcaacacagtgaaaccccatctctactcaagtacaaaaaattagccaggcatggcggcatgagccttgtaatcccagctactcgggaggctgaaacaggagaatcacttgaacctgggagacaggggttggttgcaatgagccaagagcatgccattgcactccagcctgggcgacagagcgagacttcgactcaaaaaagaaagaaagaaggtagggaaaaaagataagaagtggaggagagggaaatagtcaagaaatagtcaagaaagatgttaaacttacacaaactaatctacacaggattcccacaaataaaatcccacaaaaatttagttcagaatccaagattataaaacaccctgtaatggccgggcacggtggctcacgcctgtaatccagcactttgggaggtcaaggtgggcggatcatgaggtcaagagttcaagaccagcctggccaacatagtgaaagcctgtctctactacaaatacaaaaaattagccaggggtggtggcaggcgcctgtaatcccagtgaggctgagacaggagaatcccttgaacccgggaggcggaggttgcagtgagccaagatcgcactattgcacttcagcccagacaacagtacaagactccaactcaaaaaaaaaaaaaaaaaaaaaaaaaaaccctgtatataccacattagatgagagctaatgaatgaatactagaaaactatacagagtagattataagagacttttgaaaataatgacactgttctttttttttttggagacagagtcttgctctgttacccaggctttttttttttttttttttggagacgtaatctcattctgtcacccaagctggagcacagtggtgcaatctcagctcacaccaacctccacctcccaggttcaagcaattctcctacctcagcctccctagtaactgggactacaggtgcccgccaccacgcctggctaattttgtattttttagtagagaacatgttggccaggctggtctccaactcccgacctcaggtgatcccacccacctcggcctcccaaagcactgggattacagacttacagacgtgagccaccatgcccggcaacactgttctcttaagggtaaaacagactaaagtaattcaaaattgtacaatgaaaaatacaaactgcctaacaaataacttcataggaaacaaaataataaaggaaatatgcatcaaggttttaacaatatatcttttgcggaaaagaataatagggcagggcatggtggctcacacctgtaatctcagcactgcaggaggccaaggcaggcggatcacctaaggtcaggagttcgggaccagcctggccaatatggcgaaaccccgtctctactaaaaatacaaaaattagcagggagtggtggtcagctactcgggaagctgaggcaggagaatcacttgaacccagaggcggaggctgccgtgagctgagatcacgccactacactgcagtatgggtgacagagggagactccgtctcaaaaaaataaaattaaataaaataaaaataaaagaataataggaactaggcttcctaaagattgtacttttattttaaaaattaagacatttccatttaacacttttgaagtatcaaaacacttcaaaaagttctggagatacaaagataaataaaataccttattgtacatctatataagtattataaaacaaaaatgcattgtggacatttctgtttcaaccatataaaaactattttaaaatattttcaagaatatgtgtgtgaaaagggatgctttataaaaagtgaatataatagattagttcaactaggtcagtatgagaaataaaaagcttacttagtttttctattaattcacaaacaggaaaaaaaaatctgattttccagttcccaaatgatttctcagtttaaaataaatcaattcaaaggtcaacaaaactgtatgcttgcaggaacctaaattatcaagtctgtcacttccaggaaactttgaagttttaaaatttcaccaattcacccaaatttcttgtaattatcattaatattaatatataaccaataatatctactcatgatagctagtaaaatcccagcttgcttttttacaaaaattgatacgctgatcctaaaattcacatggaaatgcaaagggcccagaatagccaaaactgtcttgaaaaggaagaataaagaggtcttccctattttaaaactcgccacaaatcttcagtaaacaaaaggcaatttggtactggtttaagaatagacacatagataaatggaaaagaattgagtccagataaatccttacatttatgctcaactgatttttgacaaaagtgccaaggtaattcaatgggaaaagaatagcctttcaacaaatggcactctagccgggtgcagtggctcacgcctgtaatcccagcaccttgggaggccgaggcggacggaccacaaggtcaggagatggagaccatcctggcaaacacagtgaaaccctgtctctactaaaaaatacaaaataaaactagccaggcctggtggcaggcacctatagtcccagctacttgggaggctgaggcaggagaatagtgtgaacccgggaggcggagctttcagtgagcggagatcgcgccactgcactccagcctgggcgacagagcgagactctgtctcaaaaaaaaaaaaacaaaaaaaaaaatggcactcttaacaattggatatccacatacaaaataatgaatgtaggccgggcgcggtgtctcacatctgtaatccctgcactttgagaggccgagataggcggatcacgaggtcaggagatcgagaccatcctggctaacacggtgaaaccacgtgtctactaaaaatacaaaaaattagccaggcgtggtggcgggcgcctgtagtcccagctccttgggaggctgaggcaggagaatggcatgaaccaaagaggcggagcttgcagtgagccgagatcgcaccactgcactccagcttgggccacagagcaagactccatctcaaaaaaaaaaaaaaaaagaatgtagacctttcccttacccttatctcacaccatacaaaaattgacttaaaatgaatcataggcctaaatttagcagctaaaactataaagtaatgaacacaggatgtaaatgctttaaaattagattgtggtaataggtgcaaaactctttaaatttactaaaaatcattgacttgtatacttaaaatgagaagtttttttcttttttttttttctttttgagacagagtttcattcttgttgcccaggctggagtgcagtggtgtgatttctgctcactacaacctccgcctcccgggttcaagcaattctcctgcctcagcctcccaagcagctgggattacaggcatgcgccaccacacctggctaatttttgtatttttagtagagaccaggtttatccatgttggtcaggctggtctcaaactccagacctcaggtgatccacctgcctcagcctctcaaagtgctgtgattacaggcatgagccaccgcacccagcctaaaattagtggtttttatggcatgtaaaatacagttgtcccttgctatactggggacattggttccaggactcctgcatagaccaaaatctgagcatactcagataagtcctgcaatggccctgtggaacccagtgatataaaaagtaagcccttagtatgcaacagtttcacatcccaggaatactgtattttcaattcgagtttggttgaaaaaaaaaatcaccatataaatggacccatgcagttcaaactcatgttattcaagagtcaactgcatatctcaatgaaggtttaaaaaagccacctctaggctgggcgcagtggctcacgcctgtaatccgagcactttgggaggctgaggcaggcggatcacgaggtcaggagttcaagaacagtctagccaacgtggtgaaacgccatctctaccaaaaatacaaaaattagccgggcttgctggtgcatccctgtaataccagttactcaggaggctgagatagaattgcttgaacccgggaggcggaggttgcagtgagccaagatcacgccactgcactccagcctgggtggcagagtgagactccatctcaaaaaaaaaaaaaaaaaaaatatatatatatatatatatatatatatatatatatataaaatggtatttttttttcttatacagacaaggtcttactatgttgcacaggctggtgttgaacttctgacctcaaacttctgacctcccacctcagcctcccaaactgctgggattataggcatgagccactgtgcccagctcaaattttcaaatatagagtacaactgtttatatagaatttacattctattaggtattctaagtaatctagagatgatttaaagtatatgggagaaagccgggcatggtggctcaaacttgtaatcccagcattttcaggaagccaaggcaggcagatcacttgaggccaggagtttgagaccagcctggccaacatggtgaaaccccgtctctactaaaaatacaataattagctgggtgtggtggcacacgcctgtaatcccagctactcaggaggctgaggcaggagaattgcttgaacccaggaagtggaggttacactgagccaagatcgcgccactgcactccagcctggtgagggagcaagactctgtctcaaaaaaaaaaaaaaaaactagcgggttttggtggcatacgcctctaagtcctagctactcaggagactgaggcaggagagcagcttaagcccaggaatttgaggctacagtgagctatgatcaagccactgtactcaagcctgggcaacagagcaaggcgcggtggctcacgcctgtaatcccagcactttgagaggccagggcgggtggatcacgaggtcaggagatccaggccatcctggctaacacggttaaaccctgtctctactaaaaatacaaaaaattagctgggcgtggtggcacgtgcctgtagtcccagctacttgggaggctgaggcaggagaatggcgtgaacctgggaggcggaccttgcagtgagccgagatcgcgccactgcactccagcatgggggacagagtgaggctccatctcaaaaaaataaataaataaataaataaataaataaaaattttaaagagatgatttaaagtatacggaagatacatgtaagttatatgcaaatactataccattttatataagagactggagcttctgaaaattgtggtatccactaggggttctggaaccaatcccccacatatcaaggggtgactgtaattacttaacaaaaattttttaaaaaatcatgaaagtatgtatttgtcaccagctcatgggaatcactattcttgaattaggtagcactaaatacctttaaatacctgatggaagccttaaactcagcagcaagttcctgaaaacatgccaacatatattaattattctgggtctaaaagtttgacaaattactttaaaatacagatgaaaacaaaataaaatgttttaaactgcaacaagaaaaatgtacaagttgaccagaagtttgaaacacttgactacattggtgcactgttaatcaaaatttatctgcaaaacagatttgcaaaagaaattataaacagggtagtaaatttcaaagtaatttataacagactaaggtcaagctacattagcaaagttggaaggtagcacttaagaaaaaactctgggccaggcacggtggctcacacctgtaatcccagcactttgggaaggccaaggcaggcagatcacctgaggtcgggagttcaagaccagcctggccaacatggtgaaacctaatttctactaaaaatacaaaaaaattagccgggcatggtggtgcgtgcctgtagatccagctactggggaggctgaggcacaagaattgcttgaatccgagcagcagaggttgcagtgagctgagatcgcaccactgcactccaacctgggtgacagagtgagactccctctcaattaaaaaaaaaaaaaaaaaaggccgggcacagtggttcacgcctgtaatcccagcactttgggaggctgaggcaggcggatcacgaggtcaggagatcgagaccatcctggctgacacggtgaaaccccgtctctactaaaaatacaaaaaattagctgggcgtggtggcgggcacctgtagtcccagctacttgggaggctgacgccggagaatggcatgaacccaggaggcggagcttgcagtgagctgagatcgcaccattgcactccagcctaggcaacagagcaagactctgtctcaaaaaaaaaaaagagaaaaaactctggaaagttatatggctctaccatgtactatttggacacctctggaggagaggaacttgttcaattttaacagtataaactttattgtttaagtagctaatatttaggccaggcgtggtggcttaagcctgtaattccagcacttcaggaggctgaacgggtggatcacctgaggtcaagattttgagaccagcctggccaacatggtgaaaccccgcctctaccaaaaatacaaaaattagtcgggcctcatggcgcacgcctgtggtcccagctacttgggagtctgaggcaggagaatcacttgaactcaggaggcagaggttgcagggaggcaaggttgcaccactgcactccagcctgggcaacagactgagactctatctcaaaaaaaaaaaaaaaaaaaaagactaactatcaattaggaaatatttacgtgtagcagtactaacaacattgagatggactaatttacagaatcccaatactttcgttctaattttttttttcagggtgttgctctgcatgattgtagctcactgtagcctcgaactcctgggctcaagggatcctcccacctcatcctcccaagtagctgggaccacaggtatatgccaccatgcccagctaattttttatttaatttttttttttgtagagacagggtctcactatagtgcccaggctggtctcaaactcttggcctcaagtgaacctcccaaagctctgggattacaagcatgagccactgtgcgcagctgcttccaaagattttctagagtggccaaaaccccagataatccatgaaagagcatgaaaagtattttaagggacaatggaaggggagaaactgctacctaatattctcagcaacttttcctgccctacctgacaagcgaatgatattgaagaggagggtaactaactgaacagactcttctctctccttctatccaggcacctactatcctgcaaatacgcagctttgaaggacttaaccaatgaccttaaaatctataccaggtctacagttctaggaagcgtataagcaaatgctgctatagaatttggattttctttaatgataaaaatgcaaatgactcacgtttggtcatccactccaacacagcacattctaaagaacaggagttcaaatcctccttctgccaaaagatgttgtgtcttcacacacaaataagtaattatggattatattactaccacaaatttctgtttctcactgaaggcatatgacattttaaaaaagaacaaaaaatcagaaaggaaatgtttcaagtctattttgaggtaaagcaatcaatttaccatttatcttcctcagacttacatatgaaagccccacacacatgcgcacacacaagatccccaaaatgttgacaactgttgaagctgcacaacggataccagagttcattatactattctatttttgcatatatttgaacatttccataatatgcagttttttaaaatatgcatgtgtgtgtctataggtgtttatacataaactcccaataaactgacatagaaatatccaattgttcaaagctttcattcttcaaaagtaagtgaatttcttttttttttttttttttttgaaacagtctctcactctgccacccaggctggagtgcattggcacgatctcggctcacagcaacctccacctcctgggtacaagcaagcgcatccagctaatttttttgtatttttagtagagatggggtttcaccatgttgactaggccagtctcaaactcctaacctcaagtgatgtgcccgcctcggcttcctgaggtgctgggattacaggcgtgagtcaccacgcccggccagaattccatctagctactttcttattctagaagttgtactgcaggtgaccagaccattagagaaggtctagtgaaagaaataattaactgccccagaataaaacaagcctaaccttgaaaagaggcaaagggaaaggtgctaaacagttattacaattaactgcatgtttatatttggtcctgttatcctctaacacaggtgggtaggtagaaaagggggaagtattttagggccagatttccttttgattctttaagttgatgggcaagagaggctggaataaagaaatctaaaaagtctccattataaatgataaccaagccaggcacaatggcgcatgccagtagttccagctacttaggagacaagaggggagaatcgcctgaacccaggaattcaaaactagcctaggcaacagagtgagacctcatctctaaataaataagttaatgaattaattaaaggtagaattgtataatatatgaattatacctcaatttaaaaacaatttaagccctatacagtgatgcatgcctatagccacaactactcataagactgaagcaggaggatagcttgaacttaggagtttgagaacagcctgggcaacatagagaggcctcatccccctcccacccccacccgaaaaaaagcattcatagctcatcttagtataatcagcaacttccaatgactaactatgctttcctgctagacatgaatttataaaacacataaaaattatactgtatctgcttcaattccttttttcatattgccattcaattttcacaagattactttaaatgcaatcctaaattcatcaccaatttaacttttgttagttatgtctaaaaataaaactagtcaaaattaaaaatactaactttgcagcaaattaatcttgcatcagcactacaaacaaatttttaaacttattgtagcaaaacataacttcgacagaatcaaagacattaattctcaagtccaaaaaaaggtcacaagaaattatttaaagtggtaaagggaaacgcagacttaggcatacaagccaagaaaaaaaaaattagagataactcctccgctagaacctccccccaatacttccatagcaacaattatttccttagcacaaaagtgatgtgttcactttcacaaaacctggatcatctaagtttgcacaattcccttcaatctaaaaaacagatgaaattgtttcatttaggtgagtagaattttgtgtccctatacacgaaaaaagtcaccatcagtgtgagtaaaccacatggctccagctttaagatcttgttccccaacccactgaaaagagtatatgcttataaaatattcatggacttaccaggttaaagacagtttctacaatatccctattggatacttctccaacttcaaccaaaccggtcaacacggcaaatttcattctgatgcccctgatggggagccctggtttcagagacaatgcacccccttcagtaggggtttcttctctccctccacctcccccgtcatcacctgttggtggcggggaagggacacgattgtcttcgctagccattgctagctcacgataaaggacaactcagagtcaccctgggacggcagtcgctgcactggtaatgagcacaacacacgcaatgcaaaacgaaagggtccctcttccaacttgtggagataccccaaagcagttgatgtggaaagtccttggcgtcgccctcctcctcttggagaatatttgtccaatctctctccccgaggctgacaacaacgccaaaccctattggaagattaaatatatgttaaataggctaggttttgttttagggttttgaggggacaagagggaaatagttattgtcggtcaagtaagttactaaaggcaccccactactagccacccgcttctcccgggctcaaaaagctgggttctgggtgaaggcaggtccaagaggcccccgaacaggctcactcctcccccactctcgtgcaggttctaggcgcagggtaacctctcctcacaggtgcactagaaagagaaactgtcgcggggaaaggagggatcggaggaaagaaggggggcccacaagctatcacagaggtagaaagttcttcctcacccagatactccggactcgtcctcaccccccgcccaggagcagcgagaccgaggtggcggcggagatccagggcaggaaaaggcgggggaagggggcggtgattattctaaatgctcggcccagtgggaggagtgaagcacctctctcaggcacctgagattcgacgggaaggggtggggaggtgtgtgtggtggcaggaagggaggggagcggccagagaaacccagcggccaccgcagggagagaagggaggacagagaggtcagtgcacctggtcgcagcctccaagtttccct

SEQ ID NO: 1851 - DNA, 205875 bp, Homo sapiens
ttatgaaatttatttccaaattgaagaggcagtgtatataaaggtaacagagcttgtgataatttacagaaatgtttgctacaacatgcacattatgaagtatttcaaacatatacatattaggtttcatgctgaataaataatccccccaaattaatttttatttttacataaaaatataatattgcactcttaacaagaccagttattctgcatattttctctttagataaatgatgaaattcggtttttaaaaaaagatgagtagcaaccctattctaataggggactaatttaaagttctcagtaaaaaaatgaaagctagacaatagctgcaattttttgttaacaaagcaaatcacttcaacgtgaataggagtaatctcatctctgcacctccatggacctcaggattcacacctggcctgagcacacggtgatctaaatgcagcctaggtatcactacatgtgtatgcagtttaaggttaaagcatacatggccacgtgctttctctcgaatctatcttgacagcagagactttggaattatattttatatggtttttaagcagaatgttttagaaagtctggaagttacaaaagtagtactgtaaacaccatatgaattaaatttccataacaaatgcacaagttattcttaggcagggatacatatttttatcccatggtaacatattactgagcttatctgacagtgttttcaaagccaataaagcagcaccccaagtaaaaatatacagacagccatcatatgggagagacagacggctccaagatgtttaggaattctgtctttatggtatgtaagtttgctgtggaatacacgagattttattattcttcctagaattctcagatggtataggttagtagaaacagaatgaaatggtttcctaaaagaattattctgcctcctgtttaaagtaagcttttataattctgttttggggaagaaaattcttcctgcagattagatcaaatgccttatttaggctgtgttcttaatacccatgcaaacttcttgcatactgaaggctttctattgcaaattggtacagattcaatgctctgtaaatagcagactttaagacttaccattgtgtttaaacctcagtgactcaactaaggatagtcaatatctagcgttacagattttaagtaaaatttttatgaagaaacagaatgtgtctgaaatccaagatacctgtattcttgtttgtggctgtcaaaaaaattctggttctcctttgagctaagaaagcaactggcaaaaactgcctaattttgagattcattcatagtttattttagtatttagatattccataaaatatttggtacagaggcacctactgaataatttgcttctcaaagaaagcaattatcaagtcctaaaaattatctttttttctttcctcttttggagcatgtgtgtgtggtgggaggagtatttcatggcagtaaacttttaaaatataattttagtgtgttttatataaacaatcaaccaaccaatttaaattctactggtccttttggaatcatagaaaaaggggagaccttaatattttctttggaataccttggtgggaaaaaattttaagaatatcattttaatgtaccatgcgaggcttaaaacttgttggctagtgcatattgacacaatcttccagattatcactaaaatagaacagaactttcctcttaggatcatgtgactcttcagaattttgtgcagatgaatagactttatcattatttggatggtttgtccagtcatccatttctttaggttcaacctcctaaaactggtgaagtcaacaaatctagtttggagttaaagtgctttggagaacgtgaagttcattcgcattcacccggctgcatagctgctaaggaaggaatagaacattggctgtttcaagcgctgctggtccttccgacaccaggcaatcacggtcccatcactgtttgctgtgtacaaatggtggccatcacaagaaaatgtaaggctgtaaaaaaaaaaaaattcccatttgtacattatatttcttaaaagtgtattagcatattggtcatcatactgaggttagtgtaaagaagttatcttcagtggcgcagagagacataaactaaatgactgcctacaactcattggttttgactgtaattctaacatagtcactctgctgacaagttgagatgctcataaatgcggtgatatagaataaaatcaggatcacaaagctcagtacattctattctttgcatatcttcttttgcctccttgtttatgctttattacataaacaacaaatatttgggtgtacaaaacttttaaaaatataacagtactatattttctccttataaagataaataagtattttatggctatatattatttccctaaaagagaaaaggaaaaaaatgtaacattagtaattaatttaggttccttaaactttaaatttagtacactgaaaatacatttaatttaataaagtaaaatttgaatcactttatttctaattatttaaagtcaaatttgttaactaagcaaagagtaactgattatttatctattttgtcaagcacccctgcagctatcaatcaccattatggtcttgtcaaatatgaaaggaaaaaatacagtctctatgattccagagacacactacaagcatgcctttccactagactctgagtcactgactcggattttaagctccatgaagacaaggagtgtggtctctcttgctgctgggtcacggacaacccgctgtgtgttaagtggttggcttttcatgatgacttcaattgcacatttctttaagtctgtgtgcttaaatacctctctacgaaaaatacaatcacaaattgtattctgaagcataagagggggagaagatcttacctgatgatgggcttatttgatttgggaaatgtaatttctctcacaggctttaagtcccatgtgctccataacctagaggggaaaaaaatcatctaattatgcaaactaaaattactctccctaaaaagccctctatatttgtttatttgttaaaaatcatgtggaaggaaatgtaacaaacaattaacagtagttccctctagggagtttgcagggggtagatgtgggaataagagaacttttaactttgtatacttccatactgttaatcttttatagttaacataaaacttcaaaactgtgctaaagctatctttattatttagaaataaaacaggaataactaaagaacctacaccccaaggtgagtttaaatctctaaatactgaatattaatatgcctagatattaaaaattaatttctgaaactcctgtgtccttatgaatgaaatcaaaaaaagagaatccaaattcctcttaccttacaattccattttctaatcccccagcgattacattgatagatactccctcaggctggttggagaaagccacggaacagatgatctccctgcagtggacatgtccaacgagatccccgttcaccgtccagagtctgaggtcactgcctccgccagctaaaacacccaaatcatccggcgggttaccagaatgtggctgtctcagagcccacatttggccccagaagggcaaccctgaagggcaagctcatttgtttattgatgaagtttgtagacaacccatgactgaagactgtataaatgaaattactacacaagttgcacagatttttctttttcattttcttttgagacagagtctaactctgtcgcccaggctggagtgcagtggtgtgatcttggctcactgtaactgcctcctgaattcaagagattcttctgcctcagccttctaagttgctgggacaacaggtgcacgccaccacatccggctaatttttatatttttagtagaaatgggtttttgccatgttggctaggctagtcttgaactcctgacctcaagtgatcagcccacctcggcctcccaaagtgctgggattacaggcgtgagccactgcaccaggccaagttgcatagatctttatgtattaatcaagagacaataaccagcgaaaaaataaaaataagaagaagcaatctatgtgtacagtaacaaggtaaaataatcatctttgtgtaattgtaatatttcagcatatgaaccaccaaatatgagttatgattgaaaatacttggaaagctaaacagtctccaaaaagtgaaggaaatattctgtgaaaccatctataagaagtgacttggccaggcgtggtgcctcatgcctgtaatcccagcacttttggaggccgaggcgggtggatcacctgaagtcaggagttcgagaccagcctagttaacatggtgaaaccccatctctactaaaaatacaaaaaaattagccaggggtggtggcgggcgcctgtagttccagctactagggaggctgaggcagaagaatcacttgaacccaggaggtggaggttgcagtgagccgagatagtgccactgcactccagcctgggcgacagagcagagactctatctcaaaaaaaaaaaaaaaaaaagtgacttatgtgacttttgaagaaaaaaaaaggtgtagtaaaaattacctgagttaaaacttaattcttaaaaaaagaagaaaaagtattcttcagaacatctaagattaaatcttataaagcaataccttattaattttttcttttcaaagattacagagtaaccaaaagtttttcttttagttttctggggttgggggaagcataattgcctgccatgctttataaacaggatggtttgggggctgatgatgatatgtccagccttctctggggaaatactctcatactgataaagcggttaggaggcacgataaagtttgatgacatagtctcactacatttaattttatcttttcattacatataagtagaggctttgcttctgtcttttattaagacaatgaaaatatttcatattttatagcaaagaaacatataaacaatgcttctttatttaaaaatatgccaaagaccgccaaataccacagatcaaaatgcccagtgtgttgcagcattattcacaatagccaagaagaggaaacaacctaaatgtctatcaacagatgcataaacaaaatgcagtatgtacatacacacacacacacacacacacacacacacacacacacacacacaattttctttagccgtaaaaaggaatgaagcatgcgaaaacatggatgaaccctgaaaacatcatgctaagtgaaataagccagacacaaacagacaggtactgtatgattccacttacataaaatatctacaatgggcaaattcagagagatagaaagtaaaatagaggttaccaggggctggaagctgagggaggaggaatggggaaatagtggtgatggctgcacaacactgttaatataattaatgccactgaactgaatacttaaaaaatggctggaatggcaaattttatttaaatatacattgagacacacatgcacacacacacacacatacacacacacacacacacacacacacacatgcccaatgttctactaagttttcccattgtagaacattgattatatctaaatatagcatcaagatgcaggagactcagtatgctaaagaaatagaattatagacaatattttccatgagtaggctacatttcaacctttcttttgaattaaatgttggctaaaatatttttttaaaagataaaataattagataagtactagtaaggctagaaggctcattgaagtcactggaaacatagccataaaagatattgaggtaggggtttctcgctgtaacccatagctaccactactgcatggcttaatccttcaaaataaaaaatctaaatgtgggcctggactctcaagtatggcctggaacttagtagccaaagaattatcctagcagctcactcagtaacttgggctaccacaaaaccaaataactactcatctgcctacttctgtaagtatcaaaatttgacagttacccaataccagattgctcgaatgtataatttaacacatcaactaaaagtcagaaacctaggcattcctaaaaagcatctctatccttcgtatacacagtcatgaaaatcaaaataaattaaagaaccaccccactgtgaatcttagaatattttactaactctatcttgccattggcaacagaggaccaggctatggatgtctcaccttagttcaaaggcatatattttgatccagtgatagaatggtaaacacacatacaacccccccagaaatcactgattacattttcacagtttaatacatttcacatcttatcactataaaaaccatatcccatcataagaactgagaaattatgatcaggaggaatgagcttgacaatgtaacttttgagaagatgttacacatacagcacaggcacataatatagttgtccctaggtatctgagagggattggttccaggacccctgaggatatcaaaatccatggatgctcaagtccttgatataaaatggtgtagtatttgcatataacctctgcacatcctcctgtattcttttttttttttcttttgagatggagtctcgctctgttgcccagactggagtgcagcggtacaatctcagctcactgcaacctccgcttccttcaagcgattctcctgcctcagcctcctgggtagctgggactacaggcgagtgccaccatgtctggctaaatttttgaatttttagtagagatggggtttcactgtgttagccaggatggttttgatctcctgatctcgtgatctacccacctcggcctcccaaagtgcagggattacaggcatagccaccgtgcctggcctcctcctgtattctttaaatcacctctagattatttataataccaaatacaatataagtgctatataaatagttgttatactgtattgtttggataataataagaaaaaagtctgtacatactaagtacagatgcaaccattcattttcctccccagatattttcaatctgaggttggttgaatccacggatgtgaaacccacagatacaaaggattgtctgtacgtatatacatacatagacatatatatatatattttaattttaagatcacttggatgatatccaataaatagtcaaaatttttgataggttaaatctgataactttctttccttcttggcctacaagaaaataggaggatgaactctagtctgggtcgctacagataaatttgacctctctttaaaaaagtaatttaaaaaattatgttccctatataccaagtgctctttatgatttcttttatatatgtatcaagagaccttaaaaaaagttgacaaggcctttttgttcaaattggaaaaaagttttacccattactctattatattgtgtgctacccagggacacctgaataccctactagtgagttggtaattgcagaaaaagtaattttgtttctcattctcatatgactagctgatataatatcacagatataaatcactactggcagcaggaaagtaattaactttacaaaattcaactccctcaggatcagtcctaactttcaaacactgccaaaacaagaaagtagagaactccatataaacaatcattatattatttccccagtattcctcttgatatgacacactaaaagctgctaatgcacaaatcaaggaaataaaaaatcatcaatcatttgcgcaaacttgtactaccaaagtcaactctttaagatcttttccctttgttataatcattaggaaataaaaatgttttcatgacattattttacaactgggggctaagactagcaaaaattctttcatatctgaaatctaatcatgactgaagatattacttctcctgaacacaagaatagatgaatgttttgtagaaacaacaataacaaaaccctaacaggtatctgtggtataatgaaaaataagtatttggtctttgtccctggttcctgggacagagtccctaaagcccttggaatttactgtcttctgtatgctaatgagatgactctcagtgggcaggactacatagcttcagtctagaggctggtcaccagaaaaatcaaccacatgattgaggactgaaacttccagataccccccaactctcatgcccacctcctggtgaggcaggagaatagggtctggaggcagggaacctaagacagtttcacactcacttcctagaactaaattcaaaggaaaaccctaactttccaggcctaaagaacaaaaggaccagaggctactccctttgcaaaactcccacgttttctgctggcagatgggaaattggctgtctgcaaccaatcaaactgattgtgggtggagtcttcatttgcaactttgtaacttcaccttagcctacgattggttgcaaaaagcaatcagatgtttccacaggagtgtgacctttgtaactccatttaagcttctgattggtggttttaggcaacccatcagactgattgtgggataccacttcattcacatgacgtgagcataaagtggccaatgggaaacctccgcagggtatttgtacccaagaagattctatatccaggcccttgagccgctgcttgggtccacttccacactgccgagtgtactttcattttcaataaattcctgcttttgttcttttgttgcttcatgctttctttgctttgctgggcattttgtccaattctttgttcaaaacaccaagaacctggacaacttgcagtcaacaccctctaccagtgacactgggagcagagtggggggtggggattgacctatgtaacaaaaccttcataaagttcctaaatgacaagggtaggagcacttctgggttggtgaacacaactatgtcagaaataataagtttctcttcaaagctcccttggtctttcttgctctgtacacaggccccaccccttgcttaatttgtaattagcaaacctctatatgcccagacatgcccagacttgttctgtaaactacctttcccaccttagcaacagtctcttcctcccctcctcttgcaaacggcatatttaccatatgtagaaaagtttaagtcttagccaataattgggttagattgttcagtccaactcaagccaatggggagaggacacagtaacaggagctgcgttagggataaaaacttttctctcctttgtttggtatgctcttgcaatcagacggatgcaggcagcacccttctgcagaagtaaatgtgccttgctgagaaatgttctgtctaagtgctggcttttctttgaggcactgagcacttgtttctaacaaaatgggggcacatctgggatcccattctcctccggagaagggtctccaatcatctcttgtgaggagacgtgtctcactgcagcagcctcaagaatgagggattgagacccaccagcatgatgaatataccgagactctcagcaacatggaaggaaaaggcctacagatgccatggtgaccaagtaattctgtgcacagaccaaggtaagaaaagccgcaggggcagtgaagtacttctttggtggttgggacatcctggaggttgaaagtatgtgaatgagatgcacaattaagtgcaaagcgagtgtggagtaaagtaaaggagtgcaagaaacctccagtggggaggggggttaagtctccagggaaagggtgcaagaaatctctagtaagagaggttgaaccccatacagtcaggaaactcagggacacatctaaaacttccaggatgggaaataaccctagtaaaacaaaaactacaaagagcaaagcagataatatgattccctctgataaccctctaagtctcatgttaaaatattggaaagataatgaaaagacagtaaacctgagctctatttgggaaaagaaatggagctagtatttaaactatttattttcacaaggattacaggcacctgccaccacgcccagctaatttttgtatttttagtagagacaaggttttgtcatgttggccaagctggtctcaaactcttgaccttaagtgatccacctgcctcagcctcccaaagcgttgggattacaggtgtgagccactgcacccagcccaaagtacctgtttttatggagtttacattccaatggagaagacaaataataacaatataagcaaatatatcaactgctataaataaaaggcagggaatagggatagaatgcattgaattttgtcaaatgcttttttctgtatcttttgagattatcatatggcttttgctcttcattctgttaacatgatatatcacatttactgatttgtatatgttgaatcatctttacatcccaggatgaatcccactgggacagaatgtggggagggttaatactttagataagatggcttggagaagcctgtttgaagagataacatatgcagaggccccagtgaggtaagcatatgagccatataaatatttagggaaaaagcattctggacaaaggtaaaagcaagtgaaaaggccctaaaatgtaacttacttggcatgtttaaggaataacaaagaggtcagtgaggttatagcatagtgattaagagagaagaatagtaagaagtgacataaggaagaaagccaggtccttatagcctggcgtagatatgtaaatgggaagcaattagattaagaagaggatgacataattcgatttacctttatgaaatatagagctacagtgtgaaagttagactgaaaaagattaaagaggaaagcaaagaccagttaggttattatagtgttctaggtaacagttttggactagtgtgatagatgttagggtaggagaagttagaagttagattcagactctattttgtaagtagagaagataatgtctgctaatagcttggatataaggagaaagaaggagaagagtaaaggatgactcaggtttttgacctgtcaactgggtgaattctgaaattcagagatgaggcataccagagaaggaacaagtttggaggaatgtagaatcaagttttgttttggctgtgttaagttgaaaatgctgtgtaggcaattagatatccaagtctggatttcagggtataatttggaactggaaaaataaatttaggagtcattagggaataaccatgactttggataagatcacctagtacagctagagaagagaaggtagcaaaagacaagagacctaaggtatgccatcgttaagaagtagacaaaaagaggaggaaccagcaaaagactgagaaggacccaccagtgacctagaagaaaaatcaggagactagtattctgaaagccaccagaagaaagtgtttcacaaaagggaggtagtattgaatggtgtggaatgttgcctgtatacctagaaaaaagcaactttggctgctttttaagtgaatgtgatagagtttgtactgcaaataactttccatattgcttttcaaatcatgatattttagttcttaagatcatgtagaactttccattgtgaaaagggatttgattacttttataactaaagaaacttttctaaacttaattaaaaaaaattaattctagaaactcgattaccatggactaagtgttttcccgttaccctattaagagtctgaactgctcactagaaagatatcggcttatccccgtataaaatgctttataggttgccttatttaaattccactactgacctcccaacatttgagacaaaggatcagtttcttagaaactatgtatttagtctgtcttccaccctttactcactccctcaagactcaaagcctcctagcacaaactccacccctcaaactcccagttcaccgacaccaacccggagatcacatccttatcagaagttgcaaagagggaaagctcgagcccatctgggaaggaacttacctggtgctcttaacaactgaaacagtaatccaaactgctgaaaaagggtagacccattatacccgagtcaagaaagcactgccctcttcaaagccatggaccactgtcccagggccaactcccaccaaagcaatgttaaaaagaaaagtctaatcagtctgtctctttttttttctcttctctttcccttaaccaccccctccattttattattaatgtaactaagtcaagctcaccccaaaatattacttttaatgcttgttttgttataccctgcaggaaccttcaacgccaaagagaaatagcatcagaaaaatacctctgcccctccagggaagccactaccgcccccttatcccgcctatggtggggagatcagcactctctccccaatttatgttctcaatgggcatatgttgtttagaccaccaaaaatcaaggttagacatcctcagatgattgcaccaccctaaagccttacctccatttcaccgaaggagtcaccgccccccacaactgtcacacccaccagtgcaacccactactcatctctattactatccctacctctagcaactctaaccccaccttaggtgcttctatggtctaggagaaaatgccgttagaaaggactctacaggcttctttgaaatgcgctttgtttcttccccgctatcctctattgttaccccttccccaagcccatccaatcaaaccatctaccatttcatgcccaatgacaaaaccaaagtagttataataaaagtcaaggatttaaaacaaactttagccataacaactgggtaccaagatataaatgcctggctgaaatggattaaatattccgctcacaccttaaataaaagcgattgttgcgcttttgcaacaggcagagcagagacccaaatcgtcccctttccacttggatggtcctccgacccacagaatatgaactgcatagcagctctcttccaagaccccacagcccggggcaataaggcatgccagtctctcgttactattcccagaagttacaggctctgtgggtcagccctccagagctatttggcctccaagtaacaatgtcaattttaccttgtgtctctcacgacagggggaatatttggcattccttggaagcctaacaggacgcagtgaatctaagccttttcaagagttaaccagcctgtctgcccttgttttcatccccaagcggatgtatggtagtattgtagtggaccactattaagtactctgccaagcaagtggagtggcatttgcgctctaatccaattagccatccctttcaccctggcatttcatcaaccaaatagaaagaacaatcgtaaaaaaaaaaaaaaaagtgtccccctcgggtcttttgatcgtcacatatatataaatgctatcaaagttccacaagaggtgctaaatgaatttaaagccaggaatcaaatagctgcaggatttgaatctatattgttctcatgggtaactgcaagcaaaaatgtagactggataaattacgtttattataatcaacagtggtttgctaactatactagggatgccattaaaggaatagctgaacaattaggtcctaccagtcagatggcttaggaaaatagaatagcccttaacataatattggccaaaaagggcggggtctgtgtcatgattggagtccaatgttgtacttttatccctaacaacacagcccccagtaaaacaatcacaaaagccctacagggccttaccaccctagcaaataaattagccgaaaagtcatagaaaaatggtttagaaaatagaaaggactcataacatcaatctttatcccccttgcaattgttatcagtgtactcattcttgtaagttgctgcatcataccttgtattcgtggatcaaggcaaaggcttatagaaaaagctcttaccaaaacctctctcgattctcccccgccctactcaaataagttcctactcttaaacaaccaaaaggaactacaaagccaagagatgttagaaaaatttaaggactctgaagaggaagaagtataacatcaaaagggggaaaagtgtcagaaataataagttccaagctcccttggtctttcttgctctgtaaacagcccccacccttgcttattttgtaactagcaaacctctatatgcctagacatgcccagacttgttctataaactacccttcctgccttagcaacagtctcttcctcccctcctctcgcaaactgcatgtttatcatagttagaaaactttaagtcttagccaattgagttagttagattgtgcagtctgactccagccaatggcgagaggatacagcaacaggagctgtgttagggataaaaatctttatctccttttttcggtgtgctcttacgatcggtcggtcggacgcaggcagcacctttctgcagaagtaaatgtgccttcctgagaaatcttctaagtgctagtttttctttacggcaccaagcacttgtttctaacaactgtgtgccagaacatggtgcaccctaactccacaaccctgactccaggaggacagacactccagcactcagggcacttccagacctggtcctgtgcctcttcagccgctgttcatttctatcctttataataaatgatagttgttaagtataaatagtgttttactgagttctgtgagtcattctagcaaattattgaacctgagggtggggctcatggcagcctccaaatttgcaaacttctagtgtcacaattgaactgcatggtgggacacccagttggtgtcagagaactggttagtctctggaaaaacaccatacattttgtgttagaaaaaaagaaacaatgtaaaaaatgctagcaaaggataggggactacccactatgggtatgtccaacactgaatggacagaaagaagcaaacagtttttcagaggatcctttgcatcttaagacccttaaaaatagaaatgcaaacagaaaattcatgaattttctaactgttcttttctgctggatgcattggtttcttaacatgtatatatgaaacaacaacaacaaaacactcttgattaggtgatatatttttgtcatgtaatttttaaggcaaactatacttccatttactattctatactattgctctctgtctgaacctggaagacatatattcaagctggtcatctgctgaggcttttcatttagtcaggagtgttaaataaaatttacgggaggccaatgttttagactgagctcctgcactaggccctaacataccagatcaaacaagaatggagtagtcacttgtgcgaggtgacacataatcaaactgaacttggaaatgggctagttttccaaaaaaacaggagattcacagcaatcaatgacaggggatcactcaagttgagctggtatgataaggaagttccttctgctttaatcctctaaggaaagtaactgtggaatgatctatctgagttttgttccttgtttctgctttcttcagctttttctgcctatgaagcctacctcctctgctcggctctctggggtacctttctgtttcatagatggaatgctgcctgattcatgaatcattaataaaagctaattcaatttttcagctcaatttgttaaaattttgttctttcacaggaggaaggtaacaaagtcaatagttacaaagcagaagcaaaaaaggggagaaaagtcaaaaccaagaaaactgaaaaaactatgtaacaataatttgcttagcttaacatgtactcaaatgcaattttacatgtatcaggaaaatagttaaattatgacaatactaacttctgcataagctgaggcctaaattgatgcactcagtcttggaccatattgtatttctatacacatacatgctgttaccaaagtatttagatctggcagggacctgagagaatggctcgacctaggagtaaccactggccgaatgcgctgttagagcaccagccagccctgtgctttgggttggagcaagctcacctgaatcacacacagtagcaatatcacctgaggtttcactggcagagacagctgtgacagggcttttgtgtcccgccagactttgtacatagcataacctgaaagaaaaaagacatgaatttgtatatgatcattaaatataattacattctcttattttgtaattcttcttctcagtctatgtacctattgtacataaggcatacatgttttcctatctgattgtatgacttcaataaaatataataggtaatcttactacctttaagcatgtgtttcatggttaaaatgattataacgtaaagacattattttggtttatctatttcatatagtaaaaatggatatattaaaaatgctatgtttgatttggagaccttcttctgtacctgtttaaatcccatatgatgcaggttccgtctctgctcacacttatcagtatactgtatggtttgcaaacaaataagctggttatctcttctgtgtgaccatagagatgtatttgagtctccatttctatttctgatggctgaaattttaaaattaagtatgagataaaaaccacaacaaaaagtactctagtatagtatctcaaaaataaaacaaccaaagtgactcaaatggtcttctcaaacatatcattcttcaatcctattcagagtaaaacaaagaaagaaattaaaaaatttttaattcctcataatttccagttatctggttttcatttttgtctattcttgtccaatctttgttcaaatatacatgtatttttatagttgtaatattgccacataaaaatttcctattttatattttacatattctcctataagctttttctaatcttgacattgtcttcaaaataatttttaatgatgttataatattctatacagttagtaccccacaatttacaactatccttcattgatagacacttaaaattgtttctatttttttcaaattatagataataccataaattcttcatgtataaaaggtttttagtagattagagggcagacctttgggaaataaataattaaagttttttaagaagaaatacttctgtaaaaaaaaaattctgggcatggtggctcatgcctgtaatcccagcactttgggaggccgaggcaggcagatcatgaggtcaggaggtcgagaccagcctggccaacatggtgaaaccctgtctctgctaaaatttccaaaattttcctagtgggtttgtgaatattaataattttatagttcttgacagtgtactttcagaaggtgtcatgcaaattggtgatgttaccaacggtaatgggccctaatgctaccgatactcagcagttatggcttgactttctaaatcaaagcttgcaaactggtgctctgagggccacactggctcacggataccagatgtccacacagggtttgactcttgctttgttaggttaactattatcataaagcatttcaatatttccccttcaaaaatatagaaaagtagaaagaataagtataataaagagctatatactgactacccagttaaacaaatcttaacattttatattatcaatttattttttaaataaagcattaaacattgtacatataatttgtgtactgttctacatcctatttcttctgtcttgtcagaagttactactagcctaaattttgtatttatactcctatgtaagtttttatacttccattatgttactatagccataaacaacatactgtataatacatataagtattatattgtatttcatgtttatgaattctgaatatatggtattattttttaggtatcttctgcatcttaccttttctcaaaaacaccattgtttttgaaatatatctgtgttgatatattaggtacagctatctatcttagctgctatgtagtccagttacatatttttatagacataaaaatacatattttacacttaaagaatcaaaagaccaggcaataccaggctcacattattccttgtaacaactggcttgagctgtgtagcaactgcctgtttagctagggcgtgtgaccttcacctgaaaacaatcacagcgaccagatcagcttttaacaacagcaagagtagtaagcctggatccctgggccctccctttagagccattctggctctcagattgtgacactctccacagccaggagtctgcagagccactgggatatacccataacccatttcagatcatgctttgaggtatgtaggaccaaggaattccctgctctaaaggacctgagccccttccttttctgcttgggttctgcagcattgagtttgtgatttggccccactctaaatctttgaaaatttcctaagtttcaagtggcaatcaaggttgctttaaatgatatttattttattataacttttaactttttcataaatttattttcttagctgtatttttttgtgcctggttttgtgtatttgtcactacattataacatttacttgtaggaattcctctatttgtggaacagaatgcaagtaacttccttgtttctgccagatgacacccactaccacaccagcctggggccaccttaacgcaaagtgaagtctttgaggatcctagacaaaccagggaattccagggttctcccatgcaactcattttcattctgagagagcagaatgaaagggaccagccttttggaggcgggctctcttggcactccccagcttgcttagttcctgggtgccgttttccatttcttccacagaggctgtccaaggacagtgtcagtgtttcaggattgatagtgtcctcagggctaaagctccttcctgcttatttacctctctggcttggtagtttcttactagcttgtcagatcttcaatgcttttaaggctctctctctctctctctataaatatctatgtatacacacacacacacacaactaagactgaataaaaatatattttatcattatatgtttacattatattaaaatatatacttataagttatattaaaacatggatatattttataaagatatatttttgtatatatattttatccactcttcatcgtttcaggggaggattattctgaacaacttttttaagaaacagtaaatctcttgttggccatcggccatgatcatagttttgtttatttgtttttgttttttgagacagggtctcactccgtcacccaggctgcagtgtagtggtgtgattatagctcactgtagcctcaaactcctgggcttaagtgatcctcccatctcagccacctgaataacaggactataggtatgcactaccatgcccaactactttttaaatttttttttttttgtggagatagggtcttgctatgctgcccaagctggtctcaaactcttggcttcaagtggtcgtcccacctgggaaggcctcccaaagtgctgggattacaggcatgaaccactgtgactggcccatggatatttctaataaggacacacaagtgattttctttttttttttttgagatgaagtcttgctcttgctgcccaggctggagtgcaatggcgcaaccttggcccactgcaacctccacctcctgggttcaagtgattctcctgcctcagcttcctgagtagctggaattacaggcagctgccaccacgcccggctaatttttgtatttttagtagagaagaggtttccccatgttggccaggctggtctcgaactcctgacctcaggtgatccgcctgcctcagcctcccaaagtgttgggattacaggcgtgagccaccgcgcctggcctacaagtgattttcatattacagagagagacaggtaatgtggagggcaacccatacatttattcatccaacaaacattgttgagtgtcccctactgtgtgcctgtcactgaaccaggagctggggatacagagttcccctctggcagctccatggcagtaaggagtgagggctaccaaagatgattttcacaaagaactccggggacccacagataagtcgcttcctcagactggggacagggagtgaaaggaggattccctggaagacggcatatgaactgaagttttgaagaactggcagaatttactcaaagaaaaatggctgtcaaagggcactctgggctaagaagacagcatgtgtgagggaaaggagatatgaaagaaagtggcactgccaatgttactgggagcagggtaggtagggagcaggaagaaacgtggtggtgaggtagagggggcagtgaggcagagaggggtcagagcacggggcctggtgtgtgatgcctagcaacctacattttatccccgaagcaataaagggtcactgaagtgtctggggcaggactaatgtgatgcagtcggcattttaggaaggccatcatagagcctacaaggagactcaacttccagggacatgagactggtggccaggacaccagtgagaaggtcaacatagggacccaggcaggatgcaaaggaatgagctggggcaatggtcagggggacatctggaggagacaggtttgactcatttctatttatcctgccaagaattgctgtgattctttaatccaaaatgtaggttttaattgtaggaaaatctcagtcatcatctcttcacactgggcctttcttccttctctcatcctgtaactactcatcacatttggatgctctcattctagccctcatatcccttctttcctcattttttttctttatctttctattttatattctgtgtaatttttttcagttcattaattctgtaatctgctgcttgactagctgttccaatgaatcagctgtgacacgttgggcaagttacaagaaggattaactgtgtgtttcagtagtctcatgtaaaaatggagataatgacaaaacctacatcaaagggttattacgaagatttaacatgtggctcacgtctgtaatgcaagcactttgggaggctgaggcaggaggattgttgagcccaggagctcgagaatagcctgagcaacatagtgggagcccgtctctagaaaaaaatttaaaaagtagtagggcattgtggtgtgtgcctgtagccccagctattggtagggggtcggggatggggctgaggtgggaggaccacttgagtctgggaggttgaggctgcagtaagccgtgattgtgccactgtactccagcatgggcaaaagggcaagaccctgtatgcccaagaagaaagtggagaaagagaagagcaacaaggaaagggaaggtgccttagctcaacaggctgctggcggacatggagaggaagccccagagaagcatgtggcggacaagcaatgagaagcatgctgtgcagcctcaggaagcccacagcaggcactactgatgcaggagaggccatgagccaggtgggagataagaaaggaaagtatcagacaacctggggctggaacacaatgcacagctcttagaataagatcatcctcacatctgttttatgcttagggccaacagttaaaaccatagaaatgtagtcggatgaaagaatatagagaaaaataaagatacttgagtcaaaaaccaatacatcagaaattgtaaagagcttagaacaatgcctaatacaaagtaagcagtcagtaaatattaactattatttttattatgtcatttctagaagttctattttatttttttccacacatgctttgtttttcttcagtgtcccaattttaaacagaacaactatctccaattcactgagtacagattagtgagttacttcaacatcaaaactaaaatgaggttagcgttctacttgataagttacaagtttggtctccttgggccaatattttcctaaagttttaggtcattctcctactgaccacagtcaatcccattcattattgtaaaaaatatgtcagaagaaacatagagtacagatttattgacctattctccaccttttactctgtgaaatgagtaacagttatgggtaaacacaacataggggtcctaatagtagtatttgataattttttaataaactctgcactttgaaataactgcaaaggctaatattactagacaattcactgatgggtcagaaaataacttccagcgggtcgagcaggtctcttgtgctggcaccttcttttaaatattgttcttgaatgaagtaatactaccttgtataagctgcacacatattcttctgccactctcaagttagataacagatatataggtgttcacttatacgaagatgatgtggacacgttacttacttcgtgacagaataacccgacagcaactattttaaaatcagttatcacatttagaagatattctcctctaacatttaaatggcttataggttacaatcccatataacgagtcaacttattcatcattacctagaatgcattttagaagacttttatcttgggtgcttcaacagaaacttacggtgctcaaagttagatatgcttactagctaaggaaggcatttcctaagatccccttgaaagtattttcaaacaaggatttggccacatcctatgtggcacttggttggggggcccatcttttgtctgtgttaaagacaatccaaaggagaacatgaacacttttaaaaccatgcattcagtgggtcaggaaagctgaagaacagaaaccagtgaacatgaggtgtctcctgctaacctcacaagctcagggtcagaaccacaaccttagagatgccagaatagcaacacgatccctgggaaaaagcaacaacaatgtctacaaatacccaagtaatctcccaacaaaacaaactgataaaactacactactaagttagattttttggcactgttaaatagtaactattaatctcatgatttgattacctaatacttaggtggaaaaaaaatcctataaaaattagctgaaaaatctgctttaaggcaaatatataactgaggacagctaagcaacataagccttcacaagtgtgtcatgacctcaaaactaaaagaaatgtatgtcttgcagtatttaaattgtaatagctatgctcttgatctgcttcctcaaagctatcctgtgcacaaatactcctatagtgacagcttaaccttttttttttaaacctgtactgcacactgtgttagtgcacaattaaaaatggagaagtagggaaaactaagaacaaggctgttcaaagtgttggcaaaagcaaaaggaaataaaaagcaaaagataaagccaggttttaaaaaaggtgtccatgtcatggtgcaaaatgatccaagtgcacaagctgacaactgccctagcagcagggtttagaatcgatttgtaggggaagtcagaaaggggagctcagaagattaaaggtaatggcagtgtgaatattacagatgttataaaattaacattcattttaagcctttgggaatcaaaaggtgataaaaaggagacattcaaaaagttatgacacttatattctctgcttataaccttttttaaaaacaatttcagtcaggtctcactctgccgcccaggctggagtgcagtggtgtggtcacggcttactgctgtgatctcgaccttctgggctcaagtgatactcccacctcagtctcccttgtagctgggaccacaggcatgcaccaccatgcctgaccaatttttttatttttgtttttttttggtagaaataaggtcttgctatgttgcccaggctggtctcaaatttctgggctcaagcgatcttcttgtcttggcctcccaaagtgctggggccacaggcatgagccaccacaccctgcttatattctttagcattctttttatcatggcatataagaacctcatcactggcctcaatcttttcctgccctgcttttgtcattcttccccaacacgttacactctaaactacacaggaaagtatttgccaccccccaaaatccccatgcctttgattccaggctcttgtgtaaactatttcctctgcctgaaatgttctttcctctttcctttacttacagtagattgatcccttaggatccagctcaagtgtaacttaacaggctccctgatgtctggatgtccttcttctgtggtcctctatcctgggtgtgggcctgtcttagagcatacactccactgttctggctccttaacctgcccttctttgcttcctgcctggatcactgcggtggccttctcgttggtgtcctggctcccagtctcatgcccttggaagtgtttctccttgcaggctctacagtggtctccctaaaatgctgactggatcatataactcctgtttataccattttaatggctccttagactaagagacagaaacaaaatatggtcacatttatacctcagtgaccatgcaaagaaacttaacaagagttcaaaagggaataagcttggaaaaaaaagtaagaacctggctgggcacagtggctcacacttgtaatcccagcactttggaggccgaggcgggtggatcacctgagctcaggagctcgagaccagtctgaccaacatggcgaaaccctgtctctactaaaaatacaaaaattagccgggtgtggtggtgtgcgcctgtaatcccaactactcaggaggctgaggcagaagaattgcttgaacccgggaggcagagattgcattgagccaagatcacaccattgcactctggcctgggcgacagagtgagactctgtcttaaaacaaaacaaaaaaaaaaaaacaaacaaaaaaagaaaacgaagaacctgggagtcaccctatgctagaaatacaggtttcactcagtaaaacagatttaatactataaagaaaattataatggaaaaaaatgcacagtgaaaattctgtatcagaatgatgattactgagttatcaacctaaacttgacacatatcctcaactgcaccacaggcagttgattcaagaaacaaaaacaggccgggcgtgatggctcacacctataatcccagcactttgggaggccgaggtgggaggatcacttgaagccaggagttcgagaccagcctggccaacatggcaaaaccccatctctactaaaactacaaaacttggccgggcgtggtggcacatgcctgtggtcccagctactcgagaggctgaggcacgagaattgattgagcccgggaggcagaggttgcagtgagctgagattgtgccattgcattccagcttaggcaagagagggaggttctgtctcaaaaaacaaaaacaaaacaaaacaaaacaaaaccccccaaaaacagtaaattaaaagaagcattgcataatctgtcttattttttcccgttttatgattcaactccaaaatcctgggagttcagtgaatggctgaaaaataataaaatttcttccagtaagtggtacaaatccagacagactacttagattttgctgtcacttagtttacccagaggttatcggaatgttggacattagggtttctaagctttcaaactgatagactcttacagtatactcctaaggattcaggttgctatcgcaaatacaggtaagcaccaaaatgtcatttaaaagcctaaatacaaaacagatctaactcaaaataccgtctctgaaaaaaaatgggactactacaattgttttcaagatttttcatgattctaataaaccctaaagcattttaagacctaatgtagggagaagattaaggtataaacattttaagttaatcttatgcaaagtgaattatacttcataaaggctttcttcccctcattgacaaagtcccatactacccacacagaagcccagaacctaccgtgctgcttgtaaatctgtttgtgtaggctgtgatgacaccgcatttgcttccagtaaacagctggcaactgtcaggcacccaagcacaactagtcacctttgaaaaaggaccaatcaaagattatcatgttttaaaagaatgaaacttaaagtataataaaaataaaataaaagaatgaaaaatacttctacttttctgacaactattttttttaactctcaaaaatgttaggtaaacatttcttgaaacagaaacgtgtcagatatagtaatattccgtaactttgagccaaatgtctaaatgttgtttccaaattaaaatatattataatgcatagtctatgtctatacgtgcctgtgtgtggatatatgtgtatatatatttagataaatttaacaaaatgattcaggattgattaaatccaaggttgagtgtgaatgtatgtgtacttcacatatttatttgctttttgcttttattttcctcgttttatgtctttggtggggaaacaggtacatgtaaacagaggtattgcttctaatagttctaaagattgttaagcaggggaagaaagaagataaatgtgaatgtaaaagatgggattatgcctttggtacaaaatccctcagtcctaaccatggaggcaccactcaggtttgagtcaattttctatgtggcctgacaggtcctcttttccatgctagctgacccccaccctgagcaccatgtccgcagcaactgtccccaactgctctcctgtcccacctcccccacactcacttcactaagcagatggagacccccagctgcacacctcttcctctcctctcctctgcacctcaacatgtttccctgtcttctgattcagagaaagaaatgtctgctttcaaggtcagccttgcctcatcctcaggcttcctcagaaaccttgttttctttttcttacagtttcaagctgtctcttgctggcttccccccttgcactacaagtgtgttcacgtctctgctaccttagaaaatgactttctctgatctttattcttcttaactcccgttataccataaggatccattggatccaattttatgttttcagtttctttcttgagtagttctatttgttaggattgatacttcataaattttattctttcttggaggtcttccaaagaacaaagagaaaatgcacttttaaaaaatacacagaataaaactcattctgtcttggaattaccacatggatccagtgaatcaacctaagttacattacaagatcttaataactaacttgtttttctatatcctgaaacatttagcgatttcatcattctaaaaattatttcatcactactcatcaattattcctaaatacgcaaaaaacaaacaaacaagcaaggaaatgggagaatgatggaatctcccaagaggataatctaatatgtgaactaaatcgtcatcttttggttttcttattgcattgtccaaagtatagtgtcatctttcaggaaagtataaaagaaggctggagacaccacttctgtagtctacttttggctttcattgaacacggtggagaattcagaatttttcattttctaccaagaaagctgacagaggaagatgtttcacaattatgagactaatcacaacatgaaggcacacagccgtcaggactctagactctactgatgatgatgaaattgatcatataagtgaaatctcagagcgtgagtctttatataacaaaatcctggctgggcacagtggctcatgcctgtaacccagcactttgggaggccgaggcgggcggatcatgaggtcaggagatcgagaccatcctggctaacatggtgaaaccccgtctctactaaacatacaaaaaaattagctgggtgtggtggcacgcacctgtagtcccaggtactagggacggtgaggcaggagaatcgcttgaacccaggagggggaggttgcagtgagccgagatcgcaccactgcactccagcctggcaacagagtgagactccgtctcaaataataataataataataataataataataataataataataacaacaacaacaacaacaacaataatatcctagctgaattttctcaaatcaaagaattaatgggtgaacaaaaatatatctttagaaatgtatctctagatgaaaatgcaatatagtattctcatccagtttagtcatttgactcaaagtatcacacaatgtcatcacatcttgttttgctaacaggacttgtgatagtgttctttcatctttattttcatctattatgatacaaataattttgcaatgtttaaattcttttatatacatgaaatattattcagcctttaaaaagatggaaatcctgttatttgtgataacacaaatgaccctgggggacactgtattaagtaaaatctgccaggcacagaaagacaaatactgtatgatcctgctcctatgtggaatctaaaaaaagctgaactacagagagtagagtagcagtagccaggggctgagagtgctggtaatgtgtgtggaatggagagatggtggtcaaagggtacaggtttcagttgtgcaggatgattacgttctggagatctaacgtagaggatggtgactactgttaataatactgtgttgtattcttgaaatttgctaagatagtagatcttaaatattctcatcacacacgtaaaaaatgctaactatgtgaggtgacgaatgtgttaattagcctgactgtagtaatcatttcacaatgtatatatacatgtattaaaacatcacattgtataccttaaatatatacaattttatttgtcaattttatcccaataaagctagaaaaaaataaaaataagaattttaaacaactttattcaagctttggatctgctaaactaacaagtcaatttacttggcaaaaacaatttgactaaatgcttgtctttgtactggtgaaaataaattagtgaatcggaaagcatctttaaagttatttgttcatctttgtcctctcttcacaccacatcaatctaatgtaacagtacccaactcttaaatagaaggaatgcctagtaattaaaggtgtaaagaatttgattgaaagcttatgttatatctttaacattgcgttgaaaacattcaattaatactgatgatgatttcatttttcttcacttttcattggaaagtcaagatgtttgtaaatacagattactgatgacagcaatgagttaaatctgctcataaatttgtgtcagtgtattttgacaggtagaatgtattgtatatctaactcccactgtacatatttgtctgtttttcccaatttataataatcccaaaaagggtgcagtaagggacatactgattctataatatgtttttgtgttttcatttattttgtagactcatttccaatttagttatactacaagctttgccatgatttatggttataacttgtttgtgtttggatatatatatttctatctgcatacaaaggctctggttaatgcagcctgatgtttcaaaactaaaaaaaaaatcttattaaagttcctagtaaagttgtttttcactgtctctttattcttacttctgtcagtttcctggtaagctatataacaaatggtggcaatattttggtcagggatattgagggttatgcaaacaaggcactgctcctcttgctttcactgctaaacattcccctaagtagcttcctccatttctaaagagctcagggaatgggatacattttaggacacatgataaggcagcaggtgttatgcaggtaatggaaatcagaggatgaatggtaagagaacttcccatggaaagagagtcaaaaaagaaggctgtccatacgatttacagtctggaacggttgcagcagcatactgtatatttacatggtattttacagtttacaagtttcttttttttttttttcccttgagacagagtctcgttctgttgcccaggctggagtgcagtggtgcaatcttggctcactgcaagctccgcctcccgggttcacgccattctcctgcctcagcctcccgagtagctgggactacaggcgcccgccaccacgcccagctaattttttttgtatttttagtagagacggggtttcactgtgttagccaggatggtctcgatctcctgaccttgtgatccgcccgcctcggcctcccaaagcgctgggataacaggcttgagccaccgcgcctggctacagtttacaagtttctttcacaaacactggaaacattttacagcagctttctgagaaagaagtgtgagtactattatcttggttgtaatgaggaggaaagaaactcaagtttggagagattaagttactagtcaaaggctgcagttagtatataacgaagctgggacactaacaaagatcacagggctttaggcccaatgttctttctactatacatgatgtctgaataaccagtccatttaggaaaaatcaggtataaaagatggcactatggttacagaaaatgacctaatgacaaaggtgagtgaacactgagaagaaggcaatgctgatttggttcaaacactatgcccttcactgatgttgagcaggagattttgataatattctctcaatgagaaaatgggtagaaaacaaatttgggggacacaaatagtggtagttaggaagtctgtaagtactataaacatcagattctctcttttttttttttttgagatggagttttgctctggttgctgatgctggagcgcaatggcacgatctcagctcactgcaacctctgcctcccaggttcaagtgattctcctgcctcagcctcccgagtagctgggatttacaggtgcccaccaccatgcgtggctaatttttgcatttttcatagaggcagggtttcaccatgttggccaggctggtctcgaactcctgacctcaggtgatccccgcaccttggcctcccaaagtgctaggattacaggcgtgagccaccatgcccagcctaacatcagattcttgactggacaaattgcaggatattaaaaactggctgcttggctgggcacagtggctcacgcatgtaatcccagcactttgggaggctgaggcgggagaatcacctgaggtcaggagttcgagaccaacctggctaacatggtgaaaccccgtccctactaaaaatacaaaaattagccaagtgtggtggcacatgcctgtagtcccagctacttcggaagctgaggcaggagaattgcttgaatccgggaggcggaggttgcagtgggcacagatcacaccactgtactccagcctgggcgatggagcgagacttcatctcataacaaaccaaccaaccaaccaaccaaccaacctagctgctatcagtctgactcttttttttttaagatggagtctcgctcttgtcacccaggctggaatgcaatggcgtgatcttggctcactgcaacctctgcctcctgggttcaagcgattctcctgcctcagcctcctgagtagctggaattacaggaatgtgccaccatgcctggctaattttttttgtatttttagtagagatgggttttccccgtgttggccaggctggtcttgaactcctgacctcaggcgatctgcccgcctcagcctcccaaagtgctgggattacaggcatgagccactgtgcccagccagtctgactcatttttatgcattaaccattataaagataccacaaaaacgtttacatgggccagacacagtggctcactgtaatcccagcactctgggaggccaaggcgggtgaatcatttgagtccaggagtttgaggccagcctgggcaacatggagaaaccctatctccacagataatataaaaattatccaggcatggtggcacgcacctgtagtcccagctacttgggaagctgagggaggaggatcacttgagtctgggaggtggagggtgcagttagctgagagtgtgcttttgcactccagcctgggcaacagagcgacactctaaaattaaaaaaaaagttggccaggtgtggtggctcacacctgtaatcccagcactttgggaggccaaggcgggcagataacaaggtcaggagatcgagaccatccttgctaacacgatgaaatcccgtctctactaaaagaatacaaaaagtcagctgggcgtggtggcaggtgcctgtagtcccagctacttgggaggctgaggcaggagaatggcgtgagccgggaggtggagcttgcagtgagccaagatgtgtcactgcgctccagcttgggcggcagagtgagactccgtcttaaaaataaataaataaaataaaataaagtgtttacctggtactgttgtgaactttgaataaagtttactggaggctcactttgtttactcttcaaccttaaaatattatcagcatatccccagctcaggatggctgaccactgaatgtccgtactgttcatgcttctcacacctcaaggagaaggagaaagaaaagtatcagattgtcactgctcgactgttacatgacagcccaaaactggcagattaaagggtgaagtttacatagcagaacatatcatttggtgcaagaccatctttaaatctctaaaatggaacaattttttagttttattcctttaatgctaacagggttctcagggtgggattatattttttcacttgtgttgttttgactgggatttgtttgactcagaactaaaatttctgttaagaaattattataaaagacagtaatagtgaagcttactctattcatgttctgagacaccttttcttttaaaaataaatatgaactagatactatttaactttctagatacccaggatagacaactgttagtagcaggaagataacactgctagagtggaagcaacacctagcctgagaagggatcatttaatcctgtcaactgcaggactgtgtatggtagaccttcattcaattcaaggaggctctgttcttctcttcttcttcttttttttttttttttgagacagagtctcgctctgtcacccaggctgaagtgccgtggcgcaatctcggctcactgcaacctccgcttcctgggttcaggtgattctcgtgcctcagcctccccagcagctgggactacaggcgctcgccaccatgcccggctgattttttttttgtatttttagtagagacggggtttcatcatgttggccaggctggtctcgaactcctgacctcaagtgatctgcccgcctcggcctcccaaagtgctgggattacaggcttgagccactgtgcccagccctctctcttttttacaacatagtatgatgttctcttggcataaaaatttggaaattttgacatcatttcccagtactattaattatctatgctttgttggtatgctgaatatagctaaatgcagcatatatgctgtaaatggtactgcccttgaaacttgcaatgttttaagttcctaaaggagagacaatgtgctttatttattccagtacctagcagaatacccagaagtagatgagtataacaaataaatatttcttgaatgaatcaacagcatagtgaaaataggcaattcacagctttttgttttgctgagtaaaataagaaatgttgacaacattttgtaacaaaagaattggaatatactcactaaatagaaactcctctaaatataagctgctagggaaaggaaccacatatcatgagtcttgagtcctctcaaaatctgccatgatgcctggcatgcagcaagtgctccataaaccaaggtttctcattccagtaccacaagaggcatcatctttttttttttctttcagaaaaagaaacttctcctttaactattaggacagtatatcttaaataggatctattaaaattgaatctaaaattgattttcagcatgtataagcttggactcaagccccagagattctgatgcagtgtgtctcttgtgttaacaagtgacctaactttcatctgtaagctacaacattgttcagtcaatgcctctctagaatgtctatgtggactgttccttgctgggtctagtgttgagtgtatgtagtaaacactgacctctcccagaccctagggtatttacaggccaataagcatttattaagcacttagaatgaaccaggcactgtgctaatcatccccatacattattgtattgaatccttacagaaaattaccctgtgaggtaaattattttgttattcctactttatagatcaaaagccaggatttgcaaagcacgaagttaacttccccaaggccacatagctagtaagcagcagggcaaggatgcaaaactcaggaactgcctgtggaggccatggaggaaactgttctattaaactactgctctggacatacccaggttctgacaaattccaaatacattgtgcgaagaaattaagtgtaatttgagcgaacatagctattaagggcacactaagggttcatgactgtagtggcacaaataagataggcttagaatatgtttgacatgcttaagtcccataatgcaaagtgataatacctgctctttctcttttgctcaacagagagaaactttacagtactctaatttttttttttttttttttttgagacggagtcttgctctgtctcccaggctggagtgcaatggtgcgatcttggctcactgcaagctccgcctcatgggttcacgccattctcctgcctcagcctcccgagtagctgggactacaggagcccgccaccacgcccggctaatttttttttgtatttttagtagagacggggtttcaccgtgttaaccaggatggtctcgatctcctgacttcgtgatctgcccgcctcagctttccaaagtgctgggattacaggcttgagccaccgcacccagcctactgtactctaattttttaaaggtaaataattcacacatgttggtactttggtattattagtaaattacttgtaaattgcctcataactaattgtaacatactagtaagaatgaaccattgataacacaataattatgattaaacagttctaccctatcctattaactcactaaacatagataaaacggtatgcatcctctcttatttctaacaactataaaacaatcattcatttcatgacagaaataagagtgagcctaaaagaactatggcccagctagcatacctaatttctttaagtgactgatgttttctctgggtgctggcacctttgtattgcaggttgggtggaaggctatatatggctcccaaagagcacagtgcacagaaggtaatggtaattgccagcagtgctggctgctaacaggcatctagtccacacactggcttttaggcaagtctgcatttaacctgatagaaacagatgagtgccctaggtcattcattttggtgccccatgtccacagtaagtaggaagagttcttttgtttctagtgaaatggctaatttggaatggctgagggactgctcaaatgcaaaatgtccctagttttccagtgtctagttgacatttagaaacatgaagaggcctctactgcacagcactttcccacatgttgcttttagtgagtcagtatgtggggagtcagaaaaggattggttttcaggaatacgtgtctttaaaacctattttcaaggctatctcgacatccttgttgtgtttgttgcttaaacccatgactatatcttctgagatggtagatttgttggtcaaatacgtctgtctattctggggctcaacagcctcaaagtgtacatttctgccaaatcgataacatcttcattttgtgaacataaccatctattcttgtccccttcaagttcctcctctcatttcaaatagcactgcatttaactctctgttttttcatgtagcatgttttcattcctactttgcactaaataaccacaaatttgagctgagtttttccaccaaggactcaaagtagcagcacagatgagctagaaatactcaaatctcacgaaagatatatccagaatgatcttcgttacattttattttaccttgttccttgctatatgtcatcagaagacagaaattccgtgacaaaccacagattgctctggtgggcagagcctggagagagccaaatctttctccgtggggctggctgaagcagaccacaggtactggagcactgggggaacccacgtattccccccatttcaagccttttatccatgacaaaggactctaaaatgaagaaaaataaaaagtatggctttttaaaaggtggtaagtgtagaattacttctaatttaagctctaaacaaagtaagagaaagtaatatggattataagctctgtaagggcaataattattttacgcatttttttttacttccccatgcttagcgtatagaaatatttgtcccttatttgagttttactctgtggttctggcctaatttgcatgaaaatatgtggttaataattcaaaattccttgaaatttgagcagagaaaaaaatttagtacatttcttatttctagttgaaatacctaaactaaagttgatacttactggaggactgtaatttggtagtatgacaagccatatgtacatatggtaatagaaatcaagaccacatgtagcacaggaaacctcactcagctatgagctccttgaagagagggaacacctctgattcatctatgtgcctggaacatagcaggttctcatctcaaatagatacgtgatgagtgaaagggaaagtgtttatctatggaacatattgcgaggattagagaatctctagccagtactagagaagaaaagagatgagaaagaattgtcagtgaaaaataaaaggtagagcttgaagaacaataggatttgggggaagaaaggtgagtgaagactctagagagatacccatttggctgcccacgaacggtaatgaaaaggtttcctccacttcaagcaaaaacagttattaaaaagtttcaaaatgaagaagaaaagacatgatgcccttttaaagagtttccccaaatagttctattctttttgttctccttatgactgttttatcctctactgaactcttcttttttaatggattccctccttttatacatttaagagtttaacccattattttactttcaactcttcagaggaaatgctacataaaataaaaataatatattaagcaattttcagtcatttctgtaaaaaacctgatttttagtgaaacttgcttatgtcattttccaaataaatgaaaaaaaaggcatcactgacgtatagactatcttttaaaaaaatcgtgccactttaggagctctaataattctgtcagactatttaggggacatgttaaatgatatcatagtggtctaaaaaatgagtatctctggaaaagcttaagagcttcaggaatgctcatgtgggaacagagacgttagggtcaggcattttgaaaacaagcttctaaaattttgtctaacagtgtttttttgtggctcccctgtgggatccaaatctatcaatattaaagttgagaaaggccgggcgcggtggctcaagcctgtaatcccagcactttgggaggccgaggcgggcggatcatgaagtcaggagatcaagaccatcctggttaacatggtgaaaccctgtctctactaaaaatacaaaaaaatttaactgggcgtggtggcgggtgcctgcagtcccagctgctcgggaggctgaggcaggagaatggcatgaacctgggaggcagagcttgcagtaagccgagatcacgccactgcacttcagtctgggcaacaaagcaagactctgtctcaaaaaaacaaaaacaaaaacaaaaaaaatcaacaaataaagttgagaaaaatgtgtgtgctaaattttagttataatttatcattcacaattccttgccaggaattcatataaaaggaacttccttttatatgagttgcagagtttaaacttctagtttttcaatgacacagaaagatacaagggcaactgttttatatcatagcatatttatgatcattattctcctttcttttttttactttagttctgggatacatgtgcagaacgtgcaggtttgttacataggtatacgtgtgccatggtggtttgctgcacctatcaacccatcatctaggttttgtcttgatgctctctctcccatccccaccaactccaccgcgtggccccagggtgtgtttttcccctccctgtgtccatgtgttctcattgttcaactcccacttatgagtgagaacaagcggtgtctggttttctgttcttgtgttagtttgctgaggatgagggcttccagcttcatccatgtccctgcaaatgacatgatctcattattttttacggctgcatagtatttcatggtatatattttctttatctagtctatcattgatgggcatttgtgttggttccatgtctttgctatagtaaatagtgctgcaataaacatacgagtgcatgtgtctttagagtagaatgatttatattcctttgagtatatacccagtaatgggattgctgagtcaaatggtacttctggttctagatccttgaggaattgccacactgtcttccacaagggttgaactaatttacattcccactaacggtgtaaaagcgttcctatttctccacagcctcaccagcatccattgttccttgactttttaataatcgccattctgattggtgtgagatggtatctccttgtggttttgatttgcatttctctaatgatcagtgatcctgagcttttttccaacagtaaccaaaacagtatgatactggtaccaacacagacatatagaccaatggaatagaacagagacttaagaaataacaccacacatctacaaccatctgatcttcaacaaacctgataagaacaagcaatggggaaaggattccctatttaataagtggtgctgggaaaactggctagccatatgcagaaaactgaaactggaccccttccttacaccttatacaaaaattaactcaagatgaattaaagacaaatgtaaaacccaaaaccataaaaaccttagaagaaaatctaggcaataccattcaggacataggcacgggcaaagatttcatgacgaaaaggccaaaagcaattgcaataagagccaaaattgacaactgggatctaattaaagagcttctgcacgtcaaaagagactaccatcagagtgaacaagcaacctatagaatgggagaaaatttttgcaatctacccatctgacaaaggtctaatatccagaatctacaaggaactggtacaaatttacaagaaaaaaacaaacgacctcatgaaaaagtgggcaaaggatatgaacagccacttctcatagaatatttaaagaggagtgctttattgaaatgctttttatacagctctgattgttttgaacttcaatagtgaactgaagttcacacaagcatacctgggtcatccagatgacccccttataaatgagtactgttgcttggtttcaaggcttgtgtttgcattttgtgtagatgtcaagtgaaggcccacagagtcaagaagcagtatggtgtcgaaagtttcaccgtggttcaaataaagaaaagcagtggcataaatgtcattacacatcacacagaaatgcagcaaaccaaaccttaaagaatttgcatcagagaagacattaatttaaaaaatgctgagtgtctattatatgcccaggaccttcctaggaactggggacacagtaatgaacaagacagacaaagtccttgtgtttatggagttacattctatttgggatgggagtatagacaaataaataaacaaatacatatacaatatgtcaggtgatagaagtgctatacaccaaaacaaagaaggggaagggatctgaggatgacggaacagctgttttagacataattagacttagatataatcagagcttttggaaagcatttaaatgggggtcagggaagactctgaggaagagatgtctgagcagagacttgaatgagatgagggagcaaactggggatatatctggggagtggttattccaggtggagcaaagagtcatcacaaaggttctgaggtgggaatgaagcaggctggtaccatgttcccactgcgagcagacatactgctcagatacaactttaacagctaacgagcagtaagtatagtagtaaattaaatggcatttattaattttcagggatgtattgtaaaattatgctgacatgttaaagtgacagattgggctgggtgtggtggctcgcatctgtaatcccagcactttgggaggccgaggcgggcagatcatgaggccaggagttcgagaccagcccggccaatatggtgaaaccccgtctctattaaaaatacaaaaattagctgggtgtggtggcgggcgcctgtaatcccagctactcgggaggctgaggcaggagaactgtttgaacccgggaggcagaggttgcagtgagccgagattgtgccactgcactccagcctgggcgacagagcgagactcatctcaatcaatcaatcaatcaatcaatcaagtgacagattgtagttaaaaatagtgaccctggtaattacagtgactaaagtgatttgtgaagcttcaaaaacagaaaacaaaaaatatagttttctattatgaaactcaacacttgtaatttagttttagcaaaacaacactgtctaccatattaatgctttaaaattgaatttcactggtggaataagttttgtttgtatttaacatgaacatttgacatatgtgagctatgagcgcaaataatttatatccagtgttctgtcttacataaagtaatattacaaggaataatagtcaaaacaaggtgtaggtgtgtaaaaaccttttcctcttaaaataggtcacagattactgcactttgagatacactgagttatttcatctttaaggtcctttacaacgtctttcccttaccttttcattttctgtgatttccttctgcaaacccttacagtgcttacaattcacattctactatcttatgctgtttttataacgaagaattgagttgaagattaaaatccactttagctttaaggcttgcttgatttttctattttgaagtaaaaattatacctacttcctatttttggaggcaatacttcttatcattacaacctgaggaggccaaagaaatatgtaaagttccccttaggtataaaccaaaacatccgcatcactggtcaatccttttgattgtagatgataaccaagaccatggtatgcatgtgtacactggcacaccaatgctcaaactattctctagtccttctcttcttgcttgaaaaatcctattatgtcactgccctgcgaggctttccctgggaataacaattctctctgctccctgagggaggttaccgtctgaaacgatgaattcttttttcctctgagctccccaaagcactctctcatatcgctaacacagcatttacctcgcacaggattctgctttcgctgctgcacctgtcttgcactgactggcacacagctttaggccaggaccatgctattcatcacctgggagagtgcctggcatcacaagagtctaatcaggttttgctgcactcgattgaaatccaaatgacataccggataggtgatttctttgacctgttctcgggtctccctgaaagcaaactgcactagcaaccccacagcagctggaagctctccttcaatattgagcttggctccaggtctgctcacatgggccatgtggaacagctgacggggagtctgcccgtaggtttttatcatggtttctagcgctcgtctctgaactggatcttcaactgcagagacatccattccaaaatatgtctgcagagtgaaagagtaaaggaacaagacatatgtagtaaaaagaaagacttgacaataataccaaagggaaaaacaacactttgttttatattctaggttatggaaaaaatgcttttgttcaggttaacaatcactcatggtctcactgagatcagaagtatcaatgtttctgaataggtgaacaaaaacaacgtatcttgactgatggttataattagttatgtttataaaattagcttttaatttaagatctgagaatatcatatatgacctgatactaaattattgaagaagttgcttatccaaagcaatatataggaaaaggcaaaaatgaagttaaaatacaatgctggtagatagttgaagagataattatttaggttctaatcaatattggggataaaaccaaaagagcagcaatgaaaattcaaagctcttaaatgtaaagggtattattgtactaataaaattactgcactaagaagcatattttttcttagtgtcattatcccgtagagtcagatggagagcaatgcacatttacttatttctaaagctggcggtcagtaattgagtacagatcagccatattttgtacatatccacttgatggcttagcttttcgtatatttaatcagtcatagtggctttcattacatatctagacataacatttctataaatgccaaaataaaattccaaagatatttcagaagttaggtcatcttcaactccattctcctcaccacaactcccagcaccagtgatcaaatcctttttttaaaaaaacctttaggttcagcagtacatgtgcaggtttgttatttgggtaaacttgagtcacaggggtttgttgtacagatgatttcatcacccaggtactaagcctagtacccagtagttattttttctgatcctctccctcctcctatccctcaccctaaaataggcaccagtgtcgttgttcccctctttgtgtccatgagttctcatttagcttccacttacaagtgagaacatgtggtatttggttttctgttcctgcattagtttgctaagggtaatggcctccagctccatacacgttccaacaaaggacatgatcttgttcttttttatggctgcaaagtattccatggtgtatatataccacattttctttatccaatctgtcattgatagccatttaggttgattccatgtctttgctattgtgactagtgctgcagtgaacattcatgtacatgtgtctttacggtagaatgatttacattcttttgggtatatacctagtaaagggattgctgggtagaatagtagttctgtttctagctctctgaggaatcaccacactgccttccacagtggttgaactaatttacattccctccaacagtgtacaagtgttcccttttctccagaacctcgccagcatctgttatttttgactttttagtaataaccattctgactggtgggagacggcatctcactgtggttttgatttgcatttttctattgatcagtgatattgagctttttttcatatgtttgttggtcacacgtatgtcttgttttgaaatgtgtctgtttatgtcctttgcacactttttaatgaggttgtttttttcttatacatttgtttaagttccttatagatgctggatattacacctttgtcagatgtacagtttgcaaatattttctcccattctgtaggttgtctgtttactctattgatagttttttttcctgtgcagaagctcttaagttagatcccacttgtcaattgttgctcttgttgtgaatactttttataaacacttatctaagaaaggccaattgcaatggctacttaatgtactcaaaaaatcaaataaggattgatacactcctgtagctagaactgttttaaaatttattttaaaatagtgcttttcaacattctgtggtattcatttctaagtgaaccccatgtattagtgaacggtcattaagggcaacaggcatctctacatgcctttttaaaaagttaacatttatttgtgcttaattgtgttagcagacattatcctacatgaatttccttcctcatttatgaggttggttttattattcacatttgacaagtttgtacattttggtacagagaggtcaagatatttgccctaaggtcacacaacaagtggcagagtcacagagtgaggatctgaactcaatccttaattcagagtctctgcacttaatcgccatactttgttttgccccattaaataagttttattaaattcttaacgatggcataaactttatccttctaaaagttactaaagtcccaaagaattagtgaaaaaaaattccagtcagatgagaattaccatgtgtatttcagtcttcagatacttttttttaaaaaaaaaattgagacagggtcttgctctgtcaaccaggctggaatgcagtggcacgatcatggctcactgcagacttgaactcctgggttcaagtgatcctactgcctcagccttttgagtagctaagattacaggagtgtgccaccatgcccagctaatttttaaattttttgtagagacaggttcttaccatgttgctcaggctggtctcaaactcctggcctcaagcgatcatcctgcctcagtctcccagagcatttgggttataggcattagccactgtgcctggcccagtgatacttttaatgtaaattttatataagaataactgaaaagatggttcaggattataaacaaaaagggtataatgaagttaatgttaagattcctaattgctctttttatttttattttttatacagggtctcactctgtcacccaggctggagtgcagtggcatgatcttggctcactgcaacctccacctcccaggttcaagcaattctcctccctcagtctcccaagtagctgggattacaagcaagagccactaccacccagctaatttttgtatttttagtagagacagggttttgccatgttggccaggctggtcttgaactcctgacctcaaatgatccacacgcctcggcctcccaaagtgctgggattacaggcatgagccaccatgcctggcctcctaattgcttttaaagttgcattttggaatcaaatgaagctcaaaaatcagacccgaagccttgcatttattttatacttgatggagtttaggacacacaaccccaaaatttcgtaccctggcatactgaaggaatctgaggaacagcatgtgcacgaaggactttttggctttcccctgaagcagatcataagattttcacttaggagttaccctccctatacctgtagtaaagaagcaccctcatttcagaagacaaagggacacagaggaatctgaacaaacaggtcctgctattcccctggttaatcacacttagctcctactcctttgtcctatcatttttcttcatgacattccattcctcatcaaaccagacataaaaacattcaggtttaactacttggggtcttatttccacgtgaagcctcccgtgccacataaaacttgcattaaataaatttatatgcttttctcttgttaatctgggtttttgtttttctttgtttttgttattttgcagaggctccagcaagtgaacctgaggaaaagaaggcattttttctcccttacatattaatattatatgtaaagttgttattcaccaatgaaactatattattctccttttttagaatgaacttttccatagcatttatcttctattagaataattaggaagcctatcttattctcttttctagattataaatctcttaagaaatttaattttatatgacttcagacgtactcaaaataattatggaacaaaatgaactaatgagctttttattttaaagctacttttggggaatggactactggcctaaataagctcagatatggagtggtctactgtaggttctgtgtgtgcactttacctgtatttgttataaacgcttgtagatttgctacagtcgacacagaaaattacagttagtggagaagtccttcagatatttccttttaaaaggaagtatctttcttttcagaatctgctttttcacctcccactccttgagggatttcctttcagcggcctcatttggactctactactacatccaggcaggcccatctaccttggagaggaaagttggctttcctcctaacccccttcaccctatttgagtcttatttacttttgcatccccagcacctagcaaaataaatgtttcctgaagaggtaagattttttttttctaaagttagtctagccaacaacatcaaaaagtatacttgaaaatgtaggccagacatggtggctcacgcctgtaatcccagcactttgggaggctgaggtggtggatcacgaggtcaggagtttgagaccagtctggccaagatggtgaaaccctgtctcactaaaaatacaaaaattagccaggtgcggtggtgggcgcctgtaatcccaactccttgggaggctgaggcaggagaattgcttgaacctgggaggtggaggttgcagtgagctgagatcacgccactgcactccagcctgggtgacagagcaaggctccatctcaaaaataaataaataaataaaaagtaaaaatgtaacaattctacttctaggaatttatcttaaggaagtaaagatgtacataaaaataaccatagaaatattaattttaatagcaaacaaatcctaactaaatatccaacaatagaagactgctaaataaattattctatagctatacttaagaatataggttgagtatcccttatacaaacatttggaaccagaattgttttggatttcagggtttttttggggggggattttggaatattagcattatttacttagcagttcagtattcttaatccaaaaatctgaaatctgatatgctccaatgagcatttcttttgattatcatgttggcactcaaaaagtttctgattttgaagcattttgaattttggatttttggattaagaatgctctacctatagtaagtagccattaaaaataatgtagaatgatacccaatgacttgaataaatttaagattatcttatttagggagaagataaggttaccaaatagcattattattattattatataaatggaatgatacatatgtatagatagaagtctaaaggtgctttcactatttatttctggatggtgatattaaagtggactttaaaatttctccctgttgctagtctgtattttatacatttttctaacaaagtacaagtactttttctgtaataagaaaacatggtgccattttaaagtagaacatgtatgtaggatagtgtgcggaaaagagttaacatagcaagattgactgctatctctggaaaggcctgcttgcaaagttggctcttggctgttgtctgggaacctggatttcaggagaggtcctaccattccctaactgataagagtggcttactgtgcctaaactgtacaaacaatgcagtttataccgaacacctgctttccttctgaggctggaatttcagtatgtgcgaggcagagggtgcctacgttgccaatctcaataaaagtcttgcacactgagcctctaatgagattccctggcagacaacatttcacatgtgtcattatgactcgttgctggaggaggctgagtatgctttttgtgctttaccaggggtagattcttggatgtttgtgcctgctttctcccagactttgccccatgctgattctactttgtatcatttactgtaataaacctgagctggaaggatgactatatgctgaatcctcaagtccacctagtgaatcatcaaacctggggattgttttggggcacctctgaaaaagatagtatcttgtttttaaagagaggaaatataaaacctgaaaaatcttaggtgacagtttaatgctactaccaattctctttgataacttgagtgttttaaaggaatggccgaacaactaaccttaaaatattcaggttctatcttatataaatacagattgttttaaaagagtcacttacagcaggatgaaaaacattgatcgcttgaacagaagccttccccttttgcttatacccaaacaccaagtcaatccactgacagatgttctgcgacacgtagtcagactctagagcctgccgatggatgaggataaaaagacgaggatcattacgcgcccaagggggaaggttgacgtgattaacccgttcaccattctgacgcacaccaaaatcaaaacctaaaagagaagattaatattaatatttaactcccccacagcaagtttcattcagctacagagcaggtcttaagagttcacaaaaatagctgtttgtgtgctacaaccaaaaaagggaatagcaaggaggatttacattttgaataagaaacaccactgctcatctacttatgtacctactaatagggctatgtgagctaatgctatcataattaaatttgagatctttcaactttatccttctaccactttacaacatattgaagaaaaggagaaaaccattgcctactaattccaatattctgactattcacatcttcaagggcattaagtacttaaatatctattcaattgtaaacctgattagaatcaaactaaggctttgtagaagcatttctaaactattggtattaacattttaataaatttaagattatatttagtaaatattagtattctatagtttaaaaactcaactaatataaagtatacacattgttagaatgaattgccatagtctattaattttataagtctatgggtctgttctgacttcctttctactaagcattcctgtagatagcaaaattatcccaacacaggaaataagagggttcttctgtgatgtaaatgagctaatatctaattgtctcatcagtataaacaaaaatctcagaagtgtttatttaaaaaaattatcctaaaggaaatgttacctttaaacagaaatggctttttgtgctacattttctagtttgctgaacaccataacaaaaattaaaaatgaccttttaaaagctgattaagttccatgtaaaattaagttgctgtctgtctactttttgatcttgtaaaaacagttagaaggatcttcaccaaaatacttgggaagtattttgaaatgatatgatatggaatataaatcaagggtttatataaattcacatgggatggggatgtgagcatctcagaaagctcagcagtcatcgtacagagcagctgcatggttgatttaggatggactggctgagcacctgcagaactccatgtgtgtggcttcaggagcggcagcagcaggaacttatttatttaacagtgaatgaggcatctgggaatgggctggggatggggtgcataagggcatttgtacaaactcaatctttcccaactttcaggtgttctgagggaacatctgactcctgacccaaagcagacaactgacatacgagagtcccaggggaacactgataggaaatgatatgatatacgctgtaaaaaactgtgttttccaaaaatggctataacagcatttcctgtcttgcatgcccttccagaatcttgctactctccatcacaaggcaaagtctatcttcctttcttttgaatctgggaagacacttgtgactgcctcaatgaataggaagaatacagtggaagtgatgctgcgtggctgctaagaacaggctggaaaaggccatgcagcctctgttcgtctccctcttggaacacttgtctttggaaccctgagttgccaagtaggacatccagggctgccgtgctgtggggaagcccaaaactagcccacacagagagaccacatgaaaaaacactgacattgcatgaagagagggtgatgtgctccagctgcctaaggcttcatctcctgcctgttccagctccagaaaacctgaaggcaacagcatgagacaccctgagctaaaaccatctagctgagctgtttctgaacttctgaccaatttcttatttctgaccaataaaaaataattttattatctgtgattgataataaatttattattgtttcaagccattaagtgttgagattatttgttatacagccacagatagctagaacatacatataagagaccatggacagagaaaacaaggagtagatttaaacaggagtcctaaatgaaaagcttcaaggcaggtgccccaaattgcaggtgctgatgtttgactgaggcatttctcacttgagcaacactatgaaataagctccagggtggcatgaatctactgatgattcaataatcaatcaaacaacctcagagacacagatactatacaacaaaattccaatgtaatttgcccaacaccaacttcttaaagctgtttcatatgctcttaaggatcacataaaattatagaattaagtaatataagaaaatgacccaaagataccccttaaagggttagctgctcttctatttaagaatagctaaggttggcagccaagactgttagttggcatcacagaaaatttgattttatactccagtattccttttggttattagataattctgggcagagtattttatttttattttggtcattcctcataaaataattgagatttcagttaatttacattttgctttcaataaagtcatacctcttatttttaaagtaattagcacattataacttttgtattcagaaaaaagaataaagcaatttctataataaaattaaaatacatatttacaaataactttaatagttaaaagttacagttttccaaacatatttagtcctataaaatacttaaaatcctcaagcttatttgaaaatagaattatatacttaataaaaaacattttctcttatttggggactcaaaaatttttaggacttaaaaaagctattttcatttttggaaaattacaaaataaccacaagccctcagaaatataaattaaaaataatttattgctataccttcacggttaactaggaactctggaagatagaaaaactctgggataagttctttcacatcagtcatagattcaaaagatgagagtcgccaagttgtatttgtagaatgaaaagttctgtctggaatgtcaaaactttgatctataaaaaaatacaaataatacgattaagacacaaagacctaattctatttgaggcctatcataattaatttacttttgccacttcaaaaagattaaaataatgctaattttgtttgcccatagtttaaaagaagttattcatgttcttgaaaataaatatttctataaacttgagatcatattacatttttcatctgtattatgcttttgtaatatatattattagattagtttatatcatctatttgtttaattttcgtctatctatcaaagtagaatgaaagttccacaaaaacagggccctgggatatcacccacaccttgcacataatgggtattcaatcatggtttatttattgaatgaatgaataatgaagaaggaagatttaagttcaagtaggcaaacagttttttccccatcaggaagcatgattccttcactttgaattgttaagactactttttctcctttcttttctttctttcttttttttcgggggggtgcgtaggttacggtgcattgttttttggtgttctaactctgagctaaagaattgagtaaaatttcctgtgaatgaaaataaaaataagcatagtcactctttcgttcattttttttccagggtagactattaataataaagaattaagtttggactctcttttctgccaacaatgatcagactttctagccatagggaaaggcctagaatattaaatgatatccaaaagctagcctctgaaaacagtagcagtttacatgtttcttaggaaccatattgcatcatctaaaactcctctgaacttgttgaaatttgaacacatcttttcatttggagactgccacaaacacatcgcagcatcaggtttcttctcccagccttagttgctctgctgagcaacatcttctgtcacttgtattactttctcatctattctgttgagtcaattggcattggctggccactaaaaaaaatctgggaagaaataaggtttagaaacatttactttttctcagaaagtaaggagggccacttaaagaaatacctactaacttagtagaaaaagttatcaatcaaaatggaattcagaaaaattaaggtaattctcaaaaacaaacaaaaaaactaaaagaaaaattaaggtaattttgtaaggctatggtgaggtcaaagtatctggagctaagactaaggaaatacggaacaagagtagcacattgggtaggttctgttcagattttaagattctctgtattttcctacattttattaaacagtactactacaaattcccattatctagaatatgcatatattaaacctgtggttctcaaccagtagcacttttgccctccaggggttatttggcaatgtctagcaacatttttgattctcacaactggggggatggggtgtgggtggtggtggtaccactggcactagtagggagagaacagggatacagctaaacgtcctacaatgcacagggcagctcccatgacaaacgaattatgcagctcgaaatgactacagtgccaaggtggagaatccctgcattaaaccaaagccaagaaataaattcaaaagccaacagatatcacttgaaactaatgagatgaaagtgaatggagactgaggtagtcctaggttttaaacaaaatatattcataaatacataatgaagaaaacataatatatgaatacattcataatagtaacatgaataaaaatattgataaattttagttgattggtagttttatattaatgggttcttgggctacattaaatgaaatgtagtcttggatggagggaggtaatagttctgttaaacactgtaggggcccaaaccacatctgaaatattcttttttattttgactgcctttttcttttcatcaagagcattcacaaatcagaacatgtccagaaagatcttcagaatagtgacaggcttggaaaccacagcaaacaaggatggcttaaacattggttttaaaaactctttatttagtacaaaactgtcctatttattttttggtattccttccagcagctgggataggaccatgcatccaggaggccctcaatctgccgtcaaattaaccaaggataattagccaggggaaaaacaagagagagagagaaagggaacaggccaacaattttcaaatatttgaacagctgtcatatagaacatttgttctgtttacttacagagagacaaacataggaaagccccttttatagaccaataagagtgaatacaaattcattcctccaataggttgtacatgagtaaaaagcatgaagtagttcaagaatggttgagtaaaagaatggataatgattcctcaaagtattctggattccatgagaaacagctatagaactaatatcaccgttctcattagaaactacaggtgagtatgtcccaatctccacaaaaatacaaattcactcctatctaagtcatgttcaggcctccagtctgtcacttaaaatgctgatgtagaagattattaactacaaagctaccacagtgaagttgccggtgtgcgtcttttattaactagttataataaacctcaataatgtacttgcctttataataaactgcaataatgtacataggctccaaaggtaacttactggatttgaaataagtattaggtagaatgtctttaaaaagtgaactgcataaactttaaaagggtaaattttatggtttgtgaattatatcttaatttttaaaaagtgaattgcatttttataaacttagacatttaatttgaagctaaaatttgagacattagcaagatgatttggcttactacagcttttttgaggagcactttgggcaaggaataaatagaattctttttcctgtagtttgattagtcttaatagttcttaaaatgtcagtcctaagttgttgttgttgttgttgttgtttctgatgacccaacatgactttttaggcagttattaaattcttaccttgataggctaaaaacattttagtgaaaggaggcatcctgaccaggaagtgaagcacagtgccgctattggaatagtgggagccatagtgatagggctgcacgggaggcatggggtcatcttctctggctcctttgcggtactcttcctccaagtactgaaagaaacggtgaatccagagaattcatgattgtgggctccaggcaacgctagaaaagtgctggatgtttttttttctctccttctctactacccctttgaggccattctccatggctggccctcccactcttacccaggagacttcagcctccttgagtgtctgggagtcttctccttggtgcctcactaagacccaaacactcagaagcatttctcatctccaccttcactctttcattccctcatagaaaacctacctaactttgagcactccacctcctaactaatggctcataatgtctaagctgatcaagcacccaacaaatgagaggtgcttctgtcactagagatgtcttcatttcaaaagagtttcaagatgtaatgctatgctgtctagagaactgcttctctagaagtagaaatgcaatagaaatgtaaaaactatgtcacattattggtaataatataacattttaagtctgttttacagtgcagttatcagagataaaaaaaaaaaagaatatggtgatttttcactactcctatcttcccatcataaagtaggaagttcaaccaaacatttaatatctgtcactattcttgtctcccatagcttctgtctggttctgataacaaagtcaggtatagtgaattttcaagagttacttcttgatttccacagcaatgacgcattttcaactgctgaagaatcaagtagtgacagtcataagatgcttagagggatgtttcaggaactgtggcataaaataatgtgatgaatatgagaaaagtgtttcagttgctcctgtcttgatactcgtgaagaatgtaatgcgtagctattgtgatttttgaatttccaatagaatttcattaatattaatttcacagaaaaaggtaattcattttatttttaaaatgttaaaatctgataaatttttgtttaataaaccaatgcataatttcctgaatatgactaatggttatgggtacattataaatatattaacactattacataaataacactaggggatacgaatagcaggtccctggaaatctttgtgatttttataaggaatgtgactactaaatactggaataaacaatgagttactggctttcaatttatgccaaaataagtgtattctttttctgggcaaagtgttctcagaaaatcaggatagaaaatgatatttcatttcacataatgatttctagttgtctgtcaatcctagtacaagaaggtaaaaaatccatagtataaatttaaaattaggtaaaacacaagtctgtaaaacaaaacacaatttttcatttaataaagtacgagtaaaaacaaaagctaccttgtatgtgtccacataacgatcttctttttctttatactgaacagctataggtttagagagatttctgcaagaaaaggacaattttaaaaattaaatattttgatactgtcaagattaagctccctagatgtctgcatcttgtaagtaggtaagtggtcaacaaaatgctccacccttatttctctgcttaaacatattgttttgtaactaacagtcaccattcaaaattatgatttcagaaattaaggtagaattttccccacagagccaggccagtattaggaattcctgacttacaagtagcctaaataagaagggctactactatccttctttcccttacttctgcagcttcctctagagtcataactgatgttgctcgtgggagcagattcctagaccaagccctgaaagttagtgtcccattttccagactctacatccagttaggcggtgtagaatgaagggcagtttcgacagaacttaggaacagaggaagatgctgtgttattagcctagttagttaaaactgaagaaacaacacgtgcttaaaatgaccaagctgagatttggagactgagaactgaaataaatattttgctacctagttagtagatggggagtaataccattgcgcacagtgtagagtatgtatgcatgcgtacaaatctgtcagtgccggtgttcacattctgtgaacaccacatgacaccattccttgaagcaggagaatgaattctcatccctccaggaatgaatcctcacttttacaagctacagaatcatgtggtgtccctgtgtggcacttgaaggagcaaaagaaaaagctctgatgaagaagggcaggctcttttggctgaggaaccatctggtctggcacaggcatgggaccacctggatttcaacctgcagcaccataactagaccaacagcaagatttgcctacatttcagtgagtcaaaccaggtctgcttaaccacatgttgatacatctttttttttttaatataaattactattttctaggaatgttgaaattagttgtattaaatgcactaattttgtctttgagatttttctaatcataaaaaccttgttaaaaagcaaaaacaatttatagaatagatacaaattaacatctaaaaacagagcaaaatcacttaagatggctgcctacatttttttttttttcactctggagtgaagtggcgtgatctcagctcactgcaacctctgcctcccaggttcaagccattctcttgcctcagcctcccaagtagctgggactacaggcatgcaccaccacgcctggctaatttttgtatttttattagagatggggtttctccatgttggccacgctggtctcaaactcctgacctcaggtgatccatccacctcggcctcccaaagtgctgggattacaggcgtgagccaccacgcctggcctgcaattttttatagatagtataaataggggtttttttttttggacacaagctatgttaatagttgtagctgaaaaatacaaaattacagttgagcaaacaataaactaaaaatcagccacaatactattaccctaggccacacatgttggtctatacacacccagatgtttttgtatttatctgtgcaagcatattcactttttttttttttcagacagtttcactctgtcacccaaacatgatctcagctcactgcaacctccgcctcccaagttcaagtgattttcatgcctcagcttcctgagtagttggtctcgaactcctgacgtcaggtgatctgcctgccttggcctcccaaagtgctgggattacagacttgagccactgcgcccagcttaaatctgatttcttgagaactgtctgaattaggcccactctttggcacttacagctgaaatactctagtatactaagtgaaatatttggagtccatttttctttaaactaaacatcagaatattttttcatattaaacgaacaaaatattccctcatcaactaggactatttggttactctaaaatacagttcattcaggaaaggcagaataaatgctgaattctgttcctttaattgccaaatttcaaagtaaggaattggtgccctattacctctaatgggaccaatgaattttgtttcactgtgtttccttggccttttaaaaagtatcactatgaccttacgtttctttttatttccatgtgtttcaactaattgcagtcattattctttttattctcagactatcctatctttggcagcgagaggcacttcaagttggcttctgagtccttttctatttttattttttgagacggagtttcactcttgttatccaggctggggtgcagtggtgcaatctcggctcatcgcaacctccccatcccaggttcaagcaattctcctgcctcagcctcccaagtagctggaattacaggcatgtgccaccacggccggcaaattttgtatttttaatagagttagggtttcaccatgttggccaggctgctcttgaacttcaggcctcaagccatcagcccaccttggcctcccaaagtgctgagattacaggagtgagccaccacgcctggccaacttctgagtccttttgacaagaccatattagtttcctcgctttctgacacaacaaaacatcctaggctcaccttgtctattttcttctaataaatttagaagaaatgagagaatgggaaatcaacattttgcaacctctagtgaaataattgattcaagcaataatcatcaatggatgaaaccattaggtacaaattcaatgggagcctgagcccacagatcaaactgagcaccattacagtggaatatcataggcttcctgatatgatacaatataaagctcactcctctcaaccatgcagaatgataaaaaaaaaaaaaaggaaaatatatataaagctcacatcaccacctataaaggattcttgccaaaaaaagagttgaacctgaaactaagcaagacttttccagtctctaggaaatacaggggttatgggaacaaaccaaacgacgtcatgggaagcaatcagaaaatacagaatgtgaagcctccaaaagaataagtgacctggtttttccaacaagtcaatgtcaggagaaaataaagagaaaaaatacacataaaaaataatggctggctgggtgtagtggctcatgcctgtcatctcagcactttgggaggccaaggtgggtggatcacaaggtcaagagatagagaccatcctggccaacatggtgaaaccctgtctctactaaaaatacaaaaattagttgggcatggtggcaggtgccggcagtcccagctactcagaggctgaggcaggagaatcgcttgaacccgggaggcagaggttgcagtgagccgagattgcgccactgcactccagcctggtgacagagtgagactctgtctcaaaaaaaaaaaaaaaaaaaaaaaaaaaaaggctattctaggtatatgttcagagatatagcaaccaaacatgacaatggacctgattcaagacaaccaactataaaaagctatctttgagagaagcaggggacatttggaaatggactagatattagatgatatcatggaattattgtcaattttcttacatgtgataatagcactgtggttgagatgttctattttttaaagagatgcatactgtagaacaaagaagtgacataacaagatgtctgcaatttgccttaaataagaaaaaaaagttaatgtaagtttggcaaaaatcttcataattcacaattgttgaaccagggtgataggtatgtggggtcttatataattcttctattttgtgcatgtttgaaatttttcataatgaaaactttaataaagaaatacaacatatggatggatgaaccctaaaggtgatgattcttttaacttacctgtatatcaacagatcattgaggtcaagtgtctcactaacgtagtcagcaagtataaatgggaacacaggatactgcatgagatcattgaaggatcggccagcatgtttgtttaagtgagtcaaatattcaaaattagtaatttgcccagtataccataaatttgtcagagcggtgatgttaccatattccagaagattagggaggttatttgtgagtatattgtggtatacatcatcacgaacctaaaagggaaggagaagaaaaaaacccagatattatttttagtcttattggcacttttctccaaagaacccatgacattatagacatgttacaaatctcatgtcctccaaaaaaagatttttttctcagtaacattaatgggtagagaactgagattcaagtccaggttgtcctccagaggctgggctcttcaccactatgctttactgctgcagaaatatgttaataaaaaccttctaagaaaaagtttgtatagaaaagtcacttaagacacagatactaaaagaaaaaaaaataaggaaaaaagaagagttttcttctaaataaatgcaatatggtgtagtagaaacagcacggtcttctgaattggacagatctggtatattttcctgctaaccttctgtgctacagttaccatgtctataatatgggagtgataatatttctctcataagaattaaataaagtatcctatgtaaataggatatttgattttcactactgattgaaaacatatataaactcttttttagagattcacaatagttttgtcacagaaaaggggtattggttcttttaaagcaattaaataatgattgctaataaatgaaaaaaacagacaagacgagctttgctaaaaacagatatgaaatacccattctaagcaggtatatgcttcagacacaggaagaagagccacagatatggataatgagagagtgaacttaatgaggaaatgtactggtagttgtggaataggcaaaaccacagagaatagaacatcctaaacctgtagcctaaatctgaagtttgccaattgttagcgctaaggtccacggaaggggatttatgacagactataagccaagccctggaaggaaaaggaggcattcatttattcaacaaatatgaactgaatacctacataccagtagtgttcaaaattctgaagaactggaacttaacaaagtaaagacttggcattctactggggagaggcagaaaatgctggatgctaatacatcctatagagaaaaacagaccaaagtaaaggaggtaaggggtgcttggtggagagggaggggtggctactttatagagtcagggagggcctctctgataagaagatatttgatcaggaaacttgaaaaagtgacaaagcaaatcattaggatttctaaggagaaaaacattccaggcaacaatgaatgcaaagtccccgaggcactggtgtgcctgacattcaaggcatggatggagtagacagagcgagggagagaacagcagacaatgacgtcagagaggtaacaaggtacgagattatccagggctttatcaggttattggaaggactttgcctttaactgaatgtgacatgaaagtgattgaaggattctgagcagagaaaagatatgatccaacatactttagctgctgtgttgagaataatctgaaggggggctaaggggctttctatagaggagagcagagaaatggtagtgaagggactggaggtcaagaaagggtttgtcaaagtcattgtagctgaaagtcactacagcactgagcaagttttttgttttgttttgttttgttttagatggagtctcactctgttgcccaggctggagtgtaatggcgtgatcttggctcgctgcaacctctgcttcccaggttcaagtgattctcctgcctcagcctcccaagtagctgggactacaggcatgtgccaccatgccccgctaatttttgtatttttagtagagacggggtttcaccatgttggccaggctggtcttgaactcctgacctcatgatctgcccgcctcggcctcccaaaatgctgggattacaggcatgagccactgtgcccggccctgagcaagtttaaactacttcgtttcagtcattttggggaatcagaatttaacacaattttggaggtcaaaaataatcatcatataaccaaggctttcctttaattaggactaagaaatatggcaatttttatttgatttcagaaacagtatggatgcaggaaggccagttaggaggctactgtaaatgattctggcaagaaatgatagtggcttaaaccaggatggtagcagtggaagcagtcagactctcgatgtattctgaggacagagccaacagaacctattaatagagtgtatgcagggtatgagagaagaacaagagtcttggataatctcaagagttttggcctgggcattggaaagatggagttgtcatttactgagatagagaaaactggaaggaaattatggggggaagattagaagttcagttttgtacaggttacgtttgagatgtcaattagtgacttctaaatggagacatcagtcgggagttacaatatgtgagtgtggcattcaggggagaggtttgggtagtgacataaatgtgtaagttgttagaatacagatggtattttaaagtcataagactggatgagaagagaagaggtctgaggaaggagccctgcaacacaccaaggaggcgtctgcaaccaagactgagaagcaatggctggtaaggtataagaactaagagaaaatggtaacccagaagcccagggaggaaggttttatttaaggagagaaaaatcagctgggtcaaatgctgccaataggtcaagtaaaatggggacaaagaaagattatgacattacgggtttagcaacatagaggttaccgatgaccctgacgagagtggtgagaagtctgtctgaagcatttcaaaagaaaactggaggcagcaagcatatgcaactttccccaacagtttttccataaaggagagcagagaaatggtggccgaagggattagaggtcaagagagtttgtcaaagatggaccctgctacagcactgagcaagtttaaattactcctttcagtcattttggggaatcagaatttacctcactgtggaggtcaaagacaatcctcatataacaaaggcttcactttaatcaggactaagaaacatggcaattttattcgatttcagtaaaccttcatgtaatcagtatgagtatagttacagtggcccatgagcacttaaacaatatatatcaattaataagggtgaatttaccttggtgttatcaaatgccaacaggagtgttctgccatttgttagaaagatttctacagcattatctctcaattgccaccaacgcttgtgaacttctttaatttcttcatatgtccaggaaaatgatgctggttccaactctccctgaaggctctaagacaaagaaataggcaaaaatatttgttttaccggaaatataaataattactttaattttagattttaaaaagcatcaaaataaaacagaaaatctttttgtggcagatggcagataagattacctgaaaactctcccaatgcaaaacacctcaaaatgaatgataaaatttagaaataaaaaaaataggctttattttttagactagttttaggtttacagaaaattgagcagataatacagaattctcacgtatcctcccctcccttggccctgcactcacagtttctctattattaaatcttgcatttggtgtgggacactaattacaattgatgaaccaatattgctacaatttttcttacctaaagtccagagtttatattcactctttgtgttgtacattccatgggttttgacaaatgtataatgacatgtatccaccaaatagttttattgccccaaaaaccctcggtactccacctactcatccctcctttcctctccccaatctctggcaaccactaatttgtttactgtctctatagttttgccttttccaaaatgtcatatagttcgaattatacagtatatagccttttaaggttggcttcttttactaagcaaatatccttttaaatacatagctgagcttgcaagaaaacaagggaaatgacatccccagaagtcaaaaatgtagaggaactggaaaatcagcactaagcagggagtgatactctggttgctctgttgtatgtgtctgcatatgcatgcatgtatgcacataccccagtttcagaaacaaattgacgtaggttcacagcaacttgaggacagaagatgaggccctgggcccctagaatcagggtatggaattgagattgcttcagaaagctaaaacctaggaagggatttgttcctaatgaaagattagacaaacaaatgtgcccatcaataaaggggaataggccgggtgcggtggctcatgcctgtaatcccagcactttgggaggcggaggcaggcagatcacttgaggtcaggagttcaagaccagcttggccaacatggtgaaaccccatctctactaaaaatacaaaaattagtcgggagtgatggcaggcacctgtagttccagctactcgggaggctgaggcaggagaatcacctgaacccaggaggcggaggttttggtgagccgagatcacgccactgcactccagcctcagtgacagagtgagactctgtcttaaaaaaataaaaaataacaaaataaaaataaagaggattaaccaggaagcaagcttgtctcttttggcctggagcctagagcatagaaaaaaagcctctctctgagaattcataactgtgggcctgccatcatatagatttaggttaaatccatgtctggatggcctggaaacgcccgagctgtgaaacagttctcatgcttccgagtcattcagcaaagggaaagcagagtctctggaggagcattcctggaactaatggggcattcctgcaaataaagccccactcactaaatgtaagctgacagatcaacacataccaaatagatacattcccctgctaggtggtcaacagaagaaaagaagatgagaaaagaatcactggaaggttgaatctgcttgagagtattaatcctagtgtactcagacaaatccccacattctgaaatgaagaggtagggaccacagggcctacacatcctaccatcactaggtccctcccaaagtacaaaatcaagaaaaacttaaaaaaaatgcatcttaatcttttgtaaattgtaactgaatacataaattatgctacttaatgcttttaatagagaaataatgaaaagtttctactaaagtttaaaactagctagaatttatctcctcaaatcaacctgcatcctagttttcttttttaaatcagtttttttccttttaaaaaaattgcatttacttactcttctgtgttgactaacaggaagctcagagcaaatttaggactcaattgccaagaactattttatcctaggctctttatctttccaaaaccttaatttttttttttagattcagattatcctactctatgtgtgttttactattgttcttggtccaaaataatttttataagtagaggcagggaatatattatgaataaaataaaatgtcttaatgaaaatgtaatattttcatacttaaaactgaattcttcctttgtttagtttcaacattcattcaacatatattaattaacatctatgcgcaaggtactctgctaagtgctctgcatgaaatacatctgtatgggtcaaaaagggggcatgaaatatttgtacacacatttgcacacacaacgcaagataccaaatgttatataagaagaaccaacattacaaaagtacataggaaagaaggatctttcaatctattgagaagcaagggcatttttagatttgaaaaaaaaattttcctctttatttaaatataaaacacatttatagcatgcaagttgacttaaaattaaatggtgtcttcccagaccaagtatttgtgaatgtatcctcaagcactgaaaataaaccaacatattcgacagatggactcagactcttctgtcacctcatgtcaaatggagttaaacacaaattgagtagaatttttaaggggaaaaactgtcatcttttggacatacaaaaaagttgtctcatacatcaactattaaattccttggctgataaaaggatccatcttgaaaaataacataactatattttactatctgggacataccctgtggtaattgctatataaatgagaaaagaatgctgttcatatttctgactactttaaatactttcatgactttttttttacatttattttataaccaaacttcatgttttcactcactactttctttctttcttttttttttttttttgagacagagtctcgctctgttgcccaggctggagtgcagtggtgtgatctcggctcactgtaacctccgcctcctgggttcaagcgattcgcctgcctcagcctcccgagtagctgggattataggcgccaccaccacaactggctaatttttttgtatttttagtagagatagggtttcaccatgttggccaggctggtctcaaactcctgacctcaggtgatccactcacctcagcttcccaaagtgctgggattacaggcgtgagccactgcacccagcctaatttatttaaaataaaatatatattagtaattaaaccacacataatctcatttagtatatccttaggaattcccggctttagaacttttctgaaacaaaaagcttatttctcctattacaggaatctcaaaaaatattttaatggcataaaagataattcaaataaaaagctttattatacaaaaaatatgtctattttctgattaatatcagtctgtctagaataataacaattatcattattaagctatgtgaatatcagaattacttaagttattcaattatttaatatttttcctttctttctgaaggcaaaggtacttgatagtgaactgggagtggcaaggaatagatatttgttgcaacggaggacagtaataagaaggaatgaacataaattgatataataggagcatttagaatatgacttatattaactgctatgatacttgggccataagccagaggagatggtacagtcttctttttaaaattatatttaaaaaaatgtttggaactcagaccaatctatacatagagtgacaaagaatgaactctaatagttcttccttctctctagttatactgaattgatacatttttggaatctgtctagatttatgtaaatacagacttaagcctctactcaccgaactttcaactgtatcagaagcattatcttccacaaaatacattccacatttacctgcagaaagtaattggatataagggttttaaaatgtatgtgcacactaccattcatggtttaatgcatggtctctggagtcctttggtctgaatttgaatctcactacctcgacacagttcctggcactcaataaatatttttgaatagtatccatgaagtcttgggcaagttgctttacctctttgtgtcttaatttctttattaaaaaaaaaggttgcagggagctctatttcacagagctactatggaaattaaattagaatatatgcaaaatgcatatgtgctcagtgctaaataaatgttggctatttattattaccattattcttacattactagcatatagatttgctttattttgttccacactaattgaagtcaagtggtaaaccaaattatctagccaaagggaaatccttaattattttgcagactgagacactcaatagggtagagtaggccctaaacatagcctccaactttttcctgtttcataggctggctgttgctaacccatgtccctacatcgtgttttaaaatgttgggaacttctctgaggttccgccccctgcatgctcatcaccctcgagtagtgaagtagtgaagtagtgaagtagtggcatggctagctcagagaagggtactatctccatccttgtgacggtggggctcagtcccagcaggcttgaagctccatatcttggaccttggaggctatagcttacaacattcattctcgaatttgaaggtacatcaaatcactggagggctcatcagaacatagactgctgggccccaccctcagaatttcagattcatcaagtctggactgaggcgtgagaatgtgcaattctaagaagctcccatgagatgctgatgctactaattcagggttctcacacttggagaacctagcctacagcatacagattgattctttaagggaatagagatcaagtggtataattgttttccttcatattttgagaataaaattttcaaacaaatataactatataggtatctatggactaacaatcttgtcctttctctcagaagcacaatagagaatataaattatggacaatcttaaaatagacatatttcttatggacagttatatctgataaaatagtaggtaagatatcaacaatttttcactttaaaaaatctaaattggcatataataaaagaaatggttaaatataaatttgcatatcatgaagaaacaattttataaaaactaaaatgctattcatgtgcttttcagaacacaagatatcatttcttcacattcatgactcatatgcaattacatataatgttaaggcaaattagcctatatgatactacagaaagtttatccaatttaatggcatgctgtcaaaaaacactttaaataatctaagaatcaaataaggcagggtgaatatgtgcaaaattcttcaaaatttgacttacctagtaacaattcaccagctgtctctctagatggtgcaacactgatgcatcttcgattcactctgtcaaaacatatttaaaattactatgactaaatgttctgaccaatttcagagaggatatgctttattttacctagtaaaagatttctgcaaagcagactagatagagttccaatagcatgaggtatcttgtcgaaacccacatgaaaatattagctcctttttagcattctattagaagagaaatgactgaaacgcctagaaaaggctaataatccctataacctgtagacagaatatagaaattaagttatttaaaagagatatcaatattttatattttctaataaataagcaaacattgtttcatgcctctgatacttcagatacattttttgtgtgtgctctatttatttttgtattattattttgtattatttatttgttatatactattattgtattatttacattattatgaaggtaatttatcaaatacatttttaaaaaagcctagtattctaggaaaaacagaggatttggaatcagaaagttcctttgtgttcttagccaattatcttctttgtgtctcagtttttcatctatgaaatgggtataataacaaccacaataactgcaatgataatactatcaatagttaatatataataacatacttaatactcaacaacgctatgatacctattattatttcttcatttaatagatgaggtaactgagacagagaggttaggtaacttgcctaagattaaagagctagtaagagcaggaactggaatctaaacctttaatcactacgttatattgctgcttgatgataccaccagcagctctatctatattaatagatagagatgttaaacagtcaattacaaaatatgtgtgtgtatacatatatatgggtatatatatatgtacccatatatgtgtatatatatacatatttatatgtgtgtgtgtgtgtgtgtgtgtgtgtgtgtgtgtgtgtgtgtgtgtatatgtaaactaacaagggccagaacatgatgactgaaatcccatgaactcttgctgtcagaaatgtcatttccttttggattttggccatataaccttgtcctcccttgagcctttcctgtttaggatttttctgaaaatgatggcattatataaaataaatattacataaacactacaataagctgttgtatattcatgaaagagtgaaggtctattgattcaaagttaccttatagattcacttgcagctttgtctttgacagtagaagagaaagaagaatgagttttgtcttcaaacaggtaagagagtggtggtttgacaacatctgttgaggagaaaagtaaatattatctttatctaatgaccatagttctctgctatatttatatgttgagtcaagaagccactattaccttctgatttctgtctatccctaaggagatacttatttggaatagttaaataacatctctgtaaacgtctcctctctcgatttggcccttctgttggatccaactgccatgaggttggatagtagatggggtcataccatactgctctgcaagtaaaaagattaaagggtgttttaagtgaccatccaggacttgtagctataaaaaaaatcattatagagattgagtaagtaagtcacaactgatctgttaatttaaaaactccaaatgtttatatatttgatcagggaatgcatatacaagtagaagtaataaaatctaagtgtctttttgctcctgaatcccagtctcccagttcctcgcctgaaggcaagctctgcttccagtttctttcaactattaaattttttaaaagatatgtaatgactactatgaacactttagcaacataatacaacatgctggatttaatatggttaggtaaattttttttccaaattaattttttacatttcccattttgcattttttttttttttttttttgagacagagtctggctgtgtcgcccaggctggagtgcagtggcgtgatcttggctcactgtaatttctgcctcccgggctcaagcgattctcctgcctcagcctcccaagtagctgggattacaggctcccaccacacctggctaatttttgtatttttttagtagagatggggtttcatcatgtcggccaggcttgtctcaaactcctagcctcaagtgatccacccacctgggcctcccaaagtgttgggattacaggcgtgagcgccctcacctggcctcattttgcctactctctaatgaaacaaataaaatcaatttctttctgtggtatgaatcacatttttaaaaagattttaaaataaattttatcttagatgaaataagacaggaaaaacatattaagtacatttttagaaataaataagagaaaaaaatacccttattcataccctaaacataccaaaatactggtagcggttgttgtcttttttttttaaaacgtgcatctgtttttaatttgtagttatgatcattatgatcatttttctataacttgccttattttactgaaacagtattatctttatctcatcattttgaatggctgcccaataaagaggtagatgcattgtaatgtatttaaccatattacggtttataacttgtttctaattcattcactagcataaataatgcagagatgaaaacttttatgtttactttctttttctttttcttttttgacagggtctcattctgttgcccaggccagagtgcagtggcatgttcatagctcactgtagccttgaactcctgggctcaagtgatcctcccgcctcagcctcccaaagtactagactacaggtgtgagccactgtgcctggcctgccttccatatttcgaatattttccttaggatagaatcactaaaataggataactgaagctagaagtaaaatgtttttaggatgattaatacatattgtcaaaatgtacaatgccaccaaagttctgagtaaggacagctaatatcctgcggtgaatattagcagccaaaatttttgttaacataaaaagtaaaatgtggtatctagaggttctagaaaaccaaattagcctctagcaatattgaatattttcccgtgtgtttggtaattcatttgtcttatgtgaggaatgtgttcatgccttttgctcattcaaacttctgggatcataatattttactttagaatctgtgtaagtttttcaaacaataaaaataactttatttgctgaaaatatatttccaggcttttttgttcttgttatggttgttaaatacactggaaaaaattaaggttaaaatccattgatttatttgcagtttcttctattgcatttgagcttagaaagtcatctatccttcaaagagttgacaaatatcctattatcttctactttataaacttttcgagtaattcttttatccatatggaatttactttagtgtctaatgtttagtgtattttagtacaccaaagtcacatgaataagttatcttaactaaatttagagaataataccttgatttcccgctttttgttatttgtaatacatattttaaattagttagaaaaatatatttttctcaaccatcctgtttcagtgatttctctattcttttacagaccatattttaaaattaagctaattttactatctagatgagctactgcccccctcattacttttcttcctcaagaattaaaaaaaactcatatgattattctttaagatgaaaaaaacatcacaaatgattaaacaaaaaattgtttaatgaaatgattttatgagtctgaattccggaatacaaattccgtttaacatcaatatcttaaatcttcatggaagacaattttaactgacctcccgcagcttacctatcatgtgtcagctgctgaataagttcctgccaatgtctgctggcactcaaatctactttatacattcctctaatatgctggatcaccttttttctctcatttccttgggagagagacactgcctgggtgatatctgcagctattttagatatatcctttgattttgaatccagacgctgaaagagactaaacaaataataagattgtccatagttaagcatacatggaacgtatttatcagaacatgatactttaaaactaaaagtatatgtgaaatctaatggattcctaaaatacatgcctttggaacatataaaatcttacctttgttgattattgttaactgttttctgccaagcagctttattcactccttcttcagtttcatatttcttttgttcctagaagatttagataataatatactatataaaatttattatttctcacctaacattgtcacagagcccaacaaactaattttaaaacccagttaacaaaggaaaaacaattgtccctaggagaccagaatattaaaataaatgaaccatctaaacaatgttataatgttataattctgtgtctatataatttaggtcacataagttagagtagaatggttaaccagggttgctaaacctgatgagtttacatagttgcttgcctccttactctgctttttcattaaagaacctctaactcaaggtatgcttcagcttgcttgtcactttaaaaatctttccttcactgaaggctactgataatggatactgatgaccacagagaacaaaatgctccttaaaataagcctattttttctcacatagacaaaagcaatatagtatataggaaaaataaaataaaataatcatttcaagttcatcatcaatgatagcctgttcttaaaaaagtagtgtcaatcattctttatctatgatggaatctcctaagaaagtactatggtttcattgactcacctctttgatcattttaataaggtctgcttttgttgatgcactgggagggatgcacttgtgaccacataacttcaaagcattcataagcagttctgctgtgcctagctcttcttcagtcaattcaccttggtgattatgtatcaactctgacaaatacaaaactaacttggctccatgctttaaaaaaagtaataattttttagtcatttagaattttaattcttacatttaaattacttagtagtaattaaattatattgctagatttatttggttgcatctgatttaaataaagcacctacaaaagacattctgaggataagtacagaaatctgattatgcactgagtatttgatgacagaggattaatgctaattttgttagatgtaataatgttatgttacataggaaaacatttaaaaaaaagaatttagaggtaaaatatcataatttctatatatatgttaaaatagttcagaaaaagaagaaatgatgtcaatataataaaaatagtaacaactgttaaatctaggtgatggttccatggtatttattacgctattctttctagtctctgtatgtttgaaattttttcatataaaatatattttaaaaagcaagcaaactagccagctagcttttggggaaagaattttggaaaggacttgctaaaggaatacaggaaagaaactgggataaaggaagataatttttagtttttctcacagaaaaactgaactagaagggaaagcttcctttagaccttaaaacttactgactcttcttcctttggtgaaatttctggaactaaaacctatctttagtttgtaagcattcactactccctagaacaaaaggtgaaaaactcgcaaaccccacgcagacaattctatgtatgtatccatggcagagttgttttagccaatcttttattaacaggccctaaaaccaaaattcacagtgttacttaagataatgacaattggcctttgcagcacagacctaaaccaaacgttcattcacggttttttaagtggcccttacatgctgtagatattacacctgattctactgtgtacagtatgtattatttagacaataatgttgccaacaagttaaacatatatattttactttaaaaatcagcattgacacaaatatcactgtatttagttttatgacattttaaactgtgaatagtattaaatgtcagcaaatggatctggaaatgattacattttgggtgatatttaaattaacatgctgaatcacatcgtgtcatttcccaaaagcaaaagatgaacatatgcaatggtgaaaatagtacagctcattttaatgcaacattttaaattagtcagagacagctgctacctgaccaaaagagaaaaatgaacagaagctctgtgagtaaaaggcctaaagagttggcaaataaataaaaacggtacatgactaaaagactttcctaagtgtgtcttaaaggtaatgatcttgatataactttaaaaatatttcagtttggtattcaatgacattcaaaaattatcttgaaaaactatcagaaatgtttttattcattgtgaatatcaaaggaaacacatgattttcttaaacgcttaagttgtttctaatatctcattttaataccctctgatcacttactgatgatcatttcagggactataaaaggtgtcactgggaatagataacaaaaaactcttattttcagcccttaaaaaactgatttaaggaattgaatctgttaaacatgaatccttagaaaataataaagtgctaaaatatgtaaaatatttcttttcaaagaaggttctaagaaggaagagttctgagtagactacagaaagggagaaaggttttaaagaaggtatagagtgatctgggtcatggccaaatgaatggatagaatgaggatatagatagacaaaggagagagaggtgttctgtgctggtggacaatatgaataaaacagcatgactgtaaaaataaacaggatgtgaagaggttgcaagacacaaagatatgattatcttgaaaagaagagggtcagcaggctggagagttaatcagaatcaagttgtaatggcaaagaagtctggggcttaaaaaatccaggcacattccaaatgaaatacaaattaaatgtatgcagctgtgaaaaggcataaagaagatcactctgtactactatgtaataatgatctctaggatatactaagtgaagaaagtaaggtgcagaagagtgtgtatactttgctatctttctttgtgttatgaagtaggggacagaatatttacatgtgtaaatacatgtatacatagatttgcttgtatcttcaacagaaaaaaaaagtcagttacctacacagagagggaaaaaataagaggagcggaaagggataaaagctagaacctctctgaatgtgctgtttcacaacgttgcttttagaaccatgtagacatttcacatgattaaaaacaaaattaagcaaacaaacaaaaacccaaaggaatcccaaaaaactataaaacaaactggaaaaaaaagcctacctacctatctaattggttgaagttggcagcctgaccaaataaagaaaactattttaagtgcttttataatacagtattttcactgtataaccataatagtatgctaagaaaaaaagaaccacaaagacatcttcaactgcactcagcaggattgttattagtgatcatgttgatcatcttattttgaaaatgttatatatgtagaaagacaaggcaaataagtgattatgttaatgttaggaaccaagatatcaacattagtaagaaatacaaataaaagaatccaagaaaaagtgaaagtataaactcatgacttgtctttctaaaaaaatacttatttcctagctttgtccactaaaaaaggctgagaagaaatgacaacccaggagaaataaacatacctagtccttagatttgtagtctctaaatactatcatctccttaaaaggatataaggtcttcttgggagggaagttaggttctaggtttggggaaggaattgcataaggtgggcctgggacattcttctgtgccagaaaacaaggaagtttaatcatattaacttgttaaaatgaaaaaggccatgtcgacacaacaacttgaatctacagaggtgttaattttaatatcaaactgaataatgactgcaatagactaaaacacataacatttattttaaaatacctgagctcctaatgacactccaaaaataaaaacaaatacaagaattagaggctactaggggcatgaattcatcattccaaaaattaataaacagggaaggaaacagcatttatcctgcttttccttgactgactgtatttaaaggtagcgaaggtgctggagccgctgccgacgagtctggatctcactgccgcgtgccccaacacccgccggacgtgcattctcgattccttttgtttccaagtccaatatactctcaagtatacgctcaaggatcagcttattcacagtcttctaaaggaagaacagatcctccagaataagattacagttgttggggttggtgctcttggcatggcctgtgccatcggtatcttaatgaaggacttggcaggcgaacttgctcttgttgatgtcatggaagacaaattgaagggcgagatgatggatctccaccatggcagccttttccttagaacaccaaagattgtctctggcaaagactatactgtaactgtaaactccaagctggtcactatcacggctgaggcacatcgcaagagggagaaagccatcttaatttggtccagtgtaatgtgaacatctttaaattcatcattcctaatgttgtaaaatacagcccgaactgcaagttgcttattgtttcaaatccagtggatatctttgacctatagtggcttggaagataatggctttcccaaaaaccatgttattggaagtggttgcaatctggactcagcccaattccgttacccaatgggggaaaggctgggagttcacacattaagctgtcatgggtgagtccttggggaacatggagattctagtgtgcctgtatggagtaaagcaaatgttactggtgtctccctcaagactctgcacccagatttagggactgacatagataaggaacagtggaaagaggttcacaagcaggtggttgagagtgcttacgaggtgatcaaactcaaaggctacacatcctgggccattggactctctgtggcagatttggcagaaagtataatgaagaatcttaggcgggtgcacccaatttccaccatgattggtggaataaaggatgatgtcttccttagcattccttgcatcttgggagagaatggaatctcagaccgtgtgaaggtgactctgactcctgaggaaggggcccatttgaagaacagtgcagatccactttgggggatacaaaaagagctgcaattttaaagtcttctgatgtcatactatttcactgtctaggctacaataggattttagttggaggttgtgcatattgtcctttttatctgatctgtgattaaagcagtgatgttaagatggattgggaaaaacatcaattcctaaggttagaaataggaatggtttgtaaaatcctacagtatattctgtaggtactatatcctgtaggtagctataacttgtagtaccattctgtaggctggatggtactaatcttgtgtagtcctaaactggtttgtgtgaaatagttctgacacctctaaggcaccactgccaatgctgcacatgctgcagttggcccttgagccagatggatgtttaccgtgtgttatataaataacttcctggctccttcattgaacatgtctagtccaacattttttcccaatcagtcacatcctggatccagtatataaatccaatattgcatgtatggtgcataattgttccaaaggatcttattttgtgaactatatatatcagtagtgtacattaccatattatgtaaagagatctacatataaacaatgcaaccaactatccaagtgtcatactaactaaaacccacaataaaccttgaacagtgaaaaaaaaaaatagaaaaaaaaaaaaacgtagtcaaatagttgacaagggaaagttcttccctatagtaaagtcagagcttatagatgctgatggaatgagagacttagagaaatcactattttgtaactctttaatgaaaaagtggatcttggcaattatcatcagtggctgctaaaactattaggttaaagataatatcctcagtcttcgtgggtgaataaacaactggccttggtgacgaaatggattgagaaagagaagaaaaagtcaacgacaaccacagttaaaaatttcaagctgaaattcaataatgataccactgacagacacgaagtagtgggaaagggaagatggtatgagaaaaagtggactgttaacaccgcagttgaattttgatggatagcaactttgctgagtataaaggaaagaaaaaaacaccatttcaaattctccacagaaggaaaatacaggctaaatatgcttctgtcttgggaaaaggaagacagtgccctcagtgtacttgaaagtgtcttaatactggaaaaagcacctaaaagtattccttccagatagttttgactcctaatatgatatgtgttttccatgtattaaaggggatacctatcctttttaatatatcctctctcatctctattgaggtataacttacatataataaagcatagatatattaagtgtttctatgagttttgacaattgcatacatccatttaaccactactcaaaataagaccttatttttatcaccccagaaagttcccttaaacctctttccagtcaattccctttctcaccgtcccccttccacagagacaactactgtcctgaattctatcgtcatatcttggttttgcttgttccttcagatgaatagaatcacagattgtactcctttgtgtttggctgtccctttccccactcaatgtttctgagattcatccataatggtagatgtaccagtagtctgttcctttttagagctgtataatagtctatatggtgctgtagaatagtctatacagatttctctctacaggtataaagaaatcacaatgtgtttgtacattcttctgttgataagcatttgaatatttgtagtttttggccattatgaaaaaggctgacatagatattcttaaacaagcttttttatgaacatatgttttaatttctttttcaggtaaatatctaaaaatggagtaacatggtgacaagttaaatatatgtttaattttttaagaaactgttaaacagccctccaatatggtttaatgtaccttttaaactttccaactaccactcttgaagtgataaactttatacactctgaaattcttttaggtattttgggtttgattattccaaatgattaataatttttatctattttaactgaccacatatatttttgagatatgttatatatactgttgtttgagctattcaatatagatgtttcacaggtaatataatgcttttttaaaaagcctccaaacaatccttaaataaaacacttcaagatgtgttaacacattacaaagtttctgacagaaactctgaaacagaacttcttaatttaggcactagaaaaaagattgggaaataaacacagaggttaaattgagcctgtgtgaaagcacctgagaaagaccttaggttaaatttgcttggtaagaaaattatatttataaattaggcatgaacattcagtttaatttcagttcttgttttattcagactttgtatttcaccaaacgttttacttctcttatcaaagctgagatacttacttgtagggatgggctgagacagtctcgtagtatttcctgatgatttggttcatgaactatttcaaaaatttgctttctctcttgtgcagcgtgggctggcgacaaaatatgcactagtagtctcccaagctgcattcggaaggtctccttacaagaccacagaattttagtccattgctgcttggaaccactggctttacttgaaccctaaaatcaatcaagataggaatgaattaggatcagactgcttaagcaataccatgctagcctcaacacagccctaaagaagattatggaacacgttttattccagattggttttaatagtcaaaattagaaagagatatacatatccatacacataggagtttaaaagagatgggcatacaacattcatagcagcatcactcaaaatagccaaaaggtggaaacagtctgaacgtccatcagtggatgaacagataaacaaaatgtggtatatacatacaatggaatattattcatccttaaagaggaaggaaattctgacacatgctacaacatggatgacccttgaggacattatgctaaataaaataagccatatataaaaggacaaatattgtatgcttctatttgtatgagatatctagaacagtcaaactcacagagacagaaagtagaatagtgattactgggtaatgggggaaggggtggtaaaagttattatttattgggcacggagtttcatttgggataattaaaaagttccggccgggtgtggtggctcacacgtgtaattccagcactttgggaggccgaggcaggtggatcacctgaggtcaggagttcaagaccaacctggacaacatggtgaaacgctgtctctactaaaaatacgaaaattggctgggtgtggtggtgggtgcctgtaatcccagctacttgggaaggtgaggtaggagaatcgcttgaacctgggaggtggaggctgcagtgagttgagactgggccactgcactccagctggggagacagactgagactccatctcagaaaaaaaaaaaaagttcctagagatggatggtggcaatggttgcacaacaatgtgaatatacttagtgccactgaatgtatccttaaaaatggttaaaatggtaaattttatgttatatatatatatatatatcttaccacagtttaaaagaagacatggacaacgaagctaaagtcctaagccatgaaaaaattaccaaaggctcaaaaattataaattaaaaaaaagcatcaaagaacaatgataaataagcctacactgattttgcaataaaaaagagaaaggattcataataaagacttgaattgtgctacattattgagtataatagtcacaaattaagcactgcatatagcagtacccccttacctgtggttttgctttccacagtcaaccatggtctgaaaatagttaagtaccgtataataaggtatttactcattgtaaaaagggagagactacatttacgtaacttttattaaagtatattgttataactcttgttttactattattgttaatctcttactatgcttaattcataaattagactttatcataggtatgtatgtatgtgaaaaaaaatagtatatacaggtttcagtaccatctgtggtttcaggcattcaccaggggtcctggaatgtatcctctgaagataaggggaaactactctatgggtttaccatagagtattccctaacaattaaccaattgttttaactatggtcccactaagcctagccaaatgctgatcaaatcacctgtatctggttcaaaactggaagcagtacattcagaattcattctgagttttaaaaacagctcctctctaattacatctagtcctaagggccctgtttgagtgactgagttctaagtgaatctgtacttggttttgctgttcagagctaaaacaccaaaatctagtttagatttagagattgacatgtcatgatttacgagttctgctagaattagattggcttttgctatctatagagtaaactgaccgatttgttccgttgtgtcaactgtaagtgacccgcagaaacccaagtgagatgatgataaatgaaccctgacacttatcagtattctctacataattttaaaggtgttaaacttaggccaagatctaaaattcataataattagaaaaatgagagtaagtagccataaatacagtcctttaaaaagaaatagttcatgtaaactcccatagtagtcatcaatgatgatgatctactcttttctgatgctgatcttactaaacaacactagaaaatgtcttctagggttacaggcttaaaaagcaatgcttcatgagttgagtcattttggaaaggtgaattagcaatatatattattctataattaaaaattcaagttgtccgagttttaaaaagctctctgaaagagcacaaagaaatatgattttgaaaacgtataatacagtcaacataaaacctctatttcctttgtgtgaatgaacatttcccatgtaattaatttacttacaatagatactttgaatccttctaccagatatgtaaaaatttctttctgaaatggattgaaaacagaagactgttcatgatgaatattttcctcagaaatttcggtctggaaaactgaggtcttgctttgagttacattttctggagttctcaaaatgtcaataatgtctgaattaaattctttgaattgaaaaaaagaatacaaaattagtcatatcactgctatcttgccattataaatagtaataatactggtaaaaaatattgtatttaattactaattcagttatcacaatttaaatgtgtatcaggtgtattagatgtaatagatacaatgtagtagaaagtgaatttacgtaaaataacagaaatttgaaaatgcatgtcatacaattccaaattaaatatttaatggactaatgaaggtaagttaaactgcaaaatgactaaaaccataagattattatacaaatcaaacataaagatcatgtcatatttacatgagtggatctacagagctgtttctctgcatgtgctatacatttacgtgctgtatatgtgataatcatggttcaatttcagagtttagtctgggagtctgttgcacagaatgtatattagaaaagtggaaaaaaaaaaatgctggggacgatggctcatgcctgtaatcccagcactgtgggaggtgaaagcacacagatcacctgagtcaaggagtttgagatcagcctgggcaacatggtggaaccccatctctacaaaaaaatacaaaaattagccgggcatggggtgcacacctgtagtcacagctactcaggaggctgagatgggaggattgcttgagcccaggaggtaaaggttgcagtgagctgagatcataccactagccttggtgacagagtgagaacccatctcaaaaaaaaaaagaaaaaaaaaaagagagaaagaaaagtaaaaaaagctaaaaaaataataataacttgagtttatcatgtttttctagtcattaacaattactgttttctttttcctgtcttcctcgggttacctgaacatttttttagaattccattttgacttatctatagtgttttttaaaaaacaatcttcagctttattggaatataattgacaaatagaaattgtatataattaaggtgttttgatatatgaatacattgtcaaataatcaccataatcaagctagttaacatatctatcacctcacatagttaccacttttttttatgtgtgatgagaacatgatttatagtgctttggagtgtatttctttgaatagctttttttagtgggtgctctaagtattacattttaagtttgtacatatatattcattagccaatatggaaatgcaaattaaaaccacaatgagatatcactacacatctgtcagaatggctaaaataaaaaatagtgacaacaacaaacactaggtaaggatgtaaaaaaacttggaccactcatacactgttgatggaaatgtaaaactacagccactctggaaaagtttggcagtttcttaaaaaactacacatgtaattaccgtatgacccagtaactgcactcctgggcacttaccccagaaaaataaagacttatattcttacaaaacctgcacataaatgcttacagaagctttatttgtaatagccaaaaactggaaacaacccagattcatacatccataccacaaatatcactcagcaagaaaaaaaggaactattgatatatgcaacaaccagaatgactctccagagtattacactgagtgaaaaaactaattccaaaaggctacatactgtacgcttccatttatataacattcttgatgaaacaaaaatatacaaatggaggacagattagcagttacagggctgagtggctgggggtgagaggaaagtgggtgtggctaagagaagggcaatatgagagatccttgtggtgctggaaatgctgctgactgtatcgatgttactcacctggtgatgatattatactacagttctgcaagattcatgggggaaactgggtaaagggtacacagggtctctctctgtattattccttaactgcatgtgaatctacaacgatctcaaaagatcatactggaagtgccatatggttttaaactggtcagtctgggctagcatcgaacacattcaaagtggacttttattcaagacttatcagttccaaataagaaactcttaatactatggatgttaagaactgaaaaataatgctgcttaaacatctgaaaaccaaccagtttcctcttagattacttctctttcattttaaaatctgaggaaaaacaaactaatcctatagtcttaccttgataaataatcctgttgactgctaaaacagtgagcctctgtagtctctgcgcaagttccgtttcagttgcttggctagggttctcttggctcattctccgttgcatcatcacatgaagctcatcatttgccactgaacgcattttcatcagaagcgattcagtttgagcaaggggaaattttcgaggacctttaaaagtatataaattaaaacatcaaatcccagtgttaataaggatcaaggaaactatttttgctgaaattttttgattaccagaccatgaaaacaaccttatttactacaaagtcaatttatagaaaggaaagagtgattaagagaaaatgatgcttctccctctttgaagaagtgcaacagtacttttggtttcaaagtcctaaataacaatgttgaagctagtgacacagcttagtaaaacagatgtcatttggcaaagttcgagttaaaaagtattaaatgggctcaaatagttcagaacattttgataaaatagtttcaaatactgtttcacttctttgtattccaaaatcaagttttaatgcacataattttttagtaagaatactactatttctgggtaattactgttgttgaatttcataaagtagttttaaaaactgtgtatagtgacaaagtagaaatcagtcaatgaaagtgaagagatcaggaaggtgaatataattccagtgatttgttattaaaatgatttaaaacatatgcatcatttggaattcaatgctacaaaagcatttcctgagaaaggtttcctcagactgaacagagaggagtggcattcctgcaccattactgcacctgctccaggaggtacaacacaggtagtgcatccaggagaaaactggggggatgagtcttgatttaatggaccgaaggagaagggcatcggaagttgaccataggaaccaaaatgatgtcttggtagatgaggaataatggaacccttcattggaattgaacctttgttttaaattatgaaaacatatatcaatttctataaataacctctacaaaaattacttacatatgactaaattataacaggttttaaagacttatcctgtaagatatttaaatattttaatgctattttagattgctcagtattttgggtaattagtattcttaatcagttaatgtattttgatagtcacttttgaggcaaaaaaaaaagaaaatacaaaaattcatatcctgtatatattcaagagttttactgtcaaacaatatacttagtttaagcagattcttcctaatgtctacatctgacagctttcatgctgtacgtgcagctgatgattgtaattcagcggtatgataatacactgaataaggaaatgttaagtaagtcttctttagtactaggtattaatactagaaaacgtgggagggtatttcagcactcctgctatgaagccacacagagctagtgtggccttaagcacatttctttctaaacctcagttttctcatgcataagatgtggattagaaagaaaacagagcttacttcaccggtagatatttatcactatctaacattatattaaatatatttgtttatatgcttattgatcattttccccagtacaagttccatgaagactgataaaatagcaactggtacatggttggtactcaagaaatatttgatgtttgagggctgaataaacggataaagaaagagttgttttgttgataaaataaaataatgaatataaaacataatgcctgtctcattctcacaaataataaaatacttttaatggttagtattattattggctgaaatataaagttcatttgtatgtgaattactaatttaactgtgtgtatgtgcgagtgcatggcaatttaaatatatgtctagcattctaaataatatcctaatgctgactacttctaccttcatgcattaagggtgatgtgtaaagtttttcatactaataagcagacaagtaaaaaaatacatttaaaagtatatattgctaccttatttataatagcaaaaaccaagcaaaaaaacctttgtttatctataaaagttacagaagattatccacatcaaaataatagattattttgtaatcattaaaaataaaagaatatttatgtttcttaatatggaaaaatatctataatgaccagaaatagaaatcaatttataaacagtaggtagagcatgataccatttaggtaaaattacatataaagatatgtatagatatagatatccagaccaaaaacagatatagaggttaaggagtcagagctttgttcactgggcagcaggcaacttggaactgctgagcagaagaatggtaaacctgaatgaggttgtaagattaatctgacaataaaatggtatctaactcctctagcaatgcaagaacttaaggtctagatgtaatgacggtactgctgaagaaactttggttccaagtcatggatatcctggggttcagggcttgagtaaatttgtctattatcagagtctggtgtgtggccataatgcaagctgcagctgctggcagtccccacaactcctgctgaaggtgaagggtagtggcagtggggctggaggtgtcactcatctcagtagttttcaacaaatgctaaatgaatctatttaggaatcccccctaccacacctaaacatttatcagtaaagagaacggcttgagtctttgaaggaacaattcattacctaattgatagacatgacagaaatagaaatccctctatgtccctttagtatcatggacaaatggacttgaattagtttttgtaaccacactgctcagaaacagaagagcttcagtattctgcagtttttgtacctgtagcatacaaagccaatatacttttgaagatacttttaagtaatagtggagaaataaaaagcacaatcttctccaagtatatgtgtaaaaaaacaacttagaaacaattagaaagcaacaaccgaacacatataaagtggtattttgcaaactagattcacaaagacagaatttcaataagggtagtacttaaaacaggaaggattcttgagagagacttcagagagagagagagatgggtcctaagagataccatagacctgggatgagtagatgtggtgcaggacacaaaggggtgagtataggggtgcatgtgccagcagtccccagttctaggatgcagtgggtcttaagatgaggaagctggactggatgacttttaaggtcttttattaagctaaaaacttgtaggattctgtaagtctcctatagcttgcagcaatcacatttacttagagtgaaaaagacaagtccaagtataataagcagctacagaagtcagaaaaaaggacagccatctagtgaaaagactaaaagttcattatctgttttaaaatgactcaaactaaaaaaaaataataaacttgaagttacgtagggctctaaggctcaaggtgacaaaatgctagtatctaaagagagagactaaagactgctagagaaatcattgaccaaatgggaaatagcaagaggactattgtgttagcccaggcacaaggtgataattaactaaaaccagagatctagagatggaagcagaggaggaacagatgtgagaatgagaagtatcaatacaaaagaaacagcaggggtagtaaaggtatactttctgatatcaagagagggcaaattccatctaagcagtcactgactacataaggagtcctgcaaaggaaaggtgtccagcaatcatgttttggcatgcaggaagctgagcactaatgctagaactgataaagaatctgtttctactcaggacaaaagagatgtacaactgggagggcagctcaagaagagacagtgcattcagatattaaataaggaagaatgtagagggcagtaagtttagttacatagatgttttagaagttttatttatataagtttgatttagcataatttaaacatactactgcaaaacaatgggtacttggtagcttttctttacaagtgagtttttcacatggtttaaaatttttgcatagcattgaacacagaagtagcttaacacgggtgaaagaaagatttgaacttaagtgaatttaagacagtaagagtgattaaatttcaaacaatttaccaaatactctggagatggtgtgtgtgtgtgcatgtgtacatgcatatttatccactatgtatatatatgtatgtgtgtatatcctgtgtatgtggtgttcatgttatctttctgggtaaagatgatagcagattttgtagaaaaaataaggaagactaacaatattaatgtttattatttgatgacattcttccttatttaatatctgaatgcactgtttcttctttagctgccctcccagttgtacatctcttttgtcctgagtagaaacagattctttatcagttctagcattaatgctcagcttcctgcatgccacaacatgattgctggacacctttctcagagacttccctaactcctgatgtagattgccctgttataatctctattcctaccctctacatttccctactattttacaatctctgcaggggcagaatctgtgtctgtttttttcatcattgtatctccaatatttagcacaatgctcagcacatggtaggcaggtgctcaagaaataactgaatgagaaaagcactaaaagtaaggagcagaatagtttccttcaggaaaaaatctttcttaaattttatgtaaaacaagaaatattttaaaagtgtgaatggcataagaacataggaaagtcaagctagcctcaatttatggttattaaaatatgatttcaatactcgccagcaatgcttttccgcttttgaactactgcatgatggggagcagaaggtgactggagtgaatctgtgaggttttcagagtcatgatttgcggtggtccttataaattccatagcagcctggagaactctaagctgtagtgcaacagccatatctaaaaacagaagatactagaatgttttcaagctatgtggttactaattttttaattgaactgattttatgtatcatgacaataatgttttgatataaatttttaaattttgatcagcatggggatgatggtagtagacatttttaaattcttgttaaaagcaattttaaagcaaatttacaaatggtcactaaaaaaccttcaatggaaaaatattagctcataaatttatttcattttaaaaattgtttcaaagaacaggctttttttctatataaggcaaaagtttaaccggcaattatcatattttttgtttcatattcactttaataattaccattaaagaaaactaaagggtattactatgcaacatacacttttaaattctacttggtaagaaaaatcagtgacatctttcacttatgtattgccaactactaactacatgggggaatcactttttctatttttgccactttttcaagcctttttaggcttctttttaaaaactgatagatactattacaaaattaatgttaaacttttagtaaaagagtttctaagaagaaagagattgtgctcaaataacaggtttgtctgttatacaactccctccccaaattcataaaaattaaatcttactttgtgtcctcttgtttttgctattttgaagatatccaagcattacaataaggtcttcaataaccctaaaatattgtgagcctgaggaactgcaagcatgaattgtaactgctatgaaaagttgctgtatatcacaagcaagcaatttatattcactcatgggaatgctaaagataacaacaaaagaagaaaacagaacatttataagaaaaagaacaaataatttaagacacagctaactgatttaaatggtttaaattcctgttcgaccagcttgcactcattcatgcagtcattcagtatttattcatgcttattctatggcaagtaatatgtagtatgtatgctagaaatagaaataagatacactttgacacctgtcagaaatacatagttttacagagaactggacaagtaaacagattactataaatagtaaatggttgtaagtgtaacactagagattaatacacgatactataagaacacataggcagtttctagtccacactaaggatgaagattgtgtgggtatgaacaggaacattctgcgaagacttttcagagaaggtgaatttgactaaattaattaacctctctgaatctcacttgtataaattagggttatttttaggactaaaagaggtaatagatttgcatttatattatttataaatatccaataaatatgaattagttacttctggtcttcaatcttaatcttgataatctacctcaatgtacgatattaggcctacaatgcttctctccatctgggttttccaaatcaagaaagggttagaaactaacttgggccagttaataaagtagcatacagggacattcagtaaatacaatttcttgctttttttttctttctttctgttattattatttttttacttttattttaggttcagaggtacacagaaaggcttcttacataggtaaactcatgtagtaaagtaaactaatactaaagttttcctgttctaaagtatttatcagatgtaattttaaataataattttaaacttacttcttttctaatccattcagggctgctactgtattacataacacatagagtagaccattatccagcaacatatctgctaccttagaacaagaatttaaaatttggagaagaagtaaaagagcattatgcaagagtatgttgtcatatagagaggtctctattagtcccagaataggaatgacagaccacttctgaaacaatcccatgtttctcacatcttccagatcaaatctataataaataatacagttaagagcacattagaaacaatcacaaaataagaaaatatgatagcaactatgggtcatcttgctaacttgattttgaagtcataaaaacaagttgggggagtaaggattcttaacctgtttttaaaatgacagagtccctccaataatagggtaaaagctgttgctagaagtccatcccaagataaatacacaaacattcaagtgaaatatgcatacaatttcttggttttaactgatttattttaattcatccatgagccctttatgtccaaagaaactatgtttgggggcttcaagtgcacaggaaaattattattattattttacatagtatttgagagacagtgagctagtaaaaagaggtctagcaaaagggaatgattctcgagttcttatcccaatacaacttgcctctgggatggaatgaaattagctaagtattttgtgcctcattttccttatctgtcaaaaatatgtggtgatatatgtcctcttttcttctcaaggctattgtgagaatcaaataaagtaatgcacaattgtttcgtgaaagccaaaagttgtatgtaaatgaaaagtagcattgaaactaccataacaatttagtaaattctttaaggtctgaatttgtctatcacaataaggagacacacgtttctctctattctatcataaacagaaattacagcttaatttctgccaaacttttggtttgggagaaaaatattcttttatttttacacttatttgctaatccatcagcattctaccagggtcaaaactcagcaatcagtgtatccaggaattctaggtgagggatttactcctctcccagatgacctgaaggctctgaggagagtaaggcgttcctatatggatcctttatgtaatctgtcactgagaatacatgagctatctttttttcttttcttttcttttttttttttttttttttgagatggagtttcactcttgttgcccaggctgaagtgcaattgtgcaatcctggctcactgtaacctctgccttctgggttcaagcggttctcctgcctcagcctctcaagcagatgggattacatgaatgtgccaccacgcccagcaaattttgtatttttagtacagacagtttcatcatgttggtcaggcttgaactcctgacctcaggtgatccacctgcctctgcctcccaaagtgttgggagtacaggcttgagccaccacgcccagcctcacctgtcttttcagttaatcttctcatgttaatactatctgccaaatcttagctatcactttcatctgatgcagcttttatttgtttctagtttctaactagtgaatgaactataaaggatgaagttatattagaaagaacatcatatggcaaataatacattgatttacctggaaaattacttttagcagattttttctaaaggtgaccaaaagatttcgttaagagtgagttcactaaattttacatttaagacaaaagaccttgccgggtgtggtggcccacacctataatcccaacactttgggaggccaaggcaggaggatggcttgaggtcaggagtttgagaccagcctgggaaacactgcaagacccatctccactaaaagtaaaaaaaattagccaagtgtggtggtgcgtgcctgtaatcttagctactcaagaggctgaggcaggaggatcccttgaatctaggagttcaaggctgcaatgagctgaggcatgactgtgtctctctgcactccagcctgggtgacagagtgagacattgtctcaaaaaaaaaaaaaaaaaaaaaaaaaaaagccaggcatagtggctcacacctgtaatccctgcactttgggaggccaaggcaggcagatcacgaggtcaggagtttgagaccagcctggccaacatggtgaaaccccatctctactaaagatacaaaaaactagccgggcatggtggtacgtgcctgtaatcccagctactcaggaggttgaggcaggagaatcgcttgaacctgggaggcggaagttgcagtgagccgagattgcaccattgcactccagcctgggcaacagggcgagactccgtctcaaaagaaaagaaaagaaaagaaaagaaaagaaaagaaaagaaaaaagacaaaagattcccaattatagtggagggaagaacacacttactcttcatcaaggccaatatgtcgaccaaagaacatttcgatgaagcattctaacaattcttgagttcctcgatgaagatacaactggttggctagcaaggaaaatccacgattcttcagaaatttatctttttgttccttagatgctctagcaaaatatgcatctaatagctaaacaaaaaatttaagtcaatttagataatgcattaaaattaaatataatatatacaaatcagtgtaacacaactgtatttgtaaattaagttcatatgtacagaagaacacagaaagcttaaaaaaatgccaccaccacagcaaagcagaaatgaatttgtctttggctactgtggaatgctaatgatgactccatcttggagatcttaatgtttctctcatggggaaactggcatttttagctgagcatggacacctggtagactggcagccttagttgagtataaatagaatatttgtacctaatgctgagagggaaaaaatccgtaaactatgctctctctgcaaatctatatctatatctatatctatatctatatctatatctatatctatatctatatctatatctgtatctatatctatcctagacctctacttctaggcttcttgacagattatttatcctgagcacaggcctgaatttccacccttctctagcatcttaaatgcaacacgtgtaataccaaattaatccttccacctctttctccccttcaatgactctcacagtagtgatagactcctttcccccagacacacatctatttattcccctactaaaaaagctttctaagtttacagcataacacaaaatatactttttccatgaatccttccgtttcccctatgctcaattctctattaatactgccactgcagtactcatcacagaatttcttacgttttacttagttaagtatgagactctcccttctagactgtgaaattcttgaatgtaggggcttatattatttccctttatatactatattgcaactagctcagggacttacacatgaaatgcgagctcaatactaggttgtattgcaagtgattaaacaatacctacatccaagcaaactaaagaaaaatgagaatctttacaagattattttaatattgggttgttttctaatggaaactattcatatcaagcatttactcattcaataatatacttagtacctattacacaagatgcccaccctcatggagcttatatttgtgagaaatttaaaaaacaagtacacagattaataagataattacaagacataaataggatgctatgatagaataaataataagtaagattagagggaagttattttgataagatcatcagggaaggtctttttgaaaaggtgtcatctaagctgagagctgaagtaaatgtctaaaatttgatagtacactgaagaagagatttccaatgaaccacgtattccttgtaatttttacaaaagagatttactaagtgttcagatatggggatttattggtagatttaaaagacatattgatatgaaccaacatatggagggggacttaaagctggatgatgcaaaaatatgaccatgtaaccaaaaacccctgtatccctaaagctatcaaaataaaaaaagtttaaaaatatatgagtattaagtaacaaactatattagttcattattctaaaatataaaagagagatttaggtctactttaatgtatatactcaaaattttaaattacatatatatttatttttctgaattaaaataacatatctagtatttgcccttactttaataacaccttgttgtatagctggtgatgggtggttaacgaggaccaaaagtgtatctgcttgaataagcttgtccatcacatcttcaagcaaaacatcaggcaggataagaagaaccccacttaggagttcatataatccacagcatataggtaccaaacagtcttcagttacactaaaacagagaccaaaaaagtcttactaacatgacaagaaaagtacttgatgattaccttaggaactgtgacaagtagtagcattttttaacaggtgaaacaaatgttcataatgcttaagaaatgtttcctaatttaactgtgattaacaaatttaccatcactttttatcattgatttttttgggcatatagtctactaacactattcaattgtacatctctgatgtctaatacagtagtcactgtcacttatgctatttatttaaactaaaaattcagttcctcagttgcatcagccacatttcaagtgctcagtaggcatatgtggctagtgctgactgtattagacagcatgaataaaacatgtccatcattgcagaaagtttcactggacattgctacttgagatgctattggaaatgttttttttttttttttcaccaaggaagaaacagctttattaggagtctaggcatgtcagaaaaacccagttcactcacagagaagagaggcaaatattggtacaggggaagaatctagcattacagaatatcctctcaagaaccaagtgtgaaaataaaacctccatctaaatatcctaacaaatgctgctgggtttagcccaggtgaaacttctggaagctcctggtgaaaggagatttttttcataaaaggaatgctctctagcactgctgcatttcagctccatataaagttatgggtctgcgatagcagaagtagaggaaaatataagggggatatctcatcaccaaagcaaggtcatctgtgtccaggtgacagaggaaccttaagtttctggagagagaacaaactggggtagcagaaggaaaatggctgaagaaatacaacgcctaggcaatgtctgtcataacatggaggactctgtgcagtctggtgacagcctgtcctgggaaacactggtattgctttctgaggccattttagctttcttctgacttcatccagagaagaactgccaatgttcagcactaagacctgcattataattacctgagtggaatggagcagccaccctatgacacctgttcctcttcccttctggagccgtcacttgtctctgatcaagtaagatgttactcaggacaggcccagtctagaaatcactcccaccttcacatgagcaccaagtggacagaatcattctcatgagtcaaagctctagataaatcctatcgtttctctgtcctgaagaattttccttaataactataaggaattaaaccacaatatatattttttaagtgctacttatggtttagattttggttaaatatggaattcaatattatctagtcttaaaataaggaaaaatatatctttctgtttgttattattatgtatataaagaaataaacttttctgtttgttgtattataagtggcataatgaagacgtttccagaggggtagagagtctttaaagaatagtaaaataaaggtgggaggagtgtacaaaaacacataagtacctgtgagcacttgcagttcggttgtaatttggctcataaccaagagaataggcaaagttttcccaatcatcagtgtttctatcaacaagacttggccaacggccaacagctgcagatccgttctgtgaaggaaaagctagcccaaggcttgcaatagtgctgtggcttcgctggaaggaggccaatccctttaggtaatcaggtcggcgtgggcaggactcatccccaggactgtcatcttctgacctgggttctgctcccaactgtttatgatctgctttgaccactggaaatcccagcactccctttgggacatcactgacagagacctgggctgagaggacagcttccatttcacaaacagtttttgcagactcacagctactgatgaatgcgtcctctttgccttttttcagtgtgtcggaactccccaaagaattttgtttctttgattgggtggcaacataagtatctgcaatattttgtaacctgtcgatactacaacccaaacttccagtcagtttttgtgattgcgttagtagtgaagaagtagggaatgctggtaggcttctagaacgcagcatatgggcggccatctgttgtggaataatattagaggaattctctcctggtaagagtagatacaaaaatactacttaaaaatctattaagtggaaccacctctcttttgcattataaatcacaaccacagcaaaagcccatttatctagcactgttaaaatccatataggttaattttacaagtaactaatgcttaaaattcctttactttttcttaagagacagggtcttgctctcttacctactgaagtgcagtgacacaatcacagcttactgcagcctctaactcctggactcaagacagcctcccacctcagactccaagcagctgggactataggcatgcaccccacacctggcttaatgcttaaaattcttaaatgccaaaactatttttattttaaccactttttattaatatcttcccaaaacatatgttttttcctgtcttcttaacaaaatacagtattgactgaatgattcaaagtcattaggattaatggttctactgtgctgaatttaagtgaattaagtgaaactcaatttacctcaggctagcagttaccaggatgtagtggaaagagtgtgggctttgcaactagatataattggattcaaatgatagtgaagtggtccaaggtaaatcacttaattgtactacagtttctacaaatgtaaaatgagggttcagaatatctactttgcagggtggctttaaagattgagattatatttgtgatgcacctagcatagagctcaacatataacaggtgctcaaaaaatggtagtacttgttgttactagcctaaacagccctagacagttctctctctcctccatttttgcagtcacttcttgctgttattagtgagaatagtttcttttcttgtcacagctctctaatttactgcttctaatattctatgcaggaagacaccagaaaaattattttcattgtagtgcatgggatacaagtgcatgccattcaaggtgtggtctgtggactggtagcatgggcatcaataccacctgtgggattgttgggacttcacattctcaggctccaccctagatctactgatacagaatgtatgagagaggggcccaggaatcagtgtcaacagctctccaggtgattcttttgcaggttaaaatttgagaccatgaacacagagtaaacaggcattaaatgaactgctttagagcatagactctgtggcaataaaatagctccatagctcagaatctttttctagttatttctggatttgggctagagggctaaagttgccaaaagattctcttcaaaagatctggaaaaaatgggggtatgattgtatttgaaaatgtttcaacatgacagatgatttaaaaaacaaatatgtcctgtaaaattccaaataaaactaattcaaaaaggccaggtgcagtggcttgagcctgtaatctcagcactttgggaggcagaggtgggtggctcacttgagcccaagagttcaagaccagcctgggcaaaaaggcaaaaccctatctcatttatttaaaaaaaattttttttaaaaagaaaaggaaaactaataaaaacatagccttaaaatattattataaaagagcataaaaagtgctagagaataactgaaacactttggcaggaaaacaaaactagagactaatacctatatatctagttctatctatctctattaccatctcacctgcagtatttaataattaggattgaagctaaagacaagactaggttggactgacaataagagcaatgtcccagtatggaaaaggacagtagtcaggaaaggaaaagatgtatggtcagtttgcaactagaaaacctgcacctattcttttcttctataaagtagcgatgagactctgttaagagtcaattaggaagatagaaaagtactgtaggcttaaagacttgaatacacttactatggaaatagaagagggtattgattctgaacatacctaaaaattacagggcagcctttaaagctctgctacaactttcagcagtatgacaatggttagactgaggcgaggttagcatttttcagttcaagaataccaataggctaaggggacaaggaaactgagatactttccaactgagtaactgctgaagttattggctaatgtgacctaggctggatagggaaagcgagacaaggggaactttggagtgtgattaaaaaaaaaacaaaaaaaaaccagaaagatgggaggctgtcaattagagaggatgaatgcatcccctttgccttttttcagcatgtcagaactcccccaaaggattctgtttctctggttggctggagggctaatgatacagaaagattctgttcaaatgagaacacgtggacacaggaaggggaacatcacacaccagggcctgttgtcgggtggggggaggggggagggatagcattaggagatatgcctaatgctaaatgacgagttaatgggtgcagcacaccaacatggcatatgtatacatatgtaacaaaccggcacattgtgcacatgtatcctaaaacttaaagtgtaattataaaaaaaaaagattctgttcaaaagacttggaaaagaaatggagccatgattgtacagtatttgaaaatgtttcagagtgatgcatgtgattgaaaaacagatcatatggatagaacaaagcgggatattgtagtttcacaggtgcttgaaagcattcttgatgatgataaagtccaagacagatgcatgcagagcggtaagacaaagtagagaaaaggtaccctgagtcaaaaaatgtgaagctggagtattgggtggccatttatctggcaagtgaagttgtccagaatgatggttttaggtagacagaagagaataaaagtttttaaaaagcttctgaagaaaatggtaaaataaatcagaagcttgatgaaagacaaatgactatgataagagaagtcagagaatgccagaacaagatagcatgagcctcatccattttctcaatgctcttgaggacctgtgctgggtgtctcttgttagattgaatgaggttgtactacatatacttctaaaatatgtacaatttaattatctaagaatattcagaactaaaatgagaaggtcatacttccattattgctatttttaccttcatatggtgaagcagtaaaaccagatgggcttattaccataaatccagggctcataagggaccttcctccactgctggaatgcctcaggtacatgattgaccgcactttctcctgaaagatcttgccatctagaatccaaattttttttgaaacagcaaaatttttaaaaaggataaaacgaaaatataactttaaaagcagatcattaaattcaaattttgacaaaaagatgtttaaagagaaaaatatatagcatactttatattaaggcacacgatatgtgaatacttactcttcacaattttttagtacagattttgctgttgtttattatttctggccacattaacttctattttcttaattccaactgtacttatagttatttctatggtttaacatttaactattcacttttatatgttattatcatctctcaagggagattgttcatccttgaggaaaggactgtgtcttttatttttatatatccccttcagtgtctaatatttgtaaaaactaatcatttctgagcttcatacttataaattcaactgcttggtttcttaaacaaatcacaaatgcaacaaatctaaatccgaatcatctttttgccctaaatttactccttctgttttgttctttgggaagttcccatgtggtaacctggagctacccttgaccactacctttcctttatccatggcaaatcagtcaccaggttctactgactttttccctttttttgagacagtcttgctctgtcgcccaggctggagtatggtggtgtgatctttgctcactgcaacctctgcctccctggttcaagcaattctcatgcctcagcctcccgagtagctgggattacaggcatgtgccaccacgcccagcaactttttttttcttttttttttaaggagagacgaggtttcgctatgttgaccaggctggagttgaactcctggcctcaagtgatccacccaccttggcctctcaaagtgctgggattacagcatgaaccaccatgcctagcatgacttcattttttgtttcttgacctcttctcttccctaccatagtgctataatgcaggctttatcatctctcaactgggttactatcacagatttctaaatggtatccttgatgagcatctcattactctcaaatcctcacagctaccagaattcgctctctctcgaatgtcaactcctgcttaaaaccttccagtggctttctatgcctccttaccaccttggataaaacccaagcttcttgtccacaagaattaccactatttgtccctaggtccctcccaagccttgtttcataaattacatttcagcaacaccactttctcctagttccctgtcaagctgtttcctttacctggaaggcccttttctctttgattcttactcatcctttaagattcagggcaggcatcacttcctctgggaaatccccctcagtcttcatatgctctatgctaccagaaaacaaaaatgttgactgccttatcactgtgctttccacgtggcatgatataatcgtttctttatcctctttccctcaactaggctgtaaacgtcttaagagaggggaccatattttacccatctttgtaactaacccactctcagaatctttatccacagtcctttttccatgaaatgtgctaagcctaccacaaagtcatgctatctaatttcatttggacatttactgctgcttattttattcatttactacatttctttttttttcttttctttttttttttttttttttttgagatggaggtttgctcttgtcacccaggctggagtgcaatggcacattctcacctaactgcaaccaccgcttcccgggttcaagccattctcctgcctcagcctcccaagtagctgggattacaggcatgtgccaccatgccaggctaattttttttttatttttagtagagatggggttttgccatgttggtcaggcaggtcttgaactcctgacctcaggtaatctgcctgccccggcttcccaaagtgctgggattacaggcgtgagccaccgtgcctggccccatttactacatctcttaaaatggctattgtacaaccagttttccaatgtaaatttatgactcagctttcttgtaggtacattcttgctttctttcttacattacatttccctggttcttaaaaaaaactgattattccatctttctcttttactgattcttcattcttgtcctaccctccaactagtaatactaccagcagttctttccttagctttctctttccttctcttgctctacttttcttcagtggtctcatctgttctcagagcttcacctcacttctatgtggacagctccttataacctacccttccttcttcatgctgtaaccctcattcccaattgcctactagaaaattatattataaataactgcagggcacctcaaatacaacatatattatacaaccaaagccattatcctttttccttaacacctccagagtcattccatcctaaacttcccacttctcaatttatccctcctttccagttccactgttactatgcccagattctgttatcctgtctctcacggactactataattggccttactgcccctagttccttattcctgaattctactgcaataatttacttatagcctttgctcaaaacaaacaaataaaaccctttcaatgacctataactagaatacaagttcgaattctctggccttacattcaaggacccatttgatatgactttagggtaaaaataagtaaatggtggtcttaaactgtatttatggcattatttctcactattcctttacagatcccctatatataggtaaaactcattagtccttattttctatttccttttatcctccctttaaagtcattgtctttacctggaacactaactctccaatctacctatcaaattctactcaaaatcttcaatgtctacatcagatgtcatgtaacctattaaatattctctccacagtggtcggatgaaaccctctgtccactgaaatctcattagttcttcttttgtgtctctttgatacttaccaaatacacattttttttttttactgtagttatttgagtctatgtctcctttctccacttggcatttagactccttgaggacagaggccatgtctagttcattctataactctctgccctatcccaaccccaatatgtaattagagcagcacagaggccattcaaatgtcaaacaaatgtgaatcaagtgggaagaataaaacaaaagtggaaatagccatgatctaacaaaaatgattatacctacctatgtgcaaagaaaagtagaagttcgtgggattgtgacaaacgtaagtattagtaggagggtgaactgctaaaaggaaattgaagataattgtcaataattccaaatctggaggagatccaaggacttctgctataattttcacaaatgatctacaaacctctcggggcatgggtgtgagttgcccctctttgtattcctgaaaaaataaaaaaaactctctttagatttaaagaattgtcaacttaactaagatttttcatttaggcaaaatattctttttaagatagaattctgttggtttactactctagtctgatcatacttaccattaccataacaactcattaaattgagttatttcctaattcaagcaatcttgttattaaaaattcattaacacagatggcaacttaattctagcccatgtatcttaattaactgaggcaaacttatataactctcacaagcgtggtctcaaaagccagacttcctaggtttgcattctggtttctccactcactagccatgtgatcttaggtaagttacttaacatctgcatgcttcactttctttgtctatgtgagtaatactagtgctactttatagggttgttataaggactaaataacataaactcttagaatagtgccttgcatataggtaagccccatataaatgttagtgataaactacaatcactactattactactgctactatcttttcttctccttttactactactactattagtaatattagtataggattaggacagaaaacttttgatggacaaaactcgttatactaatacaatatgctccagtttacaaagctttttttcacaacagctctatgagaggttttagccctcatttctagaatatgaggcacaaagaggttatttgactagtgtaaaccacacataaaatatgtaggtagtacaattataactcaaactcaggcctctgaactctttctactgcaccatttactgtctggaataatgaggcttggcaaaatgccaactaattactaaaaataaagctgtatataaataaattgcttatatcctccaattccatctccccagtgggtagcagctggcctccagattaagggtatgggaggtaaaattcctcatcttccctcttcatatgtccaaatatatatctctacatccactcttcatttactcttgggtattactgaattggagtacttaaaatgtagatgttaattttgaaacaatttagttcgactacctcagatttaagaagggaacactgagtctacagaagaaaacacaaaactcctttgccaagttctcatagctgtcaagtggcaaagactaagacaggaacatagatctcccgacttccaattcagaactatttctgctacaaccatctgcatttcttctaaaccatactccatgtatcttcttaactttcttggttgcagcatcagtgattcattcccaagtccagcccaggttacttctatcttgccctctccactgactctttatcaatagtcactggtattctattttattatttttttaatcccttaactttaccttatatgaacattctgtttctgtctttgcttttgctgctggactttttaataatcatttgttctcactgccttcaatgatctgccacacatgctgtccaaagtccctgaaatctggctcttgccttatccatgctattgaaatcttgtaagtcattaagaatttctgagtcaatggccctttatctgcctacattttctctgaactttctatatcatttggttcaaggtatcatcttcttctctacatgttcttccccctctgccgacctctggctttcactttactgagtctcctcttagcttttcaattactctttctgtatctctttcaatagcccctttttctggtttcacatcctgaaaatgggtatctcctgaggtgtaaacctcagtcctctgattctctcactacgtttctctgtcttggagtgcttctctatcctgatggcttcactattaccagttcactgttgctgaatatcctgctgtaatttcaaatgtagatacaaaaactacaaaacttacaaggttgcttttttttcttatgaaattattgtttttctggtctcccggcttgaaattttatgttatatttgactcctcctgaagctccatttaaaaagaatcaagtcctatgaattctatccttataatctctcccatatttgctccctactaaacactcccattttaatcaccagggttcaggttctttatgctgtactcacaaatgaatgaaactgccttacatccaatatactaccaatttattaatcttcctaaagtgcacaaacactctgaggtaacttaaaggcaaagactaagttcatttctttataaacttcccacaatacctgacataaagctatgtttaataaatggctgttaatttgataagtgggctctttgaacaaacaagggtaaagaactatacatgtaaagaaaaaaatttgtacctagattttttctagcatttttgtaaataatacaaaagtgaaaaaatatatggaaatctcaaagtttataagtgccacttttctgacatgcaaagactgaataagaatatcacattgtcatatgaacttaatgaaaattggccaatatatttcaaaatggacatgcgaaggaaaaaattttgaggaaaactgatgtataaatgatgcataaaacactcagtaagcaaggggcctgaaggatcaatcgacatattctattccctacaacaatagtctaatttaccacaggggccaagaaaggcaataaaatgtttttgtgtttttggaattcattcatttaacaaatatttatcagatgcccaggtgtgtcaagtactgacattacagtgtgatttaaaacaaaacaaaacaaaaaccatatccctgctttcaggaggcttacagagggaaataaaccataattccataaataactaacaaactgtatgtacatagtgtataaagggaaaaagactaatttatatggaaagggcagggaaggtatctctcaggaagtaagtcttaagttgccacgtggaggataagtaggagttggccagatgaaaagaatgggatcaataattgttaaagcaaaaagaataccatgtactctgagacagaaaaaagtcttacttgtttaaggaagggaaagaaatccagggaggctgagtaccataagatgaagctagaatggtagccagatcatataagccttctcatattaacacttcttacagatgttgtcacagattttgaattttagcccaactataatgaaaagcccttagtgccaccgaagcaaaggcgctcaaaatataaaatattactgatctcatggagtatctgtacttatctaacttgacaaagttctaatcgatgccttagacattaaaaaaaacttggaaaattgtctaatataccaaccaagcagatatttatcaatgccttttatctgtttggttggtattagatgatatcaataaaggcagagaaaaaaattaactaaaagggccacagcatagacattacaatgtaactgatacaattagtgtcactttttaataaaaattttggatacagtttaaaatgctaattctagcatataaaatagaccgttagcaagtttatatttattaaagcaatacatatttgtaaatatttatttaaggaatatggaacaagttaaaattcattaactattcttgctgttcaaggcagtacaaaactattattctatcccaacataaagaaacatctaagaaatttagtaattgtacttttgtaattgagttaggaattatgacagcgtgatgatcaagctgtaagatgcagcagttgaaaaactcctgtactattttttgaaagaagagaatctggagagaagatggaaaaaaaaaagaaaaaaagtcccattgaaagtgccacaaaaatttgatgttcatagtattattaaacaactgtggaatatatttccaaaagtaaagttacatgaaaagtacctgcaaaacctgacaagtcagtagaaagtgatgaaccacttgagctttcaataactgcttaatattaaacatctgctggtggtgatctgctctgatgaggacttctagagctgctagcaaagtttcccaaacaccttgctgaagagataaacacacaccaataagcacatacttactgaaaaatatgcagcatgctttttggaagacacacaacgcgcaacaatttaacattgtgtatatattcagtatcaaagattacatgtctgcaaaaagccaatgttaaaatttattccctattattttttgttgccaataggctatttctaaatagctatgttgaatacaatattgtattaggtgctttcctacattaccctttctgtggcattaaatgtattttcaaaagatgaattatcaagagggattattcaaattagagaagcacacacattaccaacattattgtttttaaataatttatgttcaaagagtgttgttaaaaatgtacacatttcaataccaatctgcatatgcagcatttaaccaaaaaattttagagcaaatcatactaaattgaagagtcatggataatgtgaaaattctgcaattttagattaatttactttcaagttcaaataatagaattatctgcatgattacaaactatgcacttcaaagagtagttagcatcccttgacagtgccttaaaatgcttctcccatattgaatcaatcttaacttgtccataatactagagaaaaaaagagatcttacactgataactaatattgaaagataaccttcccttcatcttattatcctaattgacctttcaataaagcttttaacaaaaagcaaaattaactggcttgggttgcagagcctatttctcctgccattatctggcaataatgaaccaagatattgatagacttaatcatactcttctacccagggtctctctctttataagatagagccaagatattctaaaagacaaagccacacgaaaaccagcagacaaggcagccaaagtatgaaaacatgattcaaatctgaaaagtagtaccaagataaaatagtgccaatgtaaacaaacaaataccaacaaaaaaagaaaaacgagacttagttcaaatataattaattacgtaagaaaatcttatttcaaatccatagaagtaatatgtgtcttatcactttcaaattcaatttaaaaatgtttcttttaaaatcaaacaaccccaaatttgcctgctcttttgaagtactaaataaactttgtccaactttgtccaagttaggttttccaacctgcaactgagcatattctttattatacatttatactgcttttgatccaatttgtttacatatgctatccctgtaattatttgctttctccctgcaatattacacatattttaatctatcttatcttttttttttagatctgaaagtatatatttattcagagtgagaaaaggcatcacaaccaattacaaagtttaaaaaactgaaaagtaccatgaataccacaaaatccagaaacatggcaatagttagttggctgttggacatgcctttcaaaatacttttctctgttttgtggctgcatactcttgaattgcctcttcatgtaacaacaattttgtaatataattttctataggaagaatagaaaattctctttcctctagcatatttgaactaaacttatttttattactaatagattagaaaaggttttttagtttgtttttttttttttttttttttttggccaggcatggggggctcacgcctgtatcccagcactttgggaggccaaggcgggaggactgcttgagcccaggagtttgagaccagcctgggcaatatagtgagacttcatctctacaaaaaaaaattaaaaattatccaagcatggtggtgcacacatgtagtcctagctacttgggaggctgaggtaggaggaccacttgaacctgagaggcagaggttgcagggagccaagatggtgccactgcattttagcctgggtgacagagtgtgctcctgtttcaaaaaacaaaaggagtcttttttcaacctcataactcattactggtaatgtgtaaatttttagggactgttggcaagttgggaataaccattttaaaaaaattctaaaggtatatatattctgaattgctctataaataatatttgttgataatcttgttatattctaattagttctagacaatctagttttttttttgcaaaaatcatcagtacctactagaaccctgccacacttagagcaaacagtctacactagaactaagaaggctgtatgagcctatactattaagattgcttaaaactagggcagaaaggaaacaaccctatactcattccctgactgggtccttgtgaagacaagcccagccattccaggtgctgagatgtagtgcctacatctaagatcaatctatgttgcttaatttgtacttacgatgaagccttgccctatataccatggtcctatctctaactcctggccagcatggctcccctagttagaagtgtatccatttccctctcctggacctgactcccctgactcttagcagtctcccctttcagagtttatggtaaatgcaagccttcagctgatccagataagcccatatgctcctgcctgactgcagtattcttagccagcccaagtttgattttgactctccagctcagcattccccatggctgttcaaaactttgcatgggaaataagtgccagatttccatttataattaacattacaatgaagtaataaattaattatttctttcagaagaatgattagataaatatttaaaagaatatgctggctgggggtggtggctcatgcctataatcccagcatcttgggaagccgaggcaggcagatcacttgagctcaggagttcaagaccagcctgagcaacatgtgtgaaaccctgtctacacccaaaatactaaaacttagccaggcatggtggcacacatctgtggtcccagctacttgggaggctgaggtaggagtatcatctgagcctgggggtggaggttgcagtgagccaagatcacgccactgcactccagcctgggcaaaagagtaaaactccatttcaaaaaaaaaacaaaaacaaaagcaaacaaacaaaaaaacgagtatatgcttctattcacggtagctaaaatgtggaaacaatccaagtgtctctaaactgatgaatggataagcaaaatgtgataaatatatagaacggaatattattcattcttaaaaaggaaatttggacatatgctacaacacagatgagccttgaagacattaagctaagtgaaataagctaatcacaaaaagacaaatactatacgatcctacttatatgagatccttagattagtcaaaagtagaatggtggtttccaggggctagagaaagagggagaacatttgtttaaagggtacaaagttttggttttacaaaacaaaaaagatttacagagatggatggtggtgatggttggacaacactgtaaatgcacttaatgccactgaactgaaacttaaaaatgcttaagatggtaaattttgtgttatatgcattttaccacaataaaaaatggaaaaaaagtacatattacatgcctctgctttactccatatcttccagtcaagcaatagttcctctaacagcttaacatcttggattatagcattagagtctacatccaacttaaactctccattctcattcatataaataatatcttcaccacagcatccttcaagaagggtctatagaaaattagcattaatataagatgcattagtaattggttaatcaggaagttcaacagaaacattaagctttcaattttagcaatcattaaattcaaaggaaagctagtaaataatttaacacttcacaaagtatctttaacttgttttgtaaaacaattcagataagtagaaaatcccaaacttacaaatatttttaagtgagtactcaggttcaaacaaggggtgaaaacaaacagcactcaatttttatgttttaaattgaattaatctgctattaggctttaaaacgttttcaaaaaagtagtaaggattcatgccacaaatgtatggatcttgcagtttaaagaagtaggggtggaggcaagggtagagcaatcgtcttttgccttagtaccagaagtctcagagagaaatatttccacaatgttaccaaatgctttcatctagaaatgtatttaaatatatgatgatagcgggatcataataaaaatgagcacgaatatctgtgacttgaaaaactaactctgtagcagcagtgcctaatggaatggtatgcctctaggtgcctagagaactgggttctctgccataagggtgggagctaaagcaaagatctcatcaatctacagaatgaagggacagcatgggagatatctatggcccacccaggtctaaaattcaatgagtttctttctttcttacttttaaaaaatgctttaaagaaaagaaaaatgtaattatttaaatgatgaaaagaactagaagagtatcttagtttgattaactatacactaataagtttcctccattttcttcaggaataactgaaatacaaaactattattggaagactttgatgacgagatgagtatcactgcatatgaaactataagaataaattttatgaagacataccttcaaaatgtaaaacccaacaatgcatttttgtttgatcaacacctgatgaatcatagaaagtccattacaattttctaattcatgtactctttgttggttgtatttaattaatgagagtataactcgcagtgctaatgcttgagtttcttcacagctactgagttcaacaacctaaaaaaaaaaatgggtggatatagttttctcccaatttgctgagagtaaaaatttaacatgtataatcttccattctgtaacatcaatccattagtttctacaaagtatttttttaatgctcatactctacctatgtaaggcttgtgaataaacaaaactgagagtaaggcataaactccatgttctatagtctcttatatatactatagtatacaatgacacacaaccttagtggccagtagcattttataactagtgatctgaagtgtcataagtttttgataagttagtcaatagacaggctctgcattatgtggtaagggagataaaaagaagtaaaatacatgatacttgttcccaatggggtctactgtcctgtcaaagagataagatgtatctataaaaaccacatgtcctgccttgtatgtcaatttacttcaaccaacactttctgacaactactatatacataagaaacacacacttattatcatgctaaaggccaaagaagaatgagacaataggtattctggagagcacagagaccattctgatccctctctgcttggtttaagggaaggctacacagagagaagatggcctaggaagagagccaaatcctggaaagcaggaataaaggggtggctaaggcagggcacagccaggggaagggtaaaggcctaaactggaagttcacagtacatctaggaagctgcaggttgcctctttggctggattgtagagaccaggttcacaaggcaggttatgcatgtaaggattttaaggacactgaattttatttttgtaggggaggaggaaggatactgaacaaggtttataagttttagacttaaaaacatactttaaaagtcttattggcaagatactaaacatataaagataaaaatgtaaacattttatctaagatccaatctctatgtaacaataacaaaattatattcaataccttgatgaaagagaagaaaacaaggatatacattttgaaactatacgatggtacaaaatatcacaaaatattggtgaggagttaaagggcttttaattttaaaacactaggagataatctatttaactagacactagattaaaaaaactatgaaaaaggaagaggtggagaagaaaagacagattacagagtatggtggatcaaatgctaacaaaatatttgtaagaaccctaacaacaacaaacgctgatatgcttcttattgcaaaattaatcaacgatgcttccattaaagaaagttagatagggagactatgaaaacttgataatgttgcaaaagttatacttagggataaaacgaagatggcattccgaggatgaaggaagatcaaagctgctttaattaaacagggatgtggatccagaggaagtagaaatgatttttactaaagtgagactgttggtgctccctaacataggtttcagcaatccctgaaatagtctataattactgactgtctactttgcatcaggacagataattaaatgactcattcgaaaatggtacttatggcctgagtcaaactttatatgtctcttttttgaaaaaactccaaacccaaacaaattaaagtttttttttttttaaagtattttttgacccttagttttttcctatgcattggaaacatttaaggaataaaaacttcataaattttatttttaaaaatatcctcctctcaatttaaaatcttgtacatttaacatttaattgtactaattacatttttggttaatagaaaacttctaaaatattcataaattagaagaaaccttaatcatctatggcagaaagcttaataacattttaatatgtaatttttttatgttaaaagtttaatatagtcgagtgtagctttttcgtgtggtccaaaagaaatcctttaatttatcaataataagtaagtcatttctctttagacaaaactataagcagtgattcttaccctggcaaagagaaaaacaaatatgccagttccaccaatttcgtgcagaatgccttgaatagttttatattcagtaggttggagattctttagatgatgaggttctaataagatgctctgaacttcttttgagctgaagggtctttgagagagttgggttttcatttgacctttaagtctaatcactggttcatagatggtatactgagcaggacagtaagttgtataaacaactgaaagactttcctgaaatacaaatattttcattcagtaatgacaacaagtttaaaatgcaagctatgaactagcaagtaagtatttcaaagtgaaaacacactcaactgatccttttctttgtttaaaaaacaacagctactacactaaacagataaacattagaagcaaggctgtttcccacaaagcaaatggtcagtgatttatttagcagtgatcaattgtatagatcacatcaaggttgagaaggattccagctttgttcggtttagaatatatattaagttatactattactactaatatcaactaagtcttaaaccacacttattacataccaggcactattctaagcacttaaaaatattgggaactctgggtcaggtcaatttatttgaaatttttgctttgcatttgctcattggctgactcttcatttaaaagcaactctaaactagatctttctactggaataaaattccagattgtcaacagtcagcacacctaactaaaataaaatagaacttcaaatatttctcccaggcaaaggatagtttccatcagtgtgtggctccctgtcaagattctctaaactattttaaaaattaaagttaattttaaatacagaatgcatgtttttcttagagacagtgtcttgctctggcacccaggctggagtgcagtggcatgaccatagctcaccgtagccttgaactcctaggctcaagggatcctcccacctcagcctcccaagcagctaggactacaggcacctgccaccacacccagttaacccagttaaatatatatatatatatatatatatttttgtagagacatggtcttgttatgttgcccaggctagtctcaaacccttgacctaaagtgatcctcctgcctgtgcctcccagagtgctgggattataggcatgaatcttggtgtctggcccataatgtactttaaggtggttttaatggtagtagatgccaaacccaggcttagggaaatcatatagattcagtgtcttctctcagaactggatgggggccttgtgcttagattattcttattatttatttatttatttatttttccgagacggagtcttgctctgttgcccaggctggagtacagtggcgtgatctcagctcactgcaacctctgcctcccgggttcaagcaattctcctgcttcggcctcctgagtagctggaattacaggtgcatgccaccacgcccagctaattttatatttttagtagagacagggtttcaccatgttggccaggctggtctcgaactggctggtcttgaacttctgacctcgtgatctgcccgcctcagcctcccaaagtgctgggattacaagcatgagccaccgtgcctggcctgtgctttatttatgacccacagcaatcagacataccacccagcgtatctgtgcaccagctaaaccaattatactgtctgttgtgtatgattatgctggaaaagcaaagtttcaaacctgcagtagtttcaatcagaaatctgacgttgcaccctgacatgagggtaccatttcttgtcttttttctttttttttttgagacagagtttgactcttgttgcccaggctggagtgcaatggcgcattctcggctctctgcaatctccgcctcctaggttcaagcgattctcctgcctcagcctcctgagtagctgggattacaggcatctgccaccatgcctggctagtttttgtatttttagtagagacagggtttcaccatgttggccaggctggtctcaaactcctgacctcaggtgatccacccgcctcggcctcccaaagtgctgggattacaggcatgagccaccgtgcctggccgagggtaccacttctccctaaccattgtttcacaagcttataactcccaaattactaaatcgggcttaaacaatttgctctctaaaaatagttttcacataaaaccctcagaattttcattcatgataatttatgttgagttttgtaacttatatgacctatataccgttcaggaaaaataaaaggattagggaaatttttctatgaaaacaaatggattaaccaaaaactattgagttaaagttattacttgaacaaacatctgtgtgagctcctcagtctccctaaggcagaggttctcaaagtgtgatcctcaaccagcatcagcatcacctaggaacttcttaaaaatgtaaattccagggtcacacttcagacctactgaatcagaagctctggcccagcaatctatattttaacaagccctctggatgattctggtgcacactcaggtttgaggaaccatttccctaaaggatgttttcttaatggtgggacatttaggataggatcattctttgttgtataatagtgttcatgtactgtagaacatttagcatcactggcccttactacccaataattattgacaaccaaatctaccctccccgcaactcaacaacaacaacaacaccacaaacaacaaaatacattccaaaacagtagtctccttcaagtaagaaatatctgtacttctcataagaagcaagagaaagaggaacccagtttcatggccagatctactagattttagtagattttctaagactatttatgaaggctcagttttctagttgctataacgaaaaatcctcaccactagctcctacattatatactggtagaacaaaatattggaataatatataaaaatcaatagagtctcatataagcagaattagcaatactttgaaagcaaaattcctaattttactgatattaaataataagttttttaggccaggcatggtggctcatgcctgtaatctcaccatttgggaggctgagacgggaagatcgcttgaggccaggagtttgagactagtctgggcaacaaagcgagattccatctctacaaaaatttaaaattagcccggtgtggtgatgcatgaccacaggcccggccacttgggaggctgaggtgggaggatcatttgagcccaggagttcaaggctgcggtgagccatgatcacaccactgcacccaagcctgggtgacagagtgaaatcctgtctcttaaaaaaaaaaataaaaaataaaaaagagtaggttttctaagacctgaatacatgtaactaaaactaacattataaatggatattatttatttataagtatggaaagaaaatataatgagcaacattttttaggagtatgtcaaactaacaagtgttattttcactgtatcataaacatttttcctgaataattagtaggtataaaataaactaaactgataaactttttatagaaatataatttcaaggaaaaggagatataaatataaagcctgaaacaaattttgaaaggagatcaaagtgtttcaatttttttcagaaaaaaacataattctaagaaaagaaaatgataaggaaccacattaaaatctttagaaatctaattcataactatacattacaataaatatacctaaatacatttactataaaattaaaatttataaaattaaaacttacaattaagagaccaatatccacatctttcttggtcataaaaagttctctgatttgttcacatcgcaaaatttctttattaatatatttggagtagtcattgactggcttgccatacttacatggcattacagatgtatggttgggtccacaagcatacagataaaaggcctcttgtgaaccaaccttagctcctgaatagcagaaaaataaagttagttatttaaaacaccctaaccagaatttttcataaaaagcaagaaaccaggaattattttttgtagccagattctttcagttgttcactatattttataaaattgataaagcctcaatttcgaaattggtgtaacgagaaaataacctatgtcaactatgatggaagatgaattaatgtatataaagttaattgtgaagcttttaattaaatcataacatttccatttgctccttagccagaaaacaggttttctgttttattttactttgttgtattttttaaataatgggagctatatcttggtaaactccatttctaactaaaatttgaatcaatatctttattccttcctatttagtcaataaacactgtctgaatgctattatgtgtgaggtttaaggacatattttttaaaaatcatatatttcatttttccctaaaatttgatatttgtataagatataataaaattataaaggagacaaccaagataagtttactagtcatgatgctacattatccagtataaaaaaacgctaagttaatatgagcttctcttttttgaggatggaagaaatacatttttatattaaatgtatatatcaattgtaagacacaactagattacaaaaacgttaaaatattttaaaagtatatcttagaatcttggaaatacagtacttattaaacacaagtaaaggaacatagatggatattttagccaggttaatttacttagtttaatatttgttaactgagaaaaaaaactggaaatgtttcaaaggaaaaaaatctcactctgtcgcccaggctgaagtgcagtggtgcaatcatagctcactcaccgttgaagagaagcaaatttcccaggtcccattttccagccaactgcaaaaactcttcttgggatgataaacaatggccaatcatgcaaaatgttttattgctatcagatgacaaacttgtttttcttggaagcataaaatccaaagtaacatcaggcttcctacattaaaaacaaaacaaagttaaagcaatgactttaggaagtctagtactaagtatttttaaagtatgaatatttaacaatggggaattctttttttttttttttggagacagagtctcgctctgttgcccaggttggcacgatctcagctcactgcaagctccgcctcctgggttcacaccattctcctgcctcagcctcccaagtagctgggattacaggtgcccgccaccaggcctggttaattttttgtattttttttttagtaaagacggggtttcactgtgttagccaggatggtctctatctcctgacctcatgatccacccgccttggcctcccaaagtgctgggattacaggtgtgagccaccacacccggcctacaatggggaattcttgaacaattttcttgggtcattatcagctggcactggggcaagagaggagggctaattgtttgtctcttggtcaaaggtgctgcagaaagaggggagccaaagagagatacctgatgatcccacggcaggccatgggaaatgtgactaaacatttgctgcaagttttctttgccatttgacttctgtatatgcaccttcctggtttacagatataaaccaaccacctccccttaattttgccaagaagtctcccatcttgacaaacaattccaaaaactggaatccatgacattccaaaaatgttatgtcatctatgaggcctttgaaaactaatcagtaaaaacataacttcttcaaaatttctgtctagccattgaaatgccaatactttctgcattttctgttttcttaatgctaagtgattatgcagcttttgattagtctcttttgcttcatggataacggtgaaggaatgcttacaaaagacagtactggaaaaggcaaaataaggctttctcacagaaagacacacaaagcagggaggacttcatcaactagtgaaaccacagagctctacccctaatttaggaatgttttaaactccattttaagataatgagagtaatctatgaaggcaaagtctaaataaaatttgtaagatgaagacaggataagctaacacgggtagctcttaatgagaaattcaactttgtgtatatttattttaaaagttttgcctaaggctctctgtttcacatataacatataaacttaactattttaatgtttttttttttaataaaggaaagatgtgggatacattcaatgacatacttctccttgaccaaataaatggctgtgactgaaactctattgccatctagtggcattatgacttaaaatagttttaaattttttattttaaaaaatagtttttcaatgagaacatacggacacagggaggggaacatcacacaccggggcctgtcggcgggtgttggggcaaggggaggaagagtatcaggacaaatacctaatgcacgtggggcttaaaacctagatgacgggttgatgggtgcagcaaaccaccatggcacatgtatacctatgtaacaaacctgcacgttctgcacatgtatcccagaactaaagtaaaataaaaatataacaatgaaataaaaataaaatagtgtttttaagggtgaaagaaaacctattgcaggatgaatgcaaaatgaattaaacaaatattaagtatctactatgtgccatatatttctgccatatttgtaagctgttaataacaactaatagaaagtattaactcattttcagtactgttaccttattttaaaaggcctcttcaaatgtattcttttagaaattctttttttttttcttttaaattgagacagggtctcgctctgtcacccaggctgaagtgcaggggtgcaatcatggctcactgtagccttgacttactgggctcaggtgatcctcctgcctcagtgtcccgaatagctgggactacagctacgcattaccatgcccagctaatttttttatttttagtggagacagggattttccatgttgcccaggttggtcttgaattcccgtgctcaagcaatccttctgcctcggcctatcaaagtgctgggattacaggcatgaagcaccatgcctggcctagaaattattctatagcttataaagtgacaaagatactagagaaccaagtttaagtcaacagaataaaatatttgtccttggtcacttgctctgttaaccaatgaaattaacttgtgccaaatggcaaacaattctctcaaaggagtatagctgtaagttggtgggtaaaaaaacagagtgatatgtgaatcaagtgaccatgcttactaatttcagactgtccacaataaaaatctaatctctcattctgaacatttctaatagtttatggttcctctacctgtcagctgacataattcagaaaaaggctgcaggggcagtaaagcatagggttttaaagcatgggccctccctagggtcagagtttaggttaaactttcagctctaccccttacttgtggcatgagtttgggaaagtcactctaggtctcagttgcctcatatgtaaaattgggataataatatacctactttatagtattgttgggaggattaaatcaggtaatctgtataaagtgcctaatacagtgcctggcacatattgagagctcaagaaattgagtggagagtgcctaggagaaaggggctctctacttacaactccagccccagctccatctgatttaactataggttctggaaacaaatttgctgattggctacagctgccatggcagctatgaagatcgagaacgtcacagacagtattttatttggaacatggaacatggaaattaggcttcaattacgtatttttacattttttaaaatgaatacaacaaaactgaactcttaattttacttccaaagcatgttcttgcttgtggcagacaccatggactgtaaagcaatccacaagctcctgctccctgtctccctctattattgaggctggacagctgtaagcaatcaattgctgcagcctcctgcagtgatgccctgtcttccacctcaaactgtcctcctcccacctgcacagggcaaattccatctcctccttcaggtctcaggtttaataccctgttcttagataggccttccctgatccacccatcgtaagtgtcaaactcgatattttctgcctcagggttttaaagcatgggcctcacagtatttttcatcatttgtaaatattcatttaattgtgtttgcttgttgtctgattcctcatcagactgtgaactccaggaaggcagggaatgtgtctatcttgtttaccattgtcccctaggcctaattaatatatcaagtgctcaaaacactgtaattcctcaataaatgtaatgaatgaacaaatgaatgaataaaaataggttaatctgtgttaagggtatatgttatttccatggtctaatctactttgagggatttttgagagaattagatgatgtatataaagcacctagcaaaaggtctgcaacatagtaagtatgcagtattatattccctttgattaaatctagacttctcagcttggcattcaaagcctgttaagtagtctcaccatgtccattcatttttatttctcattattcaacttaaactcatccaaccagcttaatcctctaccatgctacattacagtttcgaattctctatcttctttcatgctacttcattcaatacaatacttcccaatgcttacaaatcgaagataccttatagttcctacaggctaaaatttgacattaagatattccacaagatgtttcttattaacttggctcacaattctcctatgtggtaaaaatcatacagtactctccctgaatctatcacttggtatatttctagcactctatctgaatctatcaccttatacataggctagtcattctaatttcttttgaaagcctaatttaatttaggtattagccttattagccacttaatttaaataattatcacggcttcagttttataatatatgggcttgcaggatgaaattacagattctgttctttgatatatagttatacataaatgtctaaatttctgggtatctgcatgctccccaaacccaaatattaattttcaacagtcacttcgacaggaggcttattttgcatgaaaatgaccaataggaaaaaaaagtccaactctgacagatttgtaagttaaagtatagtaaatttttcagagaaatgcaaatcaaaaccacaatgagataccatctcacaccagttagaatggcaatcattaaaaagtcagcaaacaacaggtgctggagaggatgtggagaaataggaacacttttacattgttggtgggtctgtaaactagttcaaccattgtggaagacagtgtggtgattcttcaaggatctggaactagaaataccatttgacccagccatcccattactgggtatatacccaaaggattatgaatcatactgctataaagacacatgcacatgtatgtttattgcggcactattcacaatagcaaagacttggaaccaacccaaatgtccatcaatgatagactggattaagaaaatgtggcacatatacaccatggaatactatgcagccataaaaaaggatgagttcatgtcctttgtacggacacggatgaagctggaaatcatcactctcagcaaacgatcgcaaggacaaaaaaccaaacaccgcatgttctcactcataggtgggaattgaacaatgagaacacttggacacaggaagggaaacatcacacactggggcctgtcgtggggtggggggaggggggagggatagcataggagatatacctaatgtaaatgacgagttaatgggtgcagcacaccaacatggcacatgtatacatatgtaacaaacctgcacattgtgcacatgtaccctagaacttaaagtacaataataataaaaaaagaaacaacaaaaaatatagtaaattttattatagtaaaaacctagaagtttctgtattctgtttcagaagctataattgactaatgaaacataacattgtaactgagattgagatgcattttctcaaaatgcttcctacctctgtccagagacccatatggagattttcccatgaatcctccttttcccttggggctgctgtaagtaggtgagtactaaatgttgccatttgcttgggaggaaaatattctcctgtgattcaacctgtgctagtaaaacagctttcatgtcatcatttgaatccatgcacacactacagaaaaagagaaaaggcataggctgaaaacatgaaaattctgacctcagtgtttaacatacatatagtaactataattctaaataagtaagattaaaaatcagttctattttttttaaagtgcttgaaaagtcagtaggtcttcgttttataccataagttacttagttattctatcattacctcaattcatgaactaaaatagattaggctcattggctggtagtcataatttaggcaataatgttcagaattcagtttgtaaaaaaatatatattattactatttatatagccattgcccatttagaaattacaatgtattatttggttcatagaaaaattaatataaatgtctaagtattggaggtctaatctactttgtgggattactgaaagaatgaggagataatgtacataaggcacctagtaatgtttgtaacgtttacaaagtatatattcctaaataacatactggtttgtttagatttgagttttagacaaatagtatcatactattcatactcaatacaaataaaagacctgtatctatactacttaataaaggagatagtataaaaggacaagataacaaggagaacccaagcttattaggtaatcgctattaaatatataatgcacatggaaaacttatgtctgttaataacatcttaagaccattacaatctgatagaatatttccatagcataagacttcagtatttgatctaaaatcaaacagagaattaatgtattttatttactcatttattttttgtttttatttatttatttattttttgagacagagtctcactctgtcacccagactggagtgcagtggcgcgatctgggatcactacaacctctgcctcccagattcaagtgatactcctgcttcagcctcccaagtagctgggactacaggcatgcaccatcatgcctggctaatttttgtggttttttgtttttttgtttttatttttattttttgtagagattgggtttcactatgttggccaggctggtctcaaactcctgacctcaggtgatctgcctgccttggcctcccaaagtgctgggattacaggcatgagccaccacacccagccgagaattaatatattttagactttatggatttttggatagaataatacactattataaaagtggtattaatagctgttagaatgtatatatttttaaatgagactttttgttttgctataatgaacttttattagtagatttcacattaatgtctcttacacaaattatttaaatacattatctattcatgggaggctgaggataatcaataccgaaagataagagtggcattgtggggatcagcccacacttggatcatcaacgctttggatcccagtgaaattatatgaatacatccttcttctatgagtctttcaccaggatttatgtactctgcaccttctggtctgtcgctctctataagaaaaagatgttagaatgatcagtaaaatggttcgtaacaactgagtagaaaagtgaatttagaagaatacaaagcaaatttgttcatttgtagtaggttatctacccagaatgtctgagcctgacctgttctaaacaaccatattttcagagtatagatgttaactccaaaaaagcacgagggatgaaaaatggtaattcagtactttaaaagttattagatattaaaaaatgtataataactgaggacaattgtgggcgtaaccagaccgctatgtgacaacctattacaatgtgtaccaagcttcttttatcaactatgacttcactgaccctggtccagggagcacacatcattgtccatgcctcacactaccaaaactcattctagaattatcacaatatggcatgatttaaaaaaaaatatcatattacaaattttaaggaaaaactctagtgtttgaatatattcataatttatattccctggtgagtagtttttgcatataattgctaagtgattctgaaactctaatgtttctttaaggcaagctagggtaaatgcttacaggcttgggctatctggttatttatcttgactcctcttcctcatctttgaaaacccagcactgcctgaagatgtatgatgatctacttgtcattataatacatgtgactttatgtaaagctatgttatgatatatcaaaatccaaaatacatgtccaaaggctcagacttttaaagaacactactgcttattagactgcatacatattagttgctatttttcaacaggtaaaaccatgaccgatgttaaaaaaatactccctgtagcgatgacaatagttttaaaaaagaagagttaaggtcactgattattttgaggctgctgaccaagatatatgatatacagagaactcacatctgatgtgaaattttaaaaatgttccataccaaatatgaacttctgcaaataaaagagtaggacaaaaccagtgtgtacctaggaattatagagtagtaatattacaaatatttaacttaatgctcacaaccatcttataaggtaaatatatatagggtgacaaaattgaggtgctgagaggttaatttgcccaaaggcaccagttagtttagaggtaaaaggtatgatatcgcagcaaaatattctttatctctcttcaaaactttttatatatgtctactatttttaagtgtttatacaaaatcatctttctaaaatatgttttctaatatatccttaaaataaaaattaagaaaaaactttccaatatttacttttctcaggtcactatgtatatttattcattttataagagactgtttacattgagattgcctccattaaaacatgagaaagcaatctgcatagcttatagtatagtagcaatgttaaggctctggaattaaaaacaggtgggtttcaattcctttccatcacttaccagctacataacttggtcatgctacttaacttcctctaaaaatacagatagtatgagcacttactaacttgttaagattaaaaatgtatatagaaccagctgagcaaagtgacacatacacagaaagcactcaatgcacattagatagcataataaatattatcacatgtagagctatcagttcttaggtggcaaaattcaatccacaacagaaaattctagtgaaggcatagtgtcctaaaacagaggttccactggatgagaaagatttgtggaatgaagagctactgaggcctgcatctccatgtacatataaaaccctaaacatctgtctcatccagtcatttcattcattccacaggccctaagaattatcctacctacttcactttccatcaccataaattgcttttcaatgaacagttttttttctgccctagtcatatgagaaacaagatgcagtataatagcaattcttcagttaaagaaggaactggaatgaaatttattctaatgttggagaatggctgatgcatttaaacattctgtgacaggaactaggggagggccactgaggtaagacatggcatgagaaggagaacttgaaataaaagagagaaagaagtttgcgaccagcctgaccaacagggagaaaccgctgtctctactaaaaatacaaaattagccgggtgtggtggctcacacctgcagtcctagcactttgggaagctgaggtgggcagatcacctgaggtcaggagtttgagaccagcctggccaacatggtgaaacaccatcgctactaaaaatataaaattagccaggtgtgattgctggcgcctgaatcccagctattcgggaggctgaggcaggagaatcgcttgaacctgggaggcggaggttgcagtgagccgagatcgcgccattgcactctagcctgggcaacaagagtgaaactgtctcaaaaaaaaagagagagaaagaaaaggaaatggggactgtctaataggggctgggaaacaacagaaagaaaggcagctataaggttttatccttttataacatcaggagccaccctaatccagtaatgggaccaggagagaagtcacataaggaactttaggggctgatgaccccagaaaaagttgtatatgtggtgtccccttcacccctataaaaaactaaagtttccgtaatagagattcaaggctttatgacaactcatgctttgataagtcaggacctaccaccactaagtaaggcatttaaggtgaagaacatgttaagagtgttaagaacactaccacatttttacggctcaaggaaaattatagtctgaaaacaatctttgtgtacaaatcagataatcctgtcatcatacctgtaccatcaaaactgctatctggtaaaattaatgatttgtttcttttctttatcttctttcctttttctgtagtactctcagcttcatggatacactccacattaaaccacagggaaacactgaaaccttctgataggtgtggccagcagttttgccccagcaacggcaggtggactggggctatgtgccaagatgaaagcagccgatggggaaaactctctctatcagcctctttcttgctccgtgaaactcgtgctcttctcaataaacccatggccttactgtttaaaatcccaggatacttttgtgatgaaacaccgttgcttaaatttggagcgtgcagtaaagggaaggttagatactgtgaagggctcatagtagtatcactttcaataattttcagaatacccagaagaagaattttctagagaaaaagaaaaacaaatgaaactttctaatcacgtaataaagtacataataatcttgaaatttaggttataaatgaaaatacaaacatacccacacatatcagcattcctatttaaataccttcctatctcccacatctttaaaactttcattttctcgtagctgagataaaatatgaaacagatttcattcttttttttttaagacagagtctcactctgttgcccaggctggagtgcagttgcacaatctcggctcactgcaacctccgcctcccaggttcaggcgattctcctgcctcagcctctggagtagctggcattacaggcacccaccaccacccccagctaatttttgtatttttagtagagacgaggtttcatcatgttggccaggctagtcttgcactcctgacctcaggtgatccacccacctcggcctcccaaagtgctgggattacaggcgtgagtcaccatgcccagccttcattcttaaaatatgtaatcttttgtggttaatttgtttcatgtttagatttttttttttttttgagatgcagtttagctcttgttgcccaggctggagtgcaatggcatgatctcagctcactgcaacctttgcctcctgggttcaagcaattctcctgcctcagcctcctgagtagctgggattacaggtgcatgccaccaagcccagctaatttttgtatttttagtagagacggggtttcatcatattggtcaggctggtctcgaacacctgacctcaggtgatctgcccacctaggcctcacaaagtgctgggattacaggtatgagccatggcgccctgccttagatgttctctggaacatccaatcccactacaaagtagctccaaagttttctgtcttatttgcttatgcttctagtcaaggtttcattataaaaatgggtttcctagcagataatagtttaaaagacactaagccacaccaatggaaaggggaagcatagacaataattgaagagtatagtggataataaccttttgaaaaggataatccctaagatggttgtaactattcataattaagttctctttagtaattaaaattattcagcttttctgaagcacaaaaactggggatggggtgggtaaagaaaatataatctcagcgatatgtctggttaatccaaattgaagtgaaatggttaaaatatatgcaaataattgagtatttcacacataataacatgaaattgcctataccaactgtcacatcaaaagaaagagcttagtaacatttctaaataattaaaaatacattctattaaaaattgtaagtgaaagaatttatcagtgaaaaatgtaaaaattatagcatatttactgtacaaggagatttctccagaaatattctcaaaagaagggttagctcttctgaacatgttcttgaactcatcaaagataccaaaagatccaccaatactctctggcatgctaaattaaagaaagagggaaaaaattaaagctagtacacaattagaggaataaatgagcaatttcaccaaaagaggtaaaatactattgtcactttttgaatggattataaaaaatctagtataggaatcacaaaatttgctgaagaaatagcaatataactaaatgtaaatcaaccaaccaacaaaaacaacaaaaaccacttttctttttattatttttattattattattattttagacagaggctcgctctgtcacccaggctggagtgcaatggcatgatctcggctcactgcaacctccacctcccaggttcaagcaattctcctgcctcagcctcccgaggagctgggactacaggcacgtgtcaccatgcccaggtaatttttgtatttttagaagagacggggtttcaccatgttggccaggctggtctcgaactcctgacctcaggtgatccacctgcctcggcctcccaaagttcagggattacaggtgtgagctaccatgtctggccagcatgagctcacttttcttgaagattaattagctacaagtaaactaagggcattctttaaagaaacataaatcaatataatatttgttaagctaatgcttctatatcataaaatagtctgctatcttatcttgaaaatgtttaaattatatctatcactttttaagtacgaaattagatgacaagtagtggaaatattaaagatgatttaaatacttaaataccacaaactatttagtttgaacattttctttattccatcataggtttagcataaaacataaatggtgatatacaaattcatagaattctttggagcaaaataataactaatatttgtagagcaaattatagtgttcaaagtatttttacatgctttatttcagctgatcctcaccaaaaacaaaaaaccctagaaaataaatattatctccactttgacctgaaagaaataatcttgatttaaaacctgagataagttttaaaagactggtagttttggaagacctggagtttagagaatagaagccatatttaagcaacatattttgtagaagcaatgagttgacacagtagcaaaatagtacatacatctggagagactacttgcaatgagactataaaatagcatggactttatcctgtacataacatgaatccattaaaggtttttaagtaggaaaataatatgatcagtgtgtgtgcttactttttttttccagttcaaaactgagaggttccagttaaaaatggggaaatggatatatacacttgcttctgtgtactactgaaaactcatagcattaaagtacagaattataagaaggaagaaatccgtaacagcaaaaatatgtgggggcagtgggcattggggcacatctagtaagagatttaaaaatatttcttgaagatggaaaagtagatgtataagagaaagctgcaacctagaattcctttgaattacaaagaggttcagagcagtaagaagccgagctgtccatctaaggtctggagagaaagtgacagtgcggccgacaatacagggattaacgaaaggtctgtctgtgaatatccacctctctcctgtttctcagtacagagcacagatagttcagtattcacttttaggtcccaaacctgataactcttctctaaataaacgaaatggtcaggtgtatacaggcttttagcatcatggctactgagtgtaactgtacagtctgcagactgaacaaactgcctaaccaaagggaaaagtagagactaaaataaagtctgaatgctgtatgccaagccatgcatcctggttttgggctgtgatgcctggatcaagaaagggatgccttttttctcagtgcaaagacactatacgccagccaagccctatatgtgaaagatgcatttttctaaggtatgcaaactgccatgtagggtaatagtatccctaatggtcccccaaagcaaagctctcttcattagggtgtttgggaagcccctaatcatccaatggcacattcacacagagctcttccacatactacccactcaggaaagaggccaaaatagaaaacaaattcactttcacaatattagaggaaatctccaacagttttattaaatataaatggtctaaaaaggttcataaaaatattagagaattagcaacctaaatcagtaaaaataatatttaaaaaacaaaaaaacagacaaaactgaccccagaggaaaaagagataatttggggacagaagaaactttaagatgtttattactataatcaaatatatacaaggagatattatatccttatatgaaaaagaaataaccagaaaacaatcaaaaaagagctcttaaatattaaaattaccgaaataaaaaattaaataaaaggttgggattgaaaaaatgtctcaaaatgtagcacaaaaacagtgatgtagtcaatatgacaggaaagataatcttatctttgcaagatcaattgggaggctcaagataacaattagaatacaaaaaaagaggagggaatatggagaggagaaacttattttttaaaataataaatctttataatcctgtattagatctaagatatgacactaaaagcaaagcaatgaaagatagaatagacaaataggacttcataaaaatcttttaaaacatgcttcaaagtaaaccatcaagaaagttaagaaacagcataaagaatgggagaaaatatttgcaaaccacatatctgatgaggaacttgcatctagaatacataaaaaaaacctcttactattcaataatcaaaacatgaatcaccagtataaaaatggctgaaggatttggataggcatttctctgaagaaatccaaagaaaatacgcaaatagctaaaaagcacactgctatggtgtaaatatctgtcccctccaaaactcaagttgaaatttggttgccattgtggtagtgttaagagatgggatctttgggaggtgactgggtcatgaggagtctgccctcatgggtgtgattcatgcccttatgaaagggggagttcagcccccttttgcctctcttcctttctgcattttgccatgtgaggatgcagcaagaagacccttgccagatgctggcactttgatcttggactttcagtctccagaactgtgagaaaataaatttctgttcattacaaatcactcagtctgtggtattccattatatcagcacaaatgggactaaggcacacacaaaggtatacttaatacattagccttcaggggaatacaaatcaaaaccacaatgagataccacttcatatccaccaggatagatataattaaaaaggcatataataacaagtgttggcaagaatgtgaagaaattagaacccttatacactgatggtaagaatataaaatggtatagccattttggacaacagtctgtcaatttctcaaatgattaaacacagagttaccatatgacacaaaataaatgactcgagaaatgaaaacatatgttcacacaaaaaattgtacatgagtgttcacagcagcattatacatagtagcaaaaaaggagaacaacccaaatgtccatcaactgatgaatggataaatcaaatgcagtatatccacacaatggaatgttatttcagccaaaaaagaaaagaagcagggaaggggaaaagtaactttacagtggagagacctgacaaacactacttaatgcaagtgatcaaggtcaacatcaacaattataaatcatgttgacaatatgtacccttgatatgatttaatgacaatggcactttgtttctattatcttcctctcaaaagtccatacccctagcataatcatgacttttgacaaaggtgccaaaaccattcaatgggggagggacagtctcttcaacaaacgatgctgagaaaattggatattcacacgcaaaataataataataattataaagttgggtccttacctaacaccgtatacaaaatttaactcaaaatgaattcaggatctaaatgtaaaactatatatacctaagaataaaacttacggggaacattccataatattggatttgtcaatgatttcttagatatgacaccaaaggtacagcaaactaaataaaaaaatagataaattggacttcaaaatgaaaaacttttgtgcatcaaaggatactatcaacaagtaaaaacacaacctacagaatgggagaaaatattaacatatcacatatctgataagaaatcaatatccagaatatatagagaactcttaaacctcaacaacaaaaaaagaaacaacctaattcaaacataagcagagggcttgaatagatatttcttcaaacaagatatacgaatggccaataagtacatgaaaagaggttcaacatcactaatcattagggaaatacaaatcaaaatcacaagatagcacaatgagaaaaatgtcaaacaaattctgatacagggacattctgaccagtacccctcaaaactgtcaaggctaacaaaaacaaggaaagtctgagaaactgttacagtcaagaggtacctaagaagacatgacaactaactattatgtagtattatcctggataaaatccttgaacagaaaaaggacattaagtaaaaatttaagaaatctgaattatggacttcagttaataataacatatcaatataagttcattaattataatacatatatcataaaaaattagatgttaataatagggaaaactggcagggaggggtgtaatgggggaactctttataatatctgttcaatttctctgtaaatctaaagctgttctaaaaaataaagtctattaataaaaactgaaggagaattgcttaacctgggaggtggaggttgcagtgagctgagatcgcaccactgcactccagccttggcgacaagggcaaaaccctgtcataaaaaaaaaaaaaaaaaaaaaaaaaaaaaaaaaaaaaacactgaaaaaaggaatctatgcaaagtaaaaaatttaaaaaatgattagaaagagaactaaagtgctgaaacatgctacaacatgaatgaaggttgaaagcatcatgctatgtgaaagaaaccagtcacaaaagaccacatattccatttatatgaaaaatatccagaaaaggaagtagatgagtgattgccaggggcagaagaatccgtgcaggggagggttaaggtgcaataggcaataaatgctaaagggtacagggtttcttttgggggtgatgaaaatgttctaaaattaattgtggtcatggttgcacagctctgtaaataaactgcctactacaaaacactgaactatacactttaaataggtgaatgttatggtatgggaattatatcccaataaacctgtcattaaataatggcatataatttctcagagttaaaaacacatattcagatcacaagggttcactaagtgtctagcaaaataataaaaatacacccatatactaaataagtaaatgaatgagaagagaaagcttttccttacagtacaatctcagttaataaatgaaggaatgatggaaacagaaaatcactatttggcagataccacagaattaactgttccagtcaagaatcatcatactttcatatttttttcataatactaaaattagtggatgaaagaatgagaaaaagtacatttacatagtctcaagttatctccccacaagatacttattaattataaagggaaaatagtaactttacaatagagaaacttggcaaacacctccttaaccacatgatcaaagttaacatcaccagtagtaagatccagatatcataagtccttttgatatgatgcactcaaaaggacccaatatcacttctgagtattcctgacaaaaacgtataacctgaatttaatcatgagaaaacatcatacaaaccaaaattaaagtctcgtgtaggctagccttaattctccaactaaaatttagatttcttgtgattagcaatcatattatacattcattatgaatttctcaaatgtctgagaagtaccaagtacagattaatcaataccagatatggcaacaacatggcattagactgggttacagtccccactatgccacttctttgtataagaccctgaacaactcaaccccttggaatctagattttcctctctataaacatacttgcactctggctatttcattgtgtggatctgaggaacaaacgagataatgcatataaagacacttttttgaaatcacagagcactatgccaatggaagccttttttttttttttttttttttttttttttttttttttttttttttgagacagggtcttgctctgtcacccagactggagtgcagtggcatgatcatggctcactgcagccttggcctcctgggcctaagcgatcctcccacctcagcctcccaagtagctaggaccacagacatgcaccaccacacctggctaatttttatagagacaggtctctctatattgcccaggctggtattgaactcccaggctcaagtgatccgcctgccacctcagcctcccaaagtgctaagatcacaggcatgagccaccacacctggccagaagccattattatcaacttttcacataaaataatttcagagctattgtttaaaacagtttcaacttaccttgaaaatcagaatcatcctgtgttaaaatactcaagaaccctcctaaaagatttttcacagttccctgaagattaaaaaaaatacaaaattaaattacttacctcacagaagcatgaaacaactgcaatgtcataataaattctatgatagggtatctactatatatgtatatatgtatttaaaaatgactaaaaagactactatgtgtaggattatactaattttcattttctttttatactgattgatttttcaaaacagcgagcatgtattaaaattaaatgcatttttaaaaatattacccagtctcagaaatagatgaggatttactactggctagcaaaggacattaattttctatgctactttagaaaactatggaattagaagattttggaataccacttgtaggtattcacctgaggtaccagaaaagataagtaatcatctcaaataattttcagaaaagctgggttatacataaggagatgttattgggtgatgagtctgataaatattgatcacatttaactaaatgaattttttacctgttgcatgagcagaaaaacattcttttctttctgcctaataattttcaaaaaactctcaaatacatgggcaagcacatcaagtttggctttactagcagaaagcaaatttaattccagcatacaaatctcaggataaattatttccccttgagtgaggttttcgagtaagtcatttggactgcttgatgcactgaaaccttctgtttcagactttaagtctacccctgaaaagagaaaagcgaaagattacttgtattccctaaacactaaatatttcaaacttcattaatcatttagaagatctagtggcaaaaatagtaattcagaggatgcttacaaaaccttttccaatcttttcctataacacaacttttgacaatgatatggaaattttgaagattaatgagttcccttaaaagcaattttcatcttcaatagaactacaaattttacaaataagaatttttacagacatatgatagagatttaacacatcccatggacacaactttaaaaaaaaaaaacctattcaaactttctgacccccccctcaaatacctaaatcacagagcagttcaatttgcctacccaaatctttgtgaaaatagtaggcttgactagtggttggaagaatgatcaattttgccttcttcataagtgagaaacagactctgtcttattgaatattgcattttggaaaatttgacttatatgatcttttaagactgctgtgctcttaataaaatgttgatacagttaagaaatttataaatttctacctagatcagaattctttaagttgagatctacttagcaaacataaaaaaggaggaaatccaaaattataaagtcaaatctgtactatggtaagctgtactataaaaaaattaataaaccaatattttttcaaaaagcaccagtcatgggtccatcaagccctttaagtaagatatcagtgattattcccattcactagatgagagcgagaaaactgactgtgaggaagatatcctactgagaactcagtgaagactagcagtggctgggtgcggtggctcacgcctgtaatcccagcactttgggaggccgaggcgggtggatcacgaagtcaggagttcgagactagcctgggcaacatggtgaaaccccatctctactaaaaatataacaattagctgggcatggtggcgggctcctgaaatcctagctacttgggaggcagaggtagaagaatagcttgaacctgggagatggaggttgcagtgagtcgagatcacgccactgcactctagcctgggcgacagagcaagactccatttcaaaaaaaaaaaaaaaaaaaaaaaaaaactagcagtactgggacactcacaaggtcagcatataaaaagatggagtcttgccagaagtctcttggctctaatcaacccatcttttccattctactcattttaagtccaaagacaagggaggaaaggatcataggcaatatagttccatcctaaagacaaattgagctgtggtaaactaagaagaaatctatgcttggctgtcacagacaggtgtctgcattcctgtattatgtattctttataacaaactgcctgaatgctcttcctgccagtgtttgtctgcctagcttgttttcatttagtcctcaatgtaaacattgcctcttcagaaaggacttccctcaccacccagttactaatacgacatcacccagtttatcgatttctattttattatctatttctggtatttattgtctttcacactagaatatacatgaaattggggactctgtccttcactccatgttcttaaccactcagatgatgtttgtgataacaaactatatcacattgttgcatatatgaatgccagactgttgggaagatcaataaaaagattatgcaacacacttgttaaactgtaaggcaatacaaaattctaaagtggtattattatgaaccattttgctatttaatgatctggcttgcagatctaattacaagcacttcaatgatattttaccatcatcctgggtttcgccatcttcaggattgctttcactatctgcttcgtaaccttcttcttcaactaaaagtttaaaactacaacactgagaatcctcagcttcttctgaaaaatcaccaggctgggatgacaattcttctgcagattgatgactctataaatcagtgtaattcaaaggttgtaacatttgcttgtttttagtaatagaatacttattactcaaaagtcatgttaaggacagtttcaatattttcttgaagaaaaaaacttagtaaacaatatgaatcattataaattatgaaattcactcagcaaaatttcccagatcctttcagacaacttaatacctcaaaaagggggtttctaacaaagtaagttataggtcatttcagtttaataaataaatctatgtaagaaatttcattctagttatacaattggaaatgacaaaaaaccacaatgtggtaaaattttacttcatacaatttaatactaatatatattatttgtgcacatttgttaataaaaaagattttttcataaggatttttataaatgccttataagttaggtaactagagcagacaagacatttttttcaaagggattaattaaaagatctcagaatgcaactgtctacataacaagcatctcagaagtcaagagttccagtactaacttcctgtgtaagaaagaaattttccttttcttataaaaattccactaataccttcattttagaaaacattttcacttaaagaagctcagaatacttcatcattgtaacaacaataaaaggtagaataaagtaggtattttaacattttacagttagtcaattaattcagtaatatgatgaacgtattcatagctatttcagcatgtttttaagttatggcaaatagtaacataaaatgttatttcaaaaccttataaaacattatatatatggctagatcaaggagctaaaaggagaagttatataaaaaataaaggacagatggcaactaaaggtaaaataaacataaaatgagagggaaacaagccaattatgtaccacataattttaggaaagaaaattacaacagttgttttaggaaaaaatgttaaacaactaaaacactgtgactgctattttctatgtaggcactagtcatttttatgttgaatgatttaaaattaatgtgagtagagagttctggaaatattagctataccaccaaagaaccagataggataggtaaatcaccaccatccctgaattagcatttaatacactatcaggtatatgtaaaatataccaaatcaagtaatatatttctgtcttaactcgaagtaattctcagtaaatttccagattagataaggaaaagcttatcatatcactctcctgttatgtataagacagggcaatgacaaaatactgtccatcccatcacatatccatcacgaggagataagatccactgaactcatctgaccaagtcctagtccatatgctctaatgacattcatcagcgtcctagtgtcatcccacacttccgcctctgctggtcatacccaaagaacacaactatatgttgttattcataccttctcagtcatagcatcattatgttcaaaatctgctgaataattcccgagggcaactcgaagcagggcatcaaataaaggctttgctagttgtgtttcaatcacctttgactgggaaagatggtccctcatttcaaataatatactttccacagacaagttctaaggtaaaataaaagagactaagaatattaataaccattttaaaaaactaaatgatgaaaaaataaataataaatatttacttaagtataaagctaatccatttatttgcagttgatatgaaagcaaaatgactatataaatatctagctctatacaaacatcctgttaaaattaataacatttttattgataaaatacttagttcatcttatttggttttcattgcagcatggtaaagaatggcaagaaatgaagctaagcgaagaagtcaaagcaagactgaagagttttgtgtgctgtgttaaagcttgtgaatttcaattgtggaaattcagtgtggaagcatcaggattttttagagataaggcaacatggaggctggaactgaagtaggaagagcctgttggctgactgaacagttaggtgtaagttagtgaggacagaagaggtctgccatattccaggtccctagattcctttttagttgagaaatgatctcaggagaaaacttgtaagaatgtgaggtaaagcagaagaggttaggagaagaatctggacaaagatgtggttttaggagaagtctcgtcccagcctcatttcctgggaagctctggagcctgaagtgccccacaatgattgtccccacttcttagagccacatctatcagcattagctatgagcatccttcccaggcatcttccatcggtcaagggtgattcctggaagatgggtgctgatgcgcagatggtgaatgggtgatcagtttggtaaaggagttctgggcagggcagccaacagtatcacacaaaaatttagatctttcaactttgaaacacaatatccattattattcatctgacacttataaaatgtgtgtgtgtgtatgtgtatatatacataaaacataatatatacacatatataaaagtaatatattatatgttatatataacacaataatatatatattacatatattatgtaatacatattacattttttatatatatatgtgtgtgtgtatatatatgtatatatattacataagagttggactaaggacaaggtattacctgattaggtaactccaattccatcttctgttgactagttctggcaccatgaagacaaatggccagaagggcttccaaaagtcgtatactttgaagtgaggtctcactttcttgacttgtaaatagctttgcttcctcgggagcggcttcagtagctgaaacttcttccacatttatggaagaaatatgctgtaactctaatttacctaaactgtcagcactcttttttagactacctagttctgatggtatggggtcactttttatagccaaagataataaatcttccttcatagttctcttaggttgagaaattctgtttaaatcctggttttcatttacacttgtatctccctccttttttccttgctcctctttgtgacttctgaacagtttctgtattatcataaatattaacttatggcatactcggaaaccaccaagcctataaaactgtttctggaacactgaactcaacatgtagatccaacgacacatagaccaaatgtctgctgcttggtgcatatgttcaggagaaggcaagacaaggctctcgagagatatacatggcagcatatgacttaaaggctcgctggctgtgctgtcatagccagaagtatcttctgagtcattggccgactccctgtcagactctgcttctttacttacgcataaaaaagccacacagaggaataggtttattgtgttgatatgaacatcttggttaacagtcttccgtctctttggataagcttctttgaggccagcataaaatttgctgagactctgaggagaatctgaataagcttgctgatgatgaaaagaagtacccacatgtacagaggacaactccttctgttcaatgtctatcccatcaatatctggaactgaggcatctttctgttgctcccctaggctgattatcagagtttcaaatgcttttagagaatgacttcgaataccatttaagcaatttaattcgattatttgacttactccattacaactcaaaaacaaatctcttattaccctgtgaaagaaaaaaagcatgtaaaaaggtttaaataaagaaacatcatttataaataggtacatataatatttaatatatcgctattgcatgtgggatatactaaccactacctaattttattcatcaattatcaggctaaagttcttagttagatataattaggacctcaagttactttctaattactctgatatccttcttcaaacatttgtatatatggctccagcagtatctaaaaagaaaagattgcctgtcccacattaaatgaagcaattcagggaagaatatttttctccaaatggcaaattctatataaattctgaacaccacagccaccaccacacctgaggtggacaccctgagggcaggcaagcacgtgtttgttcattagtttgtccgcctgatggttcacttgggaatttttgtttactttaaatctataccttatgaagggaaagaatcacactagagctgaaaatctacggaaggctcagcatcacatgaatttcccttctaattgggctaattgaacagtcaatggtacaaatattataaaagtttttcagctctgtctcaggtgagacttgtgtctagatcattggaatcctagtaataactttaatataagccagctaggtgattctcagccctttcatcacaaagattcaggttgtccacgaatacgccaaagagttacaaaactttcaaatcagtcagttctagttaaacaatgccaaaatgtcagaaaaatttttaaatgactgtaaggcattgatttaacatcaataatagttttaaagtagttgtgctaagattgaccaaaaaatgccacacacgaagatattgataggttatttttgtataagtttctaaaatggtatatgcattaatttgaaagaccagtctacccattcgtttataaaattatttttaaatgcaccagatttggcaatcacaaagtctggaaaactcactgataggattaaaagtaattttaatattcttatttttgtttatctatattttctaatttttctacatatattgcagaggttataaatgtaaatataatattttaaaattaataatcccattagtgcctctgcctcaataatcattttatgtattattttacatgtaatacatattttacatagttgtaaataagtgaacactattttaattgtttatattttacccataagatattataatcattttctcatattccaatatgatctttgtaaacattttcaatggccaataatattctatcaaggaaatataaagtaattaaacttgccctgctcttggatatctgtgtttcatctacgtttttctcagttgtatatctaaaacttttctttttgttgagaaattaaaatcaatggctgtatcctcttctctataaacagctcagtaaaaaatgcatacatacataaacaaatggttaaaacaaatctgacatggaaggagaacattttttgttgacaaattgaaattaaatcctaggaaagaataaagagtaaatacgatcacactgctgccaaagccctggagatatcagtgttagaagtttaaatgcatacaatttatcactcacttgaaagcatccaatgaaaaagatctagacatgctcaacaacccccgcccccgccgccacccacacacatacaaacctggatttaagcaggataggcagagtttttacataaatctgaagcacgtcctgaggcaagcactggttatgatggctacatacatgactttgagctgaagtaacgcttaggtgttgacaatgatgtgctaattcaactcctctttggagcacaggattaaatatgtaattatataatttccactgaacaactatattgcctttctggattaaattgcaaatgtgatttgcaatctgtatactatgtaatctgtcttcttcaaaaacaaagttctgataagcctttaaagcatcccatttccacaacaaatcttcagatccactgctgggcaggatcccttgaaatctgtaagaaggactggataaacttgaggagagttcagcatcacataagtttccctgcagtgtctcttctaattgggctagttggtcagagtcaacagtacaaatattacaagctgcttttttaatttttggtgatatctctgctcctcctaactgatccaaaataagtttgttaaggatattcaatatatgctgctgaaaatttttcagtgctggcaatttaaaagcatggagcaaaggaatgattacagatttgggatccatacaacagcatattccaatgttatgaacacccgataggatctggacacaagtgctgctcaaggaagcctgctgtagtaagcgcaagcactgatgggcacacactgcaatgcaacagcaccgctcaggataataaacatctccatctgcagtctcttcaaatgggtttttggaaacctggtttttaaaagccgaaaccagaagacctgagagatctcggtgatgatgcataaaatgagaatattcacatcgtctgtgcctttttcttgtacacatcgaatgatgaagttgctctgatttcacttttttgacagtgctcattattttcatcacactatttattagggctttcaaatgctctgaggcctcgggaggaactccatctcttaaaaccagccattccatttgaagaactgctgtttcaaataaattaaatccatgatgctgaatgaattcttgaaccaaatccatggcttgactgaagtagaagggatttgaagctgcactttgaagacaacagatcagaatctgaagaactccttccaaaagctcaggtaaaagaagggctctatgacgatactttgaaaacacaaaatcttcctgaacctcctgcagtgttttcttttgtcttggtgcaaaagggtcaggctgcttttctaggcatattctaatttttaaagctgctctaagcaattcagttaaatttttcctaagattttctggcatcatctctgcagtactaacatctactgacagaagatgcaacactgttcgaaagagcatcctttgaatcaaagccaccggttcttcggtccaacctgcagaaactactcgactctccaagttgtcgctcagactgcagcagtccccaaagcctgctaggaattcagttagtgtgggcactacactggctgctaaaggagaattatgattcaaggtaacgtcaaacttacaaactttttctaataaagataacaaaacatgacataagtcaaatggagaattgttcatgttactgataacagacaaggcagctggctcacttaaaatgtcagtgtttgacccctgtcttggaataatctctctggaattttccaaagccatagcatctggaggagtctgttctttggttgctaagcggtcaagtttagctttggggtggtcttgtttaggaaacgatgttaaaaaatgatgcagcagatggggccttctatgcttattcattgctatgcctttttcatctgaattggcttctgaatctgaggtggagagctgtgtctttcttgcatctcttacagaatagcgatgggtaattttacgctgtcgtctgctttttcgaaaaacatttacttttgcagaaacctgactagacagggcacttccttctaaatgtaatttttcctgagtggatctttgtgaacttgagttcttttctttggtcaggattatatctgctgagagcggtaggttaaaatctaatggaatgaaaaaagaaggcttagaatacctcaatatgttttaaaactcaattttaaggtgacagccctcttatttatcttaaacccactaaaggagtttatcctcaatgtattttgctgcagggctgatttccttcatttatgtcatatctctgggttacctcctctcacacttatccttactctaaacactagctgacattagttcaaaggatacaaattgatttttaaaacaacaaaacagaggcacacctatacttactctaaacactagctgacattacttcaaaggatacaaactgatttttaaaacaacaaaagagaggctgggtgaggtggcttatgcctgtaatcccagcactttgggagactgaggcgggtgggatcacttgaggtcaagagtttgagaccagcctggccaacacggtgaaaccctgtctctagtaaaaatacaaaaattagtcagatgtggtggtgcacgcctgtaatcccagctacttgggagcctgaggcaggagaatctcttgaacctgggaggcagaggttgcagtgagatgagatcgtgccactgcactccagcccaggtgacagagtgagactctgtctcaaaacaacaacaacaaacaaaagagaacagagttaagaaagtaaatctgatttaaaactatatattatattctaacttcaacataagagatgctgtagattatctggtatttagtgctgttgttcacaccatttacaaatctcttcccatagtaccactaattaaaatgtaaggatgtattatattctcaaaaatagtattcatagacctgatataatttaactactttaagatttttctaaaattatttcaaaatcatacactatatgccaaatgttctctaaaactgaggtttaaataattctttattcaaattatttctcaaatgtttcagcactgaactaggcaccaggtatagacactattatttcatccccggtgcctagatagggcctggcgtatggtcaacactcagtaaatacttcacaggggaaatgaatgaattctccctttaactaaaaagataattagatcagtctttctctttgcagtatgtagtaagagctatataaaaaagtagctgtaatttagagtgaataaattaaaatctgtaaataaaaaaatctgtgctttactaagacagggaaagcaaaccagatgggaagaggagaaattaaaaggagtctgacaaattccacccaagcaaaagatgcagacaatgaagacaacttcccccaaagagcattaatcagatttcttaagtgattaacaatttgtgaattctgcaaactcagaaaaaaataaaagcagagagttagtgaatcaataaataagcagaaaaacagtattacaaaaccttagatacctccttaaaaaaagctccatgaaattcactaaaaatacaggaattaaaatacaataattttttttttaacctgagagatcttcaaacatctcacaaacatgtcacaagaaagggtcaagaggaaaactattaatctctccaatgaaacatttaaagtttcatgtactttatagacatatgatttcttcaaaatcataaattaaaaatatctatcgaccttacatagaataattctacccaagcttgaaacaaaatattaaatatatcctttaggctgggcacggtggctcatgcctgtaatcccagcactttgggaggctgtggtgggcagattacttgaggtcaggagtttgagaccagcctggccaacatggtgaaatcccatctgtatgtactaaaatgcaaaaattagtctggcatggtggtgcacgactgtaatcccatctactcaggaggctgaggcacaagaattgcttgaactcgggaggctgaggttgcagtgagccgagatcactccactgccctccaacctgggtgacagagtgagactctgcctaaaaaaaaaaaaaaaaaattatactttaaaggcaacactagaaaaactaagctaaaacaaatactgcaaaagtcacttatagaatactggtaatagaaagcagtctttaaaataagcaaagaaactttaatttctttattcagacttttcacttccaacttttcactatccatttttctgatgttatgctgcacacctagactcactccttctgataagtgtttctgcttctttatacattttctaatcatcagtacattcaagtacttcccccaagaagcaccatggtttttgtattattgaaggaaaaatgtgtttgcctaaataatttttcatatttagtatgaataaatcacaataacatatagtgttctgaatctgaatcagaatcaaacattcaggcagaagtaacttttctatgaaattttgataacacaagtgatatgataaagggaaaaagcatacctgttgccttttcttcttggacaggtatcttccataccagtggaaggagagacagaagaagagtcaggagttcttctctacatgtcaatgcctatgtcagtaacaaaagaatccttcatgttctaaggcgataagacacatcagttcctaatgtcttgtcttaaactgaaccaaaaaatcctttttcttgaaagtctgcatttgaaaagctaagaatcaaattaacctatcttcaatccagttaaagctgtgatacttttaagtttataagcctttctaatgatagaagaatctaagagtatttgacagtatttagcacactcctgctgatatttccaaaaatagctgttattaccaccatgcacattgcaagaattccttacctatgaagaaacagatttgctaggtgaaaatgaaaagttaagccctattaattagcaaagcaatgctacaaagttactagaaaaatgtgaagccttcatgcagttaaatgaaaaactcagagacgattttaaaagagaaattgacattattaataaataatatataaggagagaaagacttattagtgaatgtaatccaataaatatttattgactgcatactatgtccacaaaaatactgtcttaccctttctggaggatatggtccaagccctggagaaggtcccctcatttggtccataaaatacatacacataaacagttaaagaacagcagaaggcatgtagtatgagtaagtatccaggggtggtagaagcattcagtttaggagttcagaaaaaggagcagtcattatcagaagtatggaaggagaatgggagctagagagctagacctgggacacctgggacatgggtagtaaaggatttaacgacaaatcaagtttgagttctcgccttacaccaatcagtgggagagggggtcgcatgatgacacaatcagatttgctgaacagaattagttggaaggggaagcagtgttagaggcagggtaacaataatccagatgagagagatgatgactttctgaagtactccaacaacagaagggaaaaggagacatatttgagaaactgtaaggtagaactaaaataacttgcagttgattatctatggcacataagggagaaaagaaaagatctaaaaggacccacaggttactggtttcagcatctaggtagctgataatgtattcaccaagacaggaaatttacaagtggtattaggttgggataaagatgatggattcacttttcagacatatggagtctgagacgtctatgcactatcctaatgaagacagctttttagtagacagtaaatatatagatctggaacttaaaaaaatatgaagtaaataacaagatttaggagtaattggggtggaaggcaagaagatatgtgaattttcccagggtgagaatatagaatgacaatagaagaccatcaagaatgaaactccggactttaaagacttaaagatgggcaatgctaaagaaaaggctgaaaaggcttctattgaaaaatagccccaagaaagagaagtacaaccagagaaaccaaggaagagaccagttcaggaaagaaaggagtcagcagggccaaagctgttgccctttcactgtgtgacatgatggccgaaaagcatttagtaactggaatgccccttaactaacggctttaatggagtgatttgactgcaactccaattacaataggctgaggagtcaaaggaagtgagaaagtaaagacaggacattcagactactccttctggtgtcctggttgtgaaaaggctcagaattcttcaaaaaaggggtttagtaaaatctaaacccctttttaggtatagaaaacccttcacggcaatgattcctgttgagctgtccagtgtcagctccctctgccacacatgagccctccgcatacatctagctggtaaaggtttcccctgaaaactactggtctctgtgctcccaataggtcttcctcacatacactgtttctgcaattctccatccccatcctcccatctgccaaactgcaactcattctctaggtttttagttcctctgtggggagacttctctaacaccctacctgcttcccttagtaaacttagctttcatgttcctgatttgcttccattccagcaaacaccctgctgaagtgttactgtctgaatgcccattttcctcttttatccgttaaacaaatatttcttgatccccctactaaacaggccaggcactgtgtcaggtacttcaaatgctgtagtgaacacaatatccatatcctcatgaagcctacttcctagcacaggagacagaaaataatgggtaaaaataagaaaatttcagatataatgttgtgctatgaaggaaattatctaggaaagagattacagagtgacaaaaagggtaacattttagacaggctatttaggatgggctatttgagcagatacttaattgatgagaagaaggaatccatgaaaagatttggaggaaaagggctcctagcaagtatatgaagtgctgggaatgggtttggctttttcatagaaagcaagacagctcaaaagctcctagatctgataaataacttcagcaaagtcttaggctacaaaatcaatgtacagaaatcagtggcatttccatacatcgacaacacccaagctgaggggcaaaccaagaacacaatctcattcacaacagtcacagaaagaataaaatacctaggaatacagctaaccaggaaggtgaaagatttctacaatgagaattacaaaacattgctgaaagaaatcagagatgacacaaacaaatggagaaacattccacattcatgaatagaaagaaacaatattgttaaaatggggccgggcgcggtggctcacgcctgtaatcccaacactttgggaggctgaggcgggcagatcacaaggtcaagagatcgagaccatcccggccaactggtgaaaccccatctctactaaaaatacaaaaattagctgggcgtgggggtgcatgcctgtattcctagccactcaggaggttgaggcagaagaatcacttgaacccgggaggaggaagatgcagtgagccaagatcacaccactgcactccagcctggcaacaaagtgagactccatctcaaaaaaaaaaaaaaaaaaaaaaaaaaaaaaaggctgggcatggtggctcacacctgtaatcccagcactttgggaggccaaggcaggtagatcacaaggtcaggcgattgagaccatcctggcaaacatggtgaaactccaactctactaaaaatacaaaaaattagccaggcatgatgccatgtgcctgtagtcccagctactcgggagctgaggcaggagaatcacttgaacctgagaggcggaggttgcagtgagccgagatcacaccactgcactccagcctgggtgacagagaaagactccgtcaaaaaaaaaaataaataaataaaaaataaaaataaaaaaaaaaagccatactgcccaaagcaatttacagattcaatgctattccaaactaccaatgacattcttcaaagaattagaaaaagctattctaaaattcatatggaataagaaaagactctgaatagccaaagcaatcctatacaaaaagaacaaagctagaggcatcacattacttgacttcaaactactctatgaggctacagtaactaaagcagcacagtactggtacaaaaacagacacagagaccgatggaacagaataaagagcccagaaataaagctgcacacctataaccatctggaatataacctaagaaataccatcctggacataggccctggcaaaggtttcatgacgaaggatgccaaaagcaatcacaatgaaaacaaaaattgacaaatgggacttaattaaagagcttctgcacagcaaaggaaactatcaacagagtaaacagcctacagagtgggagaaaatatttgcaaaccatgtatctgacaaaggtctaatatacagaatctataatgaacttcaacaactttataagtaaaagacaaatggccctattaaaaagcggccaaaggacacgaacagacacttttcaaaagaagacatacatgcgccaacaagcatatgaaaaaatgctcaacatcactaccaattagagaaatgcaaatcaaaaccacaatgagataccatctcacaccagtcaggatggctattaaaaatgaaaaaaagaaaaaaaaaacatgctggtgaggttgtggagaaaagagaacacttatacaacgctggtgggaacgtaagttagttcagctattgtggaaagcaaattggcaatttcccaaagaacttaaaacagaactaccattcaacccagcaatcccattattgggtatatacccaaaggaatataaaccattctaccataaagacaaacgtgtgcttatgttcaccacagcactattcacaataacaaatcaacctaaatacccatcaacggtagactggataaagaaaatgtggcacatatacatcatgaaatactgtgcagccacaaaaaagaatgagatcatgtcctttgtagcaatatggatggacgctgaggtcattatcctaggtgaactaacacagaaacagaaaccaaatactgcatgttctcactttataagtgggagctaaaccttgggtacacatggacacaaagaagggaacagccactggggcctctttcaggatggagggtgggagaagggtgaggatcaaaaaactatcgattgggtaccatgcttattacctgggtgatgaaatagtctgtacaccaaaccccatgacatgcaatctacctatataacaaacctgcaaatgcacccctgaacctaaaataaaagtaaaaaaaaaaatttgttaccacaaaaatgatctattcattaagagtttgaaggaatccactggcaatagaattgtcccttaagcccttgaaggagaaaatacgtaagttttacaatattttctgtgatgattttttgagatttatacacacatgtcaattttgcaatgtacatctttccagaaatttgtcatttcatgattatttttgtcacttcatgattataattaactttaatcatttcatgattattttcatgattattttaacttaggaattatatattacaactttttttaaaaaagaaagaaggagagtggctgaaacatacataccaagagggagagggctaggagacaaggctggagggtgtaggttggacaggtaggcagtgtcagatctaatgggcccttgtggaccacataaaggagttcaggtttatctctaaatatgatgggaaactttcccaaacatacttctcagtcttctctcagggcatggactccagggctcaggccctagtcctcagcaatcacccccttttctgccacccaacacctaacatggagttgggtattcaataaccattcactgcatgaatgactttaaattttagatgcaaaataaaacatataaaagggccccatttccatgtgctttacttccaaataataaaactaaagatgtacagataacatttccatgtatagctcatactcagtatacctcaacatttttaaagatgccaataaaaatgtacatggtcttttaaaaaaaaaaaagataaaccaatttttggcatatctttccggtagagtcctcctaatctgagtctttatctttggcaggtgaactaatagcattctaatggagcttgcagaaacctcaagggtctgagaaagtgctacggacacgctgtactgataattcagcccttgctccacatactggcaaatcaccactgctgcgtaaacaggcattcctgactcctggcagagctctgcatgacacaaggtccttcccactcagatgagggcttctcacctaccttcaaggctcagacccagcaacacctcttctgtggagcttctcctcccacacgaacccaagattgctgttctccccctcaagagaaaggaagaacattcctgttgcccccatttcaccaagtgagttagttcttgcaaaccatgggccttgaaagaatgagaatgaggcaagtgcagatgtttgggttttggcccctctgctggaattgtagtcctgaagagggcatcccacaccaccctgatgcccaatatagcactgggggaaacgagtctttccttcacatttcattaccacaatttcaaacacaattcatcattggggaagttctcttcaatcctctgggtgcattacttttttattaatatctgggtatcatttattcccagatttatcctctctggtcccaaagaaaccacatttgtaattctgtccttttagaagtgataaaatcctttactcttaatttgtgggcaccctggcaaattagaacttgcagccctctatttcaaaccaagatcttatctcccaagttttatctcccaaggtcctttgtacacacaatagtcacagaatccaggggaatgaggtgttccctcatgacatccaagtgggaagttcccaatgtgccatattagacaatatatgccatgaacaggtccattccctgctatttctagaccacccaatcaagagaaatcagccaataacataccactcttatttaatacttttattttgttttgttttgagatggagtctcactctgccacccagctggagtgcagtggcgtgatctcggctcactgcaagctctgcctcccaggttcacaccattctcctgcctcagcctcccaagtagctgggattacaagtgcctgccaccacgcccagctaatcttttcgtaattttagtagagatggggtatcaccgtgttagccaggatggtctcgatctcctgacctcgtgatccgccagcctcagcctcccaaagtgctgggattacaggcgtgagccaccgcgcccagccaatacttacatctttatgtcttcctttctacagggaaaataactgtgttacacctttataaaattccccatagaaacaacaaacagtaaagtaactttcattgaggtatttttccattcaagaaacatatttcaagtaccaacaaggtgccaggcactggcccttttcataactattgtttagactgggttttaaactaattgcctaacctagccattcagaagtagaagtggtgggatgggagtaaatgggcaagtgagtcaaaggggaaagggctgagatcacaaaccggactgatgtctaggaagctgcacaggcagatgggcaccagatggctagggttcaaggacttctggatgacatgataaggaacttggactctatccagaatgtgatggaaagctaataggtatttcttttcttttctttcttttttttttttgagacagggtttcactctgttacccaagctggacttcagtggcacaatcatggctcactgcaacctccactgcccaggctcaggcgatcctcccgccccagcctcccaagtagctgggactacaggcacgtgccaccacacctggttgatttttgtatttttttgtagagatggggttttgccatgttgcctaggctggccttgaactcctgggctcaagcaatctgtctgccttggcctctcaaagtgctaggattacaggggtgaaccaccacatccagcctaataggtatttctgatattacattaaatctgtatcttgacatgctaattaaatttgattttccatgcataagcaggaatatatgtgtatggactatttaagtcctttatttcttctatcagaattttataattatttctaatatatgtgtatatacacatatatgaaagtttctacattagtactacaaataggatctttctctttccttttcttttctagctgtatagctgcagctaaaaacaaacatctttgccttatactctacaactttgttgaaaagttttctggatgagttcttggatttttctgttcacattactttaaaaaatagtatttttatttctccatctttcccacatttagctttcatattccactttaccactacatgtatttaaaacataatatcaaatggaaatagtaataaagaattatgcttgtattggtcccacgtagaacttcttattaaaaatattattggcatctgagcatggtggctcatgcctacaatcccagcactttgggaggccaaggggggtggttgcttgagctcaggagcttgaaaacagtctgggcaacacggtgaaaccccatctgtacaaaaaatacaaaaattagctgggcatagtgatacatgcctgtaatcacagctatttgggaggctgaggtgggaggattgcttgcgcctgggaggcagaggttgcagagggctgagattgtgccaatgccctccagcctgcatgacagagtctttttttctgagaccctgcctcgaaaaagaaaaaaaaaattggttcttctaatctttgtatatgaaagaaatcctctattcgaagcttaatttgtttttagaccttttatcaaatgtttttgatgagtcaggatagttatatgtactgtttttcccagtgataaacattatgctaacagtttttcttgaattagaccaggaattgcaacctttttatataaagaaccagatagtaaatattttagacttggtgagtcatatatggtctctgttgcatattcttctgtttaacaaccctttaaaaatgcaaaaactattcttagcttgtacattgtacaaaacaagtcaatggcaacaggattggcctgtaggccgtagtttgctcagcctgctcccattctgccccacctcccctgcaggcaaagagtggttattaaatggccataatactctttgttaagactccagaaagacttaggtggtgcctagtacaccctatcacctagacaaaagtactactaggaatcttcaggggattgttctgcacaaagcagagagggctgtctcaaaggctattatagatgtggcttttgaggcatagagtgaaccccactaagattcacaggaaactcacaacattttaaagaaagttggttattaaaaaatactaacagcttggcctaaaagggataggatagagacagctcaaaatgaaaaaaggcctctgggcgcccactcttcaacaggcaggaagcagggtgagaaagctgtatattatgggctaattgttatagaaaagagaagacacctcatagggtggaaccaagagtcctggagaaacatggattagggaaccactcccacagaagataattatattcccagaccctagaacaggggccatgacaacatgtgctgactggatttcaggactgctatggccgagagatggctatgttcctctcctgtccctcttcttactacaattaacttactcctatctcattattgtatatagggcatatgcggagcagataacctgtctaattcacaagtttctcaatcaagaagagctgcaacaaaattactacatgtgaaagcctcatgtgtatccagaactgatgcataccatgagatcatcaattcaaccctgaggtcatgatggaataatatacttcaagaggcgtagaggggagtgagtgtaggaggaataataataattttggtcagagaagagaccatggtagcttaaacacagccacaaattaattgcagttcctcctatcaagtgatagagtctatttccccatcccttaaatctgagctcaacttgtgactagctttgaccaatacaatgtgatcaacatgttgttatgtgacttcttgcagcttctgcaccctcttggaatgtttccactatcatgtaaagaagctgagtctagcctactgaaagatgagaagccatgtggatgagaactgaggctggccaacagccccacccaatagccctcagttaatctgctaactgactgcaaactcagatgtaagaccagctgatacctcaaggagccaaagtggctattccagctgagccatgccagaactgccaactcaacagaatcatgagcaaagaaatcattgttttatgccactaagttttggaacatggtctgttacaccacaatcaactgatatattcattgcttcaatcagtctgggtggataattgggggattaattaaaacgggaataattcaatgaattatctactctccatggatagcaccactgtcgagtggttaagatttccactgtgatcacactctcactactccaagaagtaggaatgccaacatcccctacatcctctcattcctgtcagaccaatcatgcatagatagaactaggtttgtgtgtgaacagaaactgcagaactagatatagtaaattaatgctcatttattattacctttactatatttaaaagtttgcattattctcctattgaaacaactcttgccaattttaccattaactcacttgtcaaatctgaagaataattctcattgcctattcccttgctttaaaatttccccaatgttttcagaataaaattaagacttcttaacatggtatacaaggcttgccatgtcatggcctctgcccttcaggtctccccattagccaatccccgttttaccaaaagcaaagcaaagttcagccttcgctgtaacttcactaaactacttgtagttcattgaatgtgctgtgttttctctagcccccgtgttttttcatgtgcaattcttctggtctggtgtttcctgcctctttacatcgccaattcctacttagggatgtcaatatctaagaagcagttcctgatgacccctctccactacattcaccaaatactttttacactgttttgtcatcatttatttacctatctcttcaaaagcgaagagctcctggtaaagacagtcgctgtcctttcatctccgcatctagcagaggtgctgggccatagtaggtacttaatggtctgctgagtaaagcagtgaataaactgtagccacacttctaaaggtctgatattgttctatttattttatatatcactacaggtagcccatttcagcagtactatacattgaagtgataatactacaaaaatgtaggaagaataaagtactctcctacatagaaaatagccaaagatttttaaaaacctattataatgtttgaattatattttgttcataaatgtacaaccctctttggtaaaacttcacattttactcagcaacataagtaacaactttataaaacatccacagagtgcaataggtatggaaattatgtatcactgaaattttaaaaagtagtatttataacacatgttcatgtatactagtccaattttgatatatatgttggcaatagggcatagaagaaaccagaagccattattttcaaatattacacagagacaatttttatactggaaggatcccttaagtcatccagctgaatgtccttatgttactgatgaggacactgtgctctggagcaattaagtgactaaagtcactcatctagttgatacgggtgccaagattaaaagcaaagataggctgggcatggtggtatggtagaaatattcaactttgtcatctttaaccattaaaaagaatgtttttgatatttaaaaagagtattttcccctgagaataagtagattaaaatttctgtgtataataaattatgaacaaaatggagtttattccaggaatgcaaacatttaaaaactaccgctgagcgcagtggctcacgcctgtaatcccagcactttgggtggctgaggcgggtggatcacgaggtcaggagttcaagaccagcctggccaagatggtgaaaccccgtctctactaaaactacaaaaattagccaggtgcagtggcaggtgcctataatcccagctacttgggaggctgaggcagaagaatcacttaaacctggatggcagaggttgcagtgagccaaggtcgcgccactgcactccagcctgggcgacagagttgagactctgtctcaaaaaaaagaaaacaacaacaacaacaacaacaacaaaaacgatcaagataacttacctacattacagaataaaaaagaaaaatcatatgatagtttcaacagatgcagaaaaggcatttgacaaaattcaacatcccttcagtataaaaactcaacaaattgggaatggaagaaaattccctcattctgataaaaggtgtctaagaaaaactgagagttcatatcacatttaatggtgaaatacctcatgcttctccttaggtcagacactaaaccaggaggtccactttcactacttccatctgcttttgtactagaagccagtgcaaaagtcaagaaagcaaaataaaaggcatacaaattgggaaaaaagtaaaattgtcattcacagatgacatcattatttacatacaaaatcctagggaatctacagaaaagtttcaagatctaatgaatgaatttagcaaaggcacaggacacaagatcaacatacgaaaagcaattgtatttctatgagcaacaaacaacaggaaaataaaaaaatttaaataccatttataatagcatcaaaaaggaataaaatatttagaataaatttaaccaaacaacaggcaggacctctacaatgaaaaccactcaatagtgcagagaaacaaactaaagaagacataaatagagtttgatatcatgttcatgcattggaaaactcaacattgttaagtgtcaattctctgtaaactgatttatagattcaatgccatcttaaatgaaatcctagtgtgcattttgtagaaataacaagttgattctaaaatttatatgaaaatatgaaggatctagaatggccaaactttctttaaaaacaagaacaaaattagacaacttacaacatctaatttccaaacttatttttataaaagccacagtaatctagacagggtactgataaaagactacatgaaagatcagtggaacacaatgcagtctagaaagacccataaatatagaaaaagtgctcatcatcattaattgccagaaaaatgcaaattaaacctacaatgagatactacttcatattcacttagaatgactaacactacaaagactggcaatatcaaatattagagaggatatagaactggaattctcatacactgctggtaagaatgaaacatagtacaactactttgcaaaacagttgggcagtttcttacaaaattaaacaaacattaccctttgcccacaaattgtatgcctacatatttacccaggacaaatgaaaacatatccaaggacttttataggaatgttcaaagcagctttattcataatagccaaatgcatacagctcaaaagattaaacagcaggtgaatggttaaacaaattacagtacacccatacaatgaaatactaatcagaaattaaaaagtagtgaactactgaattatgcaacaacatggatgaatttcagagacatgagagtacatactacatgattccaaagctacatttagatgctaaaagtcacaacagtggtggtcttgcagtgagtgaaggggagggactgactgaaaaaaaaggcatgacaaaactttctaaggtggcggaaatattctaaacaatgatctgggtggtgatgacacaggtgtaaatatttggattttgttttgttttttaagacagggtttcactctgtcacccaggtcagagtgcagtggcacgaccatggctcactgcagccttgatttccccaggctcaagcaatcctctcacctcagcctcctgagtagctgggactataggcacacaccaccacacctggctaatttttgtatttttttgtagagatggggttttgccatgttgcccaggctggtctcgaactccaggcctcaagtaatccatctacctcggcctcccaaaggattgggactactgatgtgaggtgtatttgtcactattcatctaactgcatacacattatctgtgcacttactgtatataaattatacctcaataaaaagtttatttacttctttatattaaatgtctattaataagctgggcgcagtggctcacacctgtaatcctagcactttgggaggccatggcgggcagatcacttggggccagaagtttgagaccagcctggccaacatggcaaaaccctgtttctactaaaaatatttttaaaaattagcccgggcgtggtggcgcacgtctgtaatcccagctactcaggtggctgagacatgacaacctctagaaccctggaggctgaggttacagtgagccatgattgtgccgctgcagtccagcctgggtgaaaaagtgagactctgtctcaaaaataaataaataaatattaataaagcaaacggactacagttggtgggaaagggcttaaatcaccccagagtactcaagaagtgctcctattcatgagaagcacagatagaaaaactaaatttcctcctaaaacatacaactatgtgtctagtgttatgatttcatcttaaatgataaaatatcattcaattaattccccttaaaaactcaaacattcattctccatttcctaattgaaagaactaaatgttgataaaggcctatgttttaaatggctatttattttcactccaaaggcacatctactgttcctactattattgctacagatattccaaaaagtgactaggtggaaagaagggattaaaaaataccaccacaggaaaaaaatatttaacttatgacctaaataattttagtcatttaatatcttaaaatatatcttatgacttaaaagagaaagtattctatttaccatatatacaaagaaaataccgtatttggaatccaatagacttggttccagaatacataaagaactgctacaactgatgataaataaataacctgaccttaaaaatggtacaaaacttttaaagagatgttcataaaagaagatatacaaatggccaataagcaaatgaaaaaatgctcaacatcattagttgttagaggaatgtgaactaaaactacaataagatactacttcatattcttttagaatggctaacactacagactagcaaaatattcccaaaagaaaaattattgctgctgttatgacatgaattatttcagtcatttagtaatacattaaaagacatttcatgacataaaagagaaagcataaaatctggagagatagaaagtagattagtgtttgcttaggggtaggggaatggaagggataggggaacgatagctaaagggtatggagtttcttttggaggtgatgaaaatattccaaaattaactgtggtgacagatgcacttacctgtgactacactaaaagccactgaattgtacacataaaatgggtgaattttaagatatgtgaattatatctcaataatgttatttttaataatgctgttattaagattttgattgggattaaattgggatctatagatttggagaaaacatgtatgtttataatattgattctttcaatacatgaacattatataatgctccaattatttgggtcttctttagtttctctcaataatgttttatagaattccatgcagaagtactgtacatattttattagagtcattcctcgatatttactattactgatgctatttatatggtatattttaaagaagacaaagcattgaatttttttattgtggggaagaacagagcatggtgtacatattaaataatcaaaatttcaaaataaatcactatacatggtctaacatgattttttctgattttaaattttatttacagaaaagtcatacaaatatataaaaattatatttaatcactcatttaacaaatcacattcatgaaaaagaataaaaatacataaacttggctgggtgcagtggctcacacctgtaatcccagcactttgggaggccaacgggggtagactgcttgaggtcaggagtttaagatcagctggtcaacacggtgaaaccccatctctactgaaaatacaaaaattcactgggtgtggtgatgcacacttgtagtcccggctacttaggtggctgagacacaagaatcacttgaacccggaggtggaggttgcagtcagccgagattgcaccactgcactccagcctgggcgacagagcgagactctgtgtctcaaaaaaaaccataaacctacaaatgtcctgaaaattccatgacaagtaaatgcttcctaatttgtatttgctatgttccttagcttacagtgaaaacagaagtactgttttagtctccatatttcctcaatatatgtatctattagcaaaatgctttcacagcaaagaaattttatttaatgatggccaattttacatctaaagctggtaacattcaaagtgttaaaaaaaatccatcatattggtgttacaaacacttcattattttttcaactaactatattaattagttccctgaaagcagattgtagagttttacgatcacaaaataattattcattttctactaaaatgaaataaagatataaatcacatttggccttaaaattaatttatgtgagtacttaatgtttctggatctgttttctcatctgtaaaagaaggttagatgaaaacatctagtctcaactagttttaaaactctgttaattttataataagaaaacagcaaaaccatatggtcataccatactttaagccaaaaacgtttgataaattagatgtatacaagctaaaggactcagtaattattagttcacataagaggtctctgctttcactccagaattagcagcctccaaaaatttttcaaaaacatacttgatatttattgaaaatgaaaattcatcatgtttctgacataagatacagggatataagattatgtcttatatttctactaagaaccatagttatctcactgatattacgataaaaagcatagtatatatgaaaccatttagttcttaggcaattcataattctaagatatttcagacgttttgaaagtattcaaataaacaatatggttataaataggtccactttttttttagtggaataatgtgaaagactggactttatctcaaggaggcttcagaaactatgtaatccaaaaccatgtagctacagttaactatcatatattgatgaaagtaagtatttgatataaaaatgttacctgatcaattatagaatttagcttggtaagtaatagaaatcctcgaccatggacaaggtactgtccaagggttgccatgtgcgtctcctcctcttcttcctccctggcctccaccctctggaccactgcattgcaaagccggttgacatcggtcagaaattcacgtgccagtgagttactgtcggtgctcatgaccgagctataaaataagtattacaaaaaaaaaagattaggaaaacaaatacaaatttacttttaaaactatgtgtttttgttgtttgtttctaactgaagattggcttaaaattactggaaattggtacttaaccctataatattttcaggcatagttctgacctagtcaggtgcttcttaaataattccttccatggcgaaatgagtcccaggcttgaaatacctgagcatagctgagaataggtaagtaacagcacctggatggaaaacattttctctttttaagagagaagactttctttcttaaatacaataaaaataaacccattacttataaaatgttcttgctttatatattttataataaattggtattttaaaaatataacccatttttcacttgatagagcccacaatcactgacccatcctccccaaacaccaaagttcagttaataaaaaggatttccaatcaggtgaataaaaactgaaaaattctaatagctaaagttacgccacttcacttcttatgacatatttaaatcaaataaagggtaatgtgacattttaagattaagggaaataagctacagcaaacagaataggggaacataaatacagaggaaaatgtacaaatttccagaagggaaaaaccatgaacaacgaaatccccaaggagtttcaaaatagtttcatctctgggctaaaagtaattttgaggtatccagtaacctttaaaagatatttaacatagagatgttaagttaaataagacatgtattgcctcacctcccttcacccgcttcagggggaagccctccccacagtccctgctgagagggcagtgcacatatgactatgcctcttgccaagaggcacagtcaagctctgggccccagttcagctacaatccatgctcatcacaagatgtgactcgtatagtgtgggttgcaaagaggaactggactaatcaggttttctttctctctcgggaatttaaactaaagggatatagttgatgtcctgaaaggtcacgcagagatggggctgtggtagtcattatgaggtagctgagggtcagaagaagccaaccaggtaaaaatgaaccaacgggatacaaagagaagtagataaaaatgaaagggaagtaccagagaaattcctaatactaccttagttcctgttcatcctgggacctcacagtttaattctttgattcccatcaaaattctaggtattacagtaactctcttttagtataacaaacatcaatatttttaatatttttgaatattagaaaggagaaaaatataaagtgcatctctcattctaaaatacggcaataacctctattatatattaatattggttctttatatgctttcagaaagtaaaagtattaaataaatccaataacctaatttatattcagttcatatttatccaactttaatatatttcattgaatctgttcataattttaggatacataattacttagtacaccactaaaaaagaattaaactatgacacaatgcttcttatcacataaaatttccccacaatatcaccttctgggccatcaagaccattcatgccacagcacttaagagtactgcagtatcgtttctgggattttccttcaaagctactaacgtcattctataaatttatatgctggtgctttcttgatcttaccagatggtatcagcagaaagtttcagaaaacaaccaggaaaacatttaaaaactcaacaggtatagtaccagcaatgcacagaagtctgctgaagcactgacaatgtgaaagtctatgatcaagtgcactcatgtgcaggccaggtcaactacttcacaagtgcttataagacactatccattgcaagatacactgcaactttagaaacattaaaaatgtgaaaaactgaaaaattatgggaataattaagtctatcttctagaaattaagaaaatggaaatcaatataaatttttagatataaaagttaatgccatatcagtaaaaggcattataatctcaacagaaatgtatgttttttcctgatttaaaaatgtacctaaaatatatacatgtttatatgaataggttagtgtatatacatgattacttgcttttatttaatttagatatattgaaaaacatttcacatgagctctcactctttaatagctgtatggcatactgctacatgtaaatattacatatatagcattatattatagtttactatgtagccaatctcttatttttgaatagattgtttctagctttttattatcataaacaaagctacaattaacacccttatactacttgcccctttatcttattacttccttgaagtagaaattgccgttatttcataaggtaggttttacatatttcttgttaggtttactccaaggcgctttatatttttgccattattatgaatgggattttgttttccgtaacatattctaggatttaaaactggtatatagtaggcacataggaagtggatttcttttgatataataatcatatatctaaacttctgagcttttttattattttgttttgaatttcccagatataatactctataatctacaaataacaaaaattctgaattatcttatccaatattcatacaatttccattattctatctaattgtatcagtttgcactaacagaacaacatcagttgtggtgatggggacacttttgctttgtatattaggaagtattcacctcttcctaacagaaatattgaatttaattgaatgactttcagtcatttttaatgtcaactgaagagatgattgcacggtattttctttaaattttttctaatatttaaagtacccagaaacaaagaatatataacatgaggttatagccaacaaccagatataaatagtatactgtatatatccttttgtaactttgctttttcctcttaatgttatgttcattccattaaaccatcatgcaatataccattgtatgaataaaccacaaactatacatccatctctactaagaaaagtttagctgttttaactttggggtttaacgaatgtcagataattatgtagtttcaagccttcaaaatcatgttgatggttaatatttattacattatatacttaccagtctttcaccactgctgtgacatttacagtctatatcatttggactcataaactagatgaaacaaatattcttagaacaaagcttcacctacaaaaaaaaagacatattaatcacaatagtaaaccacaaataattttaacaaagttgtgacataatcagtggccagtcttcatacatgatgtatgaaaccaccaatgaaatttttagatcttaggagcacactaaaaaaatgcctacttcaagaattcctcttgagagggaatcttggaacatagtgatctgaaaaagcaactcaataatagctctctacttttcctcttccagttcttaacttaaaacctccaggtaaatcacaagttaactgcaaaggagaattagaccagtcttcttaacactagaatctaggaggcagcggaatatctaaatactatcacgacaaaaaggttttcaactcagagttcctaggtacagccattactttcctgttaggatgaaaggtatttgaggatacataagaacttagacaataccaaagccaaacattaatttattaatcaccatcaaatttcatatctttattgaagtttttaaatgaattaatcttttgagtagaatataatgaaggttatttctagaagactaaaggataaatttctatttctgggatagcaacaggatatttctctttagttacctgctctccccttctctacagtgcttaccaggaagaagcatgaagaatgtttccttatcatagttatgcggcaaacatgaagatattttgaattataagttttaaaatcagattgatttttaaaattatttttatttaaaaaaaaatgagatggggtcttgctgtgttgcccaggctagtcttggactcctgagctcaagtgatctgcccacctcggcctcccaaagtactgggattacaggcgtgagccactgtacctggcccaggagtgatctttaattacttcaaaatgctcaaatctggaaaactgtcttaagtttctttcagcttgccaaccagttcttgtaccacacattattctaggcacttgaagataaaccaggcagaaaacagctgtgttagacaatgcagggctttgtgtgaattaggaaaaaacatcccttcctgatgggtgcagctccacacagcagggcacacagctatcaaagcacagggtatatttcagtctcaccccctcattcctctggcagagcaccagaaagcagtatatcaacggctcaaccaagtggaacagccctggaatagagtcctaacacaccttccatacctgttcctgctgcctcctgagctaatcaatatcatgcaaattttttttttttgagaggagtttcaccctttcgcccaggcttgagtgcagtggcgcgatctcgggtcactgcaacaacctctgccgcctgggttcaagtgattttcctgcctcagcctcccgagtagccgggattacaggcgcccaccattatgcctggctaatttttgtatttttaatgggggggggtttcgccacattggccaggctggtctcaaactcctgacttcaggtgatccacccgcctcggcctcccaaagtgctaggattacaaatgtgagccaccgtgcccagcccatagagatatttttaactttaaaattatggaaggggaaaaaataaaataaaattatggaagggaaattatggatcaaactgtaagcctaaagatggtattatattagctgctctgactactaccaccctccagcttggactaccacaaggtagagccatctatcttgcaatgctaagatgattccagctaactcagcgtggccgtaagaagtgaaagctggcagctggtcagctagatccgtctgtttctcttatcgagggacattttctaggccaagctgagggatttctctaatgctcttaaactggcatggcttctttatctctgtagtttacaaagcctcacttgaatatctatgcagtttcattttatccaagatcataattctaaccaccagcacagtcacatgtgtcctccttgagtctgccagcactctttatacacacctgtattctaatttttatcatcctgtatcattctaggtgtccagaacatctggaagtatagatacatttttaataatgatgcccttagcccattatatatttgcctctgtttccaaactacatagacacaccctgtagttacttatctatgactgtttcaccctctaggtcacaagttacttaaggccagggaccctgtcttattactttttacctttcatagctataatgcccaattttaaatctaactttatcactataatttcaatttctaatacaacaattgttataatgtcataacaaagaaaacttgccccaacgatattcgtagaatttttatatccttagcatttaccgtaaatgaaaaacatagtaacaaatgcctataatcatataaatgacctcctcagaaaaataatgtttcactttttcctcatatagtgactggtaaaatgtaaaatatgaacaagcaaaaacaaaacatacatacacaaacactgatttaatgtattagctacctctcattttatgtcatcagaagtttcatcaatatgccatttaattcaacaaatgttattgaacatttactgtatgtgagctactaatttatgcactgagtttagagcagaatcaaaatccttaccatcatgtattatagtgaggtggagacagatgaaaagcaaacatacactataatgtcaggtcatgttaattcgatgaaaaagtaaaacaaagtaagggtatagagtgacaggaatgctgtttcagataggatggacaaggaaggtctgaagcagtaatatttgagcaaaaacttgaatggaataagtaaatggaccatgtgggtatctgggaaacgtgcgttccaagccactgagataaatgtatgctggatgtacgggatattgagtgcaagaggacaagaggtaaaaaataattgcaaagaaaaagtgagaaaagtcaacccattcttccttctcaggaactaaagtaagcatggaaagaggaaatagaagtgttcccctgaaaccatttctccccaagaatgcaagtccctcccaatgcccacccaaaaaagactataaggttttttagcctgtgtgaagaatagtactgtttactgataggtaagactgacataagaacagttgtgagggaaaataacgttcagttttagctatgttaggtgtgataggtttcttagaaattaagtaatcaagtaggcagctgaagatcaaaacaggcagggaagctggaactagtgaatcaatttgggaatcatcaggatatcatcaataaatttttaaagccatggaactagacagatgaaataacccagaacagtgctgttcaccggagctttctgagacgatgagcctgttctataatttctgccacacaatatagcagacaaaagccacatgtggctaggggctactataatgaacagcgaggacctagagaatgagtgtaagggagcagagaagaggttttacaactgagccctgggcttagcatggctgagtcaatggagagggtaagtatccaacacaggagactgagaaggaacagcaagtgaggcaggagaaaaatcaggtgagtggtatctcccagaaaccaggtgaagaaagcttgaaacagaaaagagtaaccaatgctatcaaaaattctgagagaaagctggcgggtgcagtggctcaagcctgtaatcagagcactttgggaaggtgaggtaggctaatcacttgaggccaggagttcaagaccagcctgggcaacatggcgaaatcccatctctactaaaaatacaaaaattagccggcatggtggtgcacacctgtaatcctagctacttgggaggatgaggtatgagaactgcttgaacctgaaagggggaggttgcagtgagctgagattgagccaccgcataccagcctgggtaagagtgagaccctgtttcaaaaaaaaaaaaaaaagaattctgagaagttaagttaagtaagatgaagactgggaattgactgctggatttagcaacatggaagttactgacaatcttttcaaagaatggtcttggtggggtggaaaagagtggtgaggaaatgaaggcaagcaatttaaacagctcttttgagaagttctgccacaaagcatgcaagggaacgggtgatggcttgaggaggacatgagataagtgaggttaaaaaaaaacctgattaatattatagcttgtttctaagctgaaacatagtatgtttctctaacagagaaaggaaaatagatgaaaaactagaatgagaagagagaattctaggaacaatgagtaggcaaaacgaagaagaccaacatacaagtggaaggaacagtggcagttcatctaattgaataagaagaatgtcagagaatacgagtatagatgtaggaagattagtatatttggcaataggaggaccaagaatttttttcaggtgcttctattttcttggtgcaataaacagcaagactgccagctgagagtgagaagtgggaaggaggtgttaaactgatgagtgtaacagggtcaaaaaacagcagcccataagagacttcctgccaggctgccaatgagtaactaaatcaagattgagttccattgttcaataactatacccatactataatccaactctccttcatgttcccaagtatagaatggtggactgtcaaatactccatgggaatctagatatattacagctgcagcattctcctaatctgtaaatgtagactctataggtagaaactgggttatctggaatgaattcttagaaagcctacatagcctttattgctcatcttttctttaagtataatatttgaaaatctttaaaaatgatctctagagtcttttgtggaagtaacatcaagtttacaaaaatctatggaagctacatttttttaaattttagaacattattcctccacaggcttctacaagttttcacatttcactataattactcaaagattattagttgagcaatgacattaacaaatgttctcagaatctgaccgtgagatgtgaattcattttagagcatccagagttctgatacaatctcctccccaatcttgggcttcaattttctcctcttatttttctcacttgtacccttcttagtctgtgtgtagatcattctccatgtcagagaagagaagaaagctaagaaatttcatttgttctctgtatctgattattgggtccatttgttggtaagaatctattatttatttgtcatactcattctctctctctccccctactgccctatcccccacccctgcgccctttctttctttttgtagagacagggtctcaccatgttgtccaggctggtctcgaacttctgggctcaagtgaacctcccgccttgacttcccaaagtgttgggattacaggcgtgagccactgcacctggcctcattttcgttctctacatataaaatgtaaaaggtcagcccaactttttcaaaatcttagctcattattctaccaggactgtgttcctattctataggttttatatgtgtgggtgtatgtgtgcatatatatatatacagttttttttttgagacagaatctcgctctgtcgcccaggatggagtgcagtggcatgatctcagctcactgcaacctccacctcccaggttcaagttggccaggctgatctcaaactcctgacctcaggtaatccgcccacctccacccttccaaagtgctgggattacaggcgtgatccactgcacacgaccatttggtttcatatccttctttctttcttgtgcacattatttaaaaatcagttcatgctgggcatggtggctcatgcatgtaatctcagcactttgggaggccaaggtgggtggatcacctgagattgggagttcgagaccagcctggccaacacggagaaccccccccaccacgccccatctctactaaaaatacaaaaattagccatgtgcggtggcaccgcctatagtcccagtaactcaggaggctaaggcaggagaattgcttgaacctgggagagaaggttgcagtgaactgagatcgcgccactacacaccagcctgggcgacagagcgagactctgtctcaaaaaataaaataaaatgaaataaaataaaataaaataaaataataaataaataaataaaataaatcatcagttcatgtggccatgttccctctccctttccttcacatattatttccaattgttcagtagagatactgcctattatcaccttgtaaccactttcccttcaagagactatctctggcatcttacctaccttttcttcgaattttaggaactctgtactccaattctctatattccggctttgttccatattcctcttcctgcttattagtctgccagctatcatttacaaaacaaccactttgtatcagacactaagaacataaagtaattccagtctctgccctcaagaagattacattacggtggcaaaggcaaatcaatatatagggtactatgtactgctaaggggcacttaacccaatttgagtggccagggaagcttcatgaagaataaattgaagttgtacaggtaaagggagaaaagaagggaagaaaagcattagagatggaaacagcagctcaagttgtcactgaagaaattacagtaagtttggtatcacaactacaaaatgagaaacaggaaaagtgaggatggagggagtggctggcaaagaccagatggtgaaaggcttttgtacactatgctaagaaccttgggctttaatctattggctagtgagtcttatcagaatcacctatagagtttgtctaggccccatgatcagagaacctaatctgctaaacccacagcaagacctaaacatcggtatttttaacaagcttcataggtgattctaatgaacagtcagggctgagactcactgctacaggtgacaggaagcccatgaattattttgaacatgtgagtggcatggtcaatcttgaacacataggtcattctagtggcaatgtggaagacacattttatggagaaaactctagctgcatgaaaaccaatttggagactggcgtcatactccaagcaaatggtaaggatatttttttctaaagcaacagtagaataatataattttattaaatatccaagaattaaaatgagcacaattttggtgattaattggatggagaagtgagtggtaagggagggatcaggacaactctctgaatactggcttggttaactggataaatggtactgtcacctgcgaagaacacacaagaagaactgaggcacgtgtgcagagtctgctgtcagggcaaaaccactccacaccaggtgagctgagtcctctgtctattaggccagtgactaacttctttacagtgactactgagactaaatccaccatgcctttcattccaatttcagcaatgctcaaaatgtataccttctcaacaactatccttaactccatctcatggtttccaataccagaccgaataaggaaatagcaagtatagactctcctgagaaggcaggattagaaaagaaaaacagaaaatagagaggagctggagaaggaggcataggttaaggaattttttttttcaagtatttgtattttttaaagaattggaagaaccgtatttttaggctataagaaataagaggtggtgcggcgtggccagccatctcctatcagctctgattgtgtgtacttcttcccagcatcactggcaccatgttggtagcttaaaatcatcatggtgagagtatttccatcatggaaatgggcaaatgctacacattagggtcttttttgtttctttctccaggagagccactttactagcataccactgcagccagcacaagggaagatactgaagacaggggcaagagaacgaatgaatgaaggacaaaattcatggagaaaataagtgtggattggatcaagggtataggtgaagaggttaggctggggcggggaagcaggaggggacacatcatcctctgaggctgagggaaaggaggtaaggagaattgcagatatagaaaacaggtggaaggccagaaactgagggagctcaagaatgactggctcaattttttcattcaagtaataggcaaagttgtctgcttaaagaagagagtctagagattgggggctaaaggctaagtaatttagaataattattggaagaatagtcaaatgggggaaagtagtgatgacagacaaaataatttactggttggctactagcttagcagaggtggaaaaccatgaatttctggtggtatggattttttcagctatttcagattcaccagcaggattcagctgcttgggtctaataatagacagtgcagactgttatcactgatctggaaatgggagttttggtgggtggaggcagcagaagcataagtgaaggggacccaagggtatgggtggaagaacagtccttatggccaaaaatgagacacagactgggtaggaaaaagaaagaggccaggaaaataaatgttgatagacaagcagaaaatccaggcaatcaaggaagtgtggatctctaccagactgaagagtacacaatgtgggaatgaagatgttagaatttttagatttctgaaacaagcggtcccagatgacaacatccacagtgtggccctgcaagcagatgtctaaagtgaagtgaaagttaaggtccttgcagttaagtaaccatgaagctagtatttttggacaacagatcattgtaagttcttaaaatgaaagccctataatgacagagattttgtctgttgtattcactgctaaatctctagcatctagaacagaacacagctaacagcaggcattcgattctactcatttgccgaatgaatggcgtggcctctctctcaggattttcattaggttaacttgtctaattaagcccctcgtagtcaagttaggtcaaagatagactcaagagtactggttccctggattatttcctttaccttctggaaatgaaatggtcactaaagtcagtcaacagtggctctgctttcattgaatgagacttcctgcagacatctggatagttaactttgatatcttagctctgttccagttctgtgattaatttccacaacttattatccacctaaaagattacagaattaagctatcaccctcagtcttgtggattttcatgcatttatcttcttgacacagagaactactacacccgcccctcacagcaagtcatgaccacatatattcttcacttttagggcagctcctcatataatggcatttttagatgccttgtcatgtctgtgttctagacaatgctaccaaggacattacatgtaccactgaaaataaaatctcaagctcaacaacagggcaagaaatggtccctaggtggctgagtttccttttcaataaatatcaaatagccagtggccacagtgataagaagggaaaggggtccattgtgctacagttccctttttcataaattcattaattccaatatttatttattaagtaaatattttaatagatatttattaatatgctccagctcattctattttcactatttatgaatctgttctgaatagtgggatatacatacagtaggcatcatgacagtagtgaaataggacccagaagccgcagatcaggaatctagcaattactagctagtcacacagagctgtgtgaagtttggctgcctcttccataaactaccccacagagttgctatgtggagcctaagaaattatataacctcagtaaacattgttgacaaattttatagctctatgtaaatgctcagtactagctgcacaccttatgacagacagtgccatctgaaggaagaaaaagatcactgcaagctttcctcagatcagtgtgaggaaaatgatgttctgtttcataacgctatttccagggaagcactgaaaaaaaaaataggaagtccctgtattttctgctttttccttgtcttgtggcttccacaagaaaaaaaagaagtaaaaggaaaaaacaacaaaaaaggttataataatgatatttattcttataggttgattagaaagcatactttttcctcatcaaacagtaacacccaaaagacttgttagtctttcaccaaatgccaaaaaatcctggaaaattcccttttaaagtaacactacgtgcttgcctaattttctcaattcaatagtattagagaagttgccattggaaagactttttttcaaaaatgttatgtgccaaagaggagactgtgataaatcagggttattttaagaattaggcaaaataatgtacagaataataagtgcccaataaattctgttaaatcaaaatctgccatgatttgaagcagccttcttgaaaataaaggttagtttatatggatttaactattctaaatcccagctctccagagtttaatatatattgatagattgattagcaactttctcaaagatctcatatagtctttacaacacatcagtaaaaataaaaaatctttatgagaaaaaaagataacaccatttatatcatttcataaatgacatgaataaaggaataaacatgaataacttagaatcttatgttgtcataatggcagaaattttagatatcatattctctaaccccacattctacagttgagaaaaactgaggcctacaggtccaaggtcacagaaatgattagtcactggactctactatcccagttgtcttggagttacatatgttttggggggtaattaactaaaactgaaataagcaagtttagaagatacatagcctttcttcttctgtcgattagaaattagacaacaggcaaaggcgtttccctaacactaaatactacctctaaatggtatccagaacctttactcaagtccactggattgtaatacatacacctggaaacaagatttttaaacctctctctacaaactttttagactacaacacagaactatatgtctgaaatgcaggacactggtggggggaaggggaccaaagagggggagggggaaactgcacttgttcagattaatataattctctttaaagaataagccagttaaaacatatcagttgaactgtacaatatttaagcaagaaaatatctgttaatctaagctttactgtgtaactttttagtcaatactagatgtgttaagcaataaccatcagaatgattcctaactaaagagaggagctcctgggatcatggcgaagggaggcaggactagattgcagctctggacagagcagcatgtggtggcttgcattgtgaatttgagctccagatccactgcaagaacaaaccagcaatcccgagaggacccacagaccctctgaaggaagcggattgctcctgcaggccccaggagacccccaaatactgtgagtgccccaactgtgcaagtgggaaagggagaccctcctctcctgaacacacacccccactggagaagctgaaggtctgtttgctggagaagtttctgaccttacctgagctgaatcaagttagagagccaagcctagtgaattacaggggtagagaatgcagcagaaaggccctgggagctccctgggtccttaagtagcccattcctgcctggcaccacaaggatccattgggagggtggctagaggagcagggggtaaaaccccacagggaaaggaattctctagcctaactttctaacaatttgaacgcggtgagaagcctgctggccagaactccggggagggtgcaaatccagctcgcagacttcacaggtggaaggaagaactaaagcccttttctttcgtagctgagaggtggatagcctcggggaagttttcaagcccatctagccctcagcctggaaacagactcccggcagttaggggggacacggtgggagtgagagtggcccttctgtttgcgtgggagctgggtgagggctccgactgctggctttcccccacttccctgacaaccttcatgactcagcagaggcagccataatcctcctaagtacacaactccagtaaactgggaatctcacccccaattccccacagcagccccagcacgacccaaccaaggagctgctgagctcatacacacctagccccacccccacctgatggtccttccctatccaccctggtagcaaaagacaaagggcatttaatcttgggagttctagggccctgcccaccgcatatctttctctgtactactacagctgatgctttctggaaagcgccacctcctggcaggaggccaaccagcacaaaaatagagcattaaaacatggccaaccagtacaaaaatagagcattaaaccaccaaagctaaggaccctcacggagtccactgcaccctccaccacctgcaccagaaaaggcgctggtatccatggctgagagacccatagatggttcacatcacaggactctgtgtagacaacccccagtaccggcctggagccagggagactcgctgggtggctagacccagaagagagacaacaatcactgcagttcggctcacaggaagccacatccataggaaaaggaggagtatactacatcaagggaacaccccgtgggacaaaagaatctgaacaacagtcttcagccctagaccttccctctgacagagcctacccaaatgagaaggaaccagaaaaccaaccctggtaatatgacaaaacaaggctcttcaacacccccccaaaatttctctagttcaccagcaatagatccaaaccaagaagaaatccctgatttacctgacaaagaattcaggaggttagatattaagctaatcagggagggaccagagaaaggtgaagcccagtgcaaggaaatccaaaaaatgatataagaagtgaagggagaaatattcaaagaaatagatagcataaagaaaaaaaacaataaaaaattcaggaaactttggacacacttttagaaatgcaaaatgctctggaaagtctcagcgatagaactaaacaagtagaagaaagaaattcagagctcgaagacaaggtcttcgaattaacccaatccaacaaagacaaagaaaaaagaatacgaaaatatgaacaaagcctccaagaagtctgggattatgttaaatgaccacacctaagaataatcagtgttcctgaggaagaagagaattctaaaagcttggaaaacatatctgggtggataattgaggaaaacttccctggccttgctagagacgtagacatccaaatacagaagcataaagatcacctgggaaattcatctcaaaaagatcttcgcgtaggcacattgtcatgaggttatccaaagttaagatgaaggaaagaattttaagagctgtgaaacagtagtaccaggtagcctataaaagaaaacctatcagattaacagcagatttctcagcagaaaccctataagctagaagggattggggccctaacttcagactcctcaaacaaaacaattatcagccaagaattttgtatccagcaaaattaagcatcatatatgaaggaaagatacagtctttttcagacaaacacatgctgagagaattcgccatcaccaagccaccactagaagaactgctaaaaggagctccaagtcttgaaacaaatcctggaaacacatcaaaacagaacctcttcaaagcataaatcacacagggcctatagaacaaaaatgcaagttaaaaagcaaaaacaaaacaacaacaaacaaaagtacagaggcaacaaggagcatgatgaatggaaccataccgcacatttcaatgctaaaattgaatgtaaatggcctaaatgctccacttaaaagatacagaaccacagaatggataagaattcaccaatcaactatctattgccttcaggatactcacctaacacataagcactcacatacggtaaaggggtgggaaaaggcatttcatgcaaatggacaccaaaagccagcaaggtattcttacatcagacaaaacaaactttaaagcaacagcagttaaaagagacaaagagggacattatataatggtaaaaggccttgtccaacaggaagatatcacaatcctaaacatatatgcacttaacactggagctcccaaatttataaaacaattactaatagacctaagaaatgagacagcaacacaataatagtgggggacttcaatactccaatgaccagacaggtcatcaacacagaaggtcaacaaagaaacaatgaatttaaactataccttggaacaaatggacttgacagatatatacagacatttcatccaacaactgcagaatatacattctattcaacagcacatggaactttctccaagatagatcatatgacaggcaacaaaacgagtctcaatagatttaagaaaactgaaattatatcaagcactctctcagaccacagcggcataaaactggaaatcaactccaaagggaagcttcaaaaccatgcaaatacatggaaattaaataacctgctcctgaatgagcattgggtcaaaaacgaaatcaagatagaaattaaaaaattcttcgaactgaatgacaataatgacacaacctatcaaaacctctgcgatggagcaagggtggtgctaagaggaaagttcacagtcctaaatgcctacatcaaaaagtctgaaagagcacaatctaaggtcacacctcaaggaactagagaaactagaacaaagcaaacccaaacccagcagaagaaaggaaataaccaagatcagagcaaaactaaatgaaattgaaacaaacaaaaaaaatacaaaagataaatgaaacaaaaagctggttctttgaaaagataaataaaattgatatatcattagcaagattaaccaagaaaagaagagagaaaatccaaatgacctcattaagaaatgaaatgggagatactacaactgacaccactgaaatacaaaagatcattcaaggctactacgaatacatttacagacataaactagaaagtctagaagagatggatacattcctggaaaaatacaaccctcctagcttaaatcaggaagaatgagataccctgaacagacccagcgagattgaaatggtaatttaataattaccactaaaaaaaaagtccaggaccagacagattcacggcagaattctaccagacatttaaagaattggtaccaatccttttgacactattccacaagaaagagaaagagggaaccctacctaattcattatatgaagccagcatcacactaatatcaaaaccaggaaaggacataaccaaaaagagaaaactacagaacgatatccttgatgaacacagatgctaaaatccttaacaaaatactagctaaccaaatccaagaacatgtcaaaaagataatccaccatgatcaagtgggtttcataccagggatgcagggatggtttaacatacgtaagtcaataaatgtgatacaccacataaacaggattaaaaacaaaaatcacatgatcatctcaatagatgcagaaaaagcattcaacaaaatccagcatcctttatgattaaaattctcagcaaaatcggcatacaagggtcataccttaatgtaataaaagccctctatgacaaacccacagccaacataatactgaatggggaaaagttgaaagcattccctctgagaattaaaacaagacaaggatgcccactctcaccactccccttcaacatagtactggaagtcctagccagagcaatcagacaagaggaagaaataaagggcatccaagtcagtaaagaggaagtcaaactttcactgtttgctgatgatatgattgtttaccttgaaaaccctaaggactcctctagaaagctcacggaactgataaaagaattcaacaaagtttctggatacaagattaatgtacacgaatcagtagctcttctatacaccaacagcgaccaagtggagaatcaaataaaagaactcaaccccttttacaatagctccaaaaaaaaaaaaaaaaaaaaaaacttaggaagacacctaacaaaggaattgaaagatctctacaaggaaaactacaaaacactgctcaaagaaatcacagatgacacaaacaaatggaaacatatcccatgctcatggatgggtagaatcaatattgtgaaaatgactatactgccaaaagcaatctacaaattcaatgcaatccccatcaaaataccactatcattcttcacagaattagaaaaaaaaatctaaaattcatatggaaccaaaaaagagcctgcatagccaaagcaagactaagtgaaaagaacaaatctggaggcatcacattacctgatttcaaactatactataaggccatagtcaccaaaatagtgtggtactggtataaaaataggcacatagaccaatggaacacaatagagaacccagaaataaacccaaatacctacagccaactgatctttgacaaagcaaacaaaaacataaagtggggaaaggacattcttttcaacaaatcatgctggaataatcagctagccgcatgtaggagaatgaaactggatcctcatctctcaccttatacaaaaaatcaactacacatgtactaaggacttaaacttaagacctgaaactataaaaattctagaagataacattggaaaaacctttctagacattggcttaggcaaggatttcatgacagagaacccaaaagtaaatgcaataacaacaaagataaatagctgggacctaattaaactaaagagcttttgcatggcaaaagtaacagtcagcagagtaaacaaacaacccacagaattgggagaaaatcttcacaatctatacatctgacaaaggactaatatccagaatctacaacaaactcaaacaaatcagtaggaaaaaaacaatcccatcaaaaagtgggctaaggacatgaatagacagttctcaaaagaagatatataaatggccaacaaacatatgaaaaaatgctcaacatcactaatgatcaggggaatgcaaatcaaaaccacaatgtgataccatctcactcctgcaagaatggccataatcaaaaaatcaaaaaacagtagatgttggcatggacgtggtgaacagggaacacttctgcactgctggtaggaatgtaaactagtacagcctctatggaaaacaatgtggagattccttaaagaactaaaagtagaactaacattggatctagcaatcccactactgggtatctactcagagaaaaagaagtcattatttgaaaaagatacttacacacgtttatagcagcaaaattcacaattgcaaaattgtggaaccaacccaaatgcccatcaatcaacaagtgaataaagaaactgtggtatgtaagtatgtatgtatatgtgtgtgtatatatatatatatgatgaaatacaatgcagccataaaaaggaatgaattaacagcatctgcagtgacctggatgagactggagactattattctaagtgaagtaacttgggaatggaaaacaaaacatcatatgttctcactgatatgtgggagctaagctatgaggatgcaaaggcatagaatgatacaatggactctgaggacttggggggaagagtgggaggggggcgagggattaaaagactacaaatatggtacagtgtatactgcttgggtgataggtacaccaaaatctcacaaatcaccactaaataacttattcatgtaaccaaataccacctgtaccccaataactgatggaaaaattaaaaataataaaaataaaaaggtttattggcaaaaaaagaatgattcctaactaaagacaaaacaaagttcattaggaatattatttttatatatttacttttattaatataaaaacctttataatctattttatagtggataataaatacactctcgagaatactgaagcaaaatctggtactcactaaataggggaaattaaaatatttaatgggctttgtgtgatcaaattcctcttggaatttaaaatgcagatcagggaaagatatgacacttaaagttctaaattaaataactgaataagaaaattcatgaaaaccaatttaacaataatataaatggtttcacaaactgaaatcttccataagacaaatcatgatcccatatttattgactactcaccatacttcgtggtatgttcaactttcattgaatctattaactttaaaagaaatgatagcagttgtttagcgcccaggcccttcttgacaaatactgaacttgcttctctgaagagtgcattaaggagcatctgactagaagtcaagatgtcatgtattcttaggaaataaagattgtggtctccagttccgtagatactaacattgggacagcttcaggaaggaaatgctgttaaggcttttaactacagaccctacagaatcttagtaacaactcatgcctcaatgggaaaatgaattcagagttccaacttgaattgctagcaatatgttttgccccattctcccccagccccctgcctgtcagggagggagaagagattcctgtacctcaaagccatttgtggtagctccaacaatctggggaaagggccccaaaagtaggatagtaccacgtaaggcaaacagtaagccagttagacatgttgaggtaatctcagcactttgccggacctttttcccggggaagtctcacaatgcaacactcaagtatactgtagtttattttgtctgtaagggcaaatcttatgcattctaaacattctcaacaaccatcttagaaatgagcctctggaacacagtcatatgtaagacgtaactgccatactcaaaagacattttttcaactaatactgaggtaagtgacaagttgattgacaataaaggaaaactgccagagttcgcatttaataaattattttaaaatgagaatccattctacaatcaactttcagagagttaaacgatctctgggttaatgaccatatcacctccctcaaaattttacagataaactaaggcagacagcagttaagagatttcccaaaagtcagaggacttaacagctaggtctgcagagtcctatccaatgtttttcctaatactgcatacaatttttgacagactactcacaaccaaactatatctttcagaattctacctttcagagcattttagcgattaggtctggcacaacttacaactgtaactagacggttttctgtgtggacaggacagaaaactgactaattacagctgtacttagtgccaactcccaggcacgcctccaagcaccacaaacttcttgcccccccacaaacttctcaagatgttttacagctttgttatctttttccatgtttccacattgtacatttataccaaaaagtaaatgacttggaagaaaaatgttgctcctcttgaaaagaagtatgtacattttaacaagaagtaacaccttcagctctaaagagcatcagaaatttcagcatcggagggttaagaattggctctgaactagatgttctatatttaaaatgtgggaatataataatccttaactagtgaatatggaaataaatggttgtgctgttcctatatttattctgtattatgcatttaagctaagttaaagtagaaaaatgtgtttaatgaaatatttccaatttatgtagaattgtgtaaagaaaactaaaaaaaaaaacatgtataacagcagtaaggcagtagttctgggggaagaatggaaatctaagacagcaatggcccagaaaggtgtacatattattttttcatatttcagggtgtcaataaacaacattgcctatttcgctacccctctccccaagcccatgaaatcttggttaacatgccattccggctgccttgaaacctggggcgctgacctagggaggagaggttactctggctccttgcagaacaaagctggccaggaaataaaggaaactcaggcatagggcagccaggcaaaattttaatagaaattcagaggaagtcacactaaaacgcaccaaacttaagcctttcaacaggtagttcatttttcctaaaaacaaacaaattcggcaaccagatatctcaggaagaacctgtgtttggccctgagcaccgcaaaagggtagaaattctgagatattgtagctatagagagagagacggcatttaaaggaactatgaaggttcatccaggtaaatcatctccccggctttctatccctgttagaaggaatgtgctagatgttttacactgactactacatccctcctcaaaagagacctttggatttttatagcatgatgatgatgatgataatctggctaacacctacagtgattaattactacacatcaggcactattgtaagcactctaggtaagtagagtagttagtttaatcctcctaacaatctcctaagtaacattattatccctagttgacacatattggaaactgaagcacagtaaggttaggtcattgctcaaagtcacagagttactaagtgtcagggccaggattcagactcatgcaatccctttgtattctatatacaaatttctattctccaaagcagacattgacttctctctccaataagccagctcttccttcttcattcctctttcagtaaatggcctctacccagtgactgaggtgagaaaccagaatagcacttcatctagtgcctagtcaattctccctcttgaccacttactggttcacctctgcatctgctgctctatgaccttgggtactcgacttcctctttctaagcctcagtttctcatctatacaactgagttcataagagtagctgtagttgttgcgaatatcaacattaaacgagataattcatgtaaaatgcatagcacagtgcctggcagattgcaggaaaatcaattattattagatattatcatcatcaccttgaatctggtccttccccctaatcttacacctaagcatccttagaccttcaactcctctcttacttgcaatactaacaacctcctacttgatcacactgtctggtctattttctgtttaatctaaatatgctaccactaaaaatgttactcatatcccttggaatgacaaatgtcactccaattcatagggaagaagatcccaactgcttattatcaaagtatgcaatacctgctacaatttagcttttccaaactcccaacacataacacgttgtaccaccctgcaattccttcaaagggtatacactttctcaactaattttttatcatgttgctatggaaattcccattaattcccaattaattacttttccatatgcctctatcttatcactcaccacactgtactgtattgtttcttttaaaactagattatacttttcttaagaaaggaaaccagatcttatttgatcagaaaaatatgagcatctaacacagtaccacagatacaagagttcaataaataaacaccagttcatttaatactaactttgatagaaaacattttaatattcaaatacctttaggaaatgttcccccaggtaaggctctgagaaacagacacatttacaaaagccactctctattccacaattagcatttaaggcactaccgaaacaccttaaaaaccttaccaaacatttttcatattaaaaccaaaaaccttcagcaataaaattttggatgcttattcatactgttaaagataatccaaagcatacagtttaaaagttcttgaaaatcaattataagcatgatagttttccatacctcctgaggaatgctaaaaacagcttggagccttatcctaaatgtgaaatgaaaataataaaaataatttatgtagctgtactataataataaacttttttcatatatattttgcataaggttaaagattctgcaaaataagttttagaagattctgcaaaataagttttagacatactgaacacagatatttataagctttaaatacaccttgcacgtatagatagcacgtttcctcttatttcataattcttaagaaacaaaaaaattagcttcccttcaaaagaaagaaaaaacaataattgaggcagtcaattacagaaaaatgtgtttactgttataaaacatttcacaccaagaaagataaccacaagttcaaactcagatctggtggctgaatctactgttctataaccatgtgtgaagatggatagttaggggagcagagcacagaacagaaataagaaagaaatatatataaatattttctgagcacaggcatttcaaattccacccacataatttttttccctaccacactgggtagtttctatcatactcggtagtttctatcactgtggtctaaatgtagacttgtataaagaaaaagggttaaagttaaaggggtaaaataaggaaattacatattgaaaaccaaacactatgggtttctatgatgcacagacatcttttggttatgagatcactttcttaaaatacattaaaattttcaaatggttggtagtataacagaaagaatagtagactaaaagtcaagagattctcagttttctgttttgccttgttctctttaggatctcaggcaaggtgcttaacctttctgatgcccattattcttacagatatttaaaaaacaaaaactagatgatctctaaatgcctctttgggttgtgaacttttatgagagtacaacattcagaaaatgtagtaagtatcaacattaatttaagattaaaattatacatcttcaatgtttccttaaactgtgcataatcaggttttatcaaaactgccttactgggttctgttttttaaaaaataaggtgaagagaaaataaatatatttcagtaatgtggagcaaatgactttagaaacattctccaaaatgtttaaataaggctaatagagaaatatttcaagactaattatcagtattactgtctttggaagcatcactaagcagaaattcaggaaatggcaaaagattttaatcttgaacaaactctaagtcataatgcagtaaaggtacaatgaagtctagacacttaaatatgaaaagtaggataagagtgagctgatggatataagcagctcttacaagttacacaggatatactgattttttttttttttttttttttgagatgaaatctcactcttgtcgcccaggctggaatgcagtggtgcgatctcggctcactgcagcctccacctcctaggttcaagcgattctcatgcctcagcctcctcagtagctgggattacaggtgtgcgtcaccacacctagctaattttttgtatttttagtagagatggggtttcaccatgttggccaggttggtcttgaacaataggcataaaccagagccatcttaggcaaatcaagatgtttggtcataccagtgataagtaaccagagaagctatcaccttagaaatggttgtggatgttgaaaataagtgaattgagccctcaactagatgggcatgagtggagattactagcctaagatgactttctctagtcacatgatattgccctgaaatatcatgggctatttcttctgggtacatcttcctatataaggatgttgggatttgaagaaagttctagattcatctctagatgaacattcagaagtcattaacatataggtggtatatgaaagcttagaaatagatgagatcatcaaaggaaagcacaaagaaagagaaatgaggaggaggagagaatccagaggctcaccaacatgaaggagctggcaaagaagaatccagccaatgagactgaagaggagtggttagaggggtacgaggaaaaccaaaaaagaggggggtgtgtctgtgggtgtgtgtgcgcgtgtgcacacaggtgtatatatatacacacacacacgtatatatacacaaacatatgtaaatacacacacacacacacacacacacacacacacacacacacacatatatatataaaatttcacaagccaagagagaagagagggttaagaaatgaatggttaatattttcatatgcatcactttgggggccaggaagacaagtcagtattctcctagtttcccaagatgacttgtaagtcattgttattcgattttatccacttttaagattacattatagctatatttatagttgtcacctactgacctttgagtcagccatctccatttactgagaattttgtcgtatgactatcttcctttccacacagaagctatatattctggggacttcattatccataagaacaattgattccaacacacaagacttaatgctctttgccttcttcttcaatgacccctactttgcagaaggctagcatggtttagtagtcaggcataagtgcttcaatgctagaaggactcagaaagactcaggtacttcgtagctgtgagtcttgggaaaagttactcaatctcactgagctccagtttcctcatctgtaaaatgttgatactaatatgtgaaacataagcatgataacctatggaaaatatttactatagtgactactacacagtgttcaatgaatagtagtttttattaatattaatattgttataattagcactattaatcttggctatccacccatcattggtcattctttggcccttatcatcacctgaaactgctaactccagaatcttaaattgagaattctcacatctatgtgccaatttttccatctctagtactcttttatttccattaatcctgcacttgactcatttagattcttcatcctcttcattatccacatttaccagccttgtcttggcttggctttgttccttaataagcaggattcctatggctcaacccttcaattagcagcctcattaccactctctattccttgacttcccactaccccctactcaagttttccatcacatcttcccttccaatctcaatccaggttcagtctacttgttttctgcattgttatgggggtggggaaggggagtggtccaagttcagtctatttgttttctgcattgttatggggggcagggaaggggagtgggagcaggcaggctgctggagaacactgcttaaccatcctgctggcctctgtacatttgtgatttcaagcctggaagggtattcatcatgattcagcaaagaagtcacatgcccctagttaagtcccttttacaatctcaatagtaacttttattttcccctcaagcatactccaacccatgttcttccttctcaatctcagcagataatcttgcttcacagagaaaaagagatgtcatcctggatactaacttatatctatatctaccccatttccttttcgtttttaaacaggaagatacatcattcctcttcttcagggtaactctttcatttgtcctcctggacctgactcttccatttcctctcgttacatttgatcaattatcttctacctcttgtgacttcaattttcttcctcttcaatggtccctttccctcaatccactgaagtgtccttggcttctccatccttaaaacagacaaaccttcccaatgatcacatctacttcctcaagcttctacccactaacctcccttcattaccaaaagtatttgaaagaatatatttactgaacaaatgaaaattgttttattgggtttaggcttctctcctgagcaccaggcctttttttttttttaaatgtatctatatctgactcagtttcaacaaaggaaataaaacagctaattccaccaaactgaagaaaactgatggatttcacatctccaaatccactcctccacccgtattttttaaattacgagtaattatctgcatccccattcaccctcagacaatctagaatccttaaagcctgctttgattcctccctctcctttatccataactacacaaggcctttctaaaatctctcacatctgtcccctttgcgccttcctgggattattactgttgaggtctttctcatcttacacgaattgaaagggatgttgtcagggttaaataaaataataaatgggaatgtactctgtaagttataaagtagtactatacaaagagtatcatacaaatactattacatctttggcaaagtaagcatgaagttagcttaatatgacttgttcttaaacaaattctgggtcttagtaatcagtgctttcttttctaattacaaatcactaagcacttggcaagctggtctatagtttttctaggaatcagtcagtgtcaagattttcaatatatagtttctggactttaccttcctctccccccatttttaaatgtaaaatatgcaattcttcaggtttctggcagaaatcttctatcctcttttttaaaaaaagactttattttttagaagagttttaggttcacaacaaaacagagaggcaattacagagtttccatgtacaccctgctctctcacacatgtacagcctccccaactatggacagcccccctaaactggtacatttgttataatcaatgaacctacactgacaggtcattatcacccaaagtccacagtttacattaggattcactcttgatgtggtatattctatgggtatcgacaaatgtataataacatgtagctaccactgtagtatcttcagaatagtttcaccgccctaaaaatcttctgtgctctgcgtattcatccctccttctctccaccactaatctttttactgtctccatagttttgcctttcccagaatgccatacacttgtaatcataaagtatgcagacttttcagtttgccttttttcacttagtgatatgcactaaagatttcttcatgtcttttcatggtcaagccacttttaaacacaactttacaggtataactgacatgtaacaaaccacatatttaaagtgcataatttgatatgttccaacatatgtgtacacccatgaaaccatcatcaaatcaagatagtaaacatatctagtatcccctgaagtttcctagtatgccactgttctccctctttcctgccccttccctctgtaacttatctccaggccagcattgatctttcttccattatagattaataggcattttctagaattttacagatggaacaatgcagtatgtactttttttttctttttggtctggctttttttcgtgctgtgtaattattttgagatttatccatgttgttgtgtgatctaaagttcattccttgttattgctaagtagtaatctgttatataaacattgctttttaaagatgagtggcagtagttttataaacatttctaatatgtgtagtactctaccctattgttcatttatttcttccattcagttaaaatagtgaaaagctctcttatgtcctcatccattttatgttttaatttcaaagaatcatatttgaatggaacaatgactagccttttgaaaattatttgattcctttcttgattaagataatcaattttaagcattaatctttcatgttattaggtaagatttttgtttttcagcagttagacctggaaagccttcaacatttccaaacgtattggacctctctcattactgtaaacaaagttgggggattaagagttacaaagccaaacactggtgacacacagcagcaaaataaaataatatcaaagacaatacagtgccctcaaagactccaagatcagtttataattagttattaatctgacagatttttatacatttttaagatatatttaggttgaaaatccattttaaaaaattagcttatttcctggttcttaaagtgtagaccttaaattccagaagactgatatatacatatatatgttttgtttgtttgttctgtttagagatgacgtgttgctgtgttgcccaggctggactcgaaccaggctcaagcgatcctcccacctcagtcttccaagtaactgggactataggcacaagccatggctcctggcttcggagactgatagactttttatccaagttttacagggcaaattctattgctacaaatactatataatttgatttagaagatcttcatttaacatgtgatggcccatttatttcaagccatctttactgaaacaaaacaattaggctaatccctgcatattactaacttaccagtgttaaatgaaatttataggaggtcactggtttagactgagttcctcctgcactagggacaacagatcaaatcaaaatggagtcactcatgctgaagttccacttcaccaagccaaaactaagttgtttatctgaccttccaagcaatcaggagagacagagttagtagtcaaatcccaaacaggccagttgatatgatatgatatgactgacataaggaagtcccatctgctttaaccctaataagaaaagtaactttaaatgaccaatttgctttttcttttctgtttctgttttcctcaccccttttcagtgtatacggtagtatccctttatccgcagattcattttccaaggtttcagttacctgaggtcaactgtggtctgaaaatattaaatggaaaattccagaaataattcataatttcaaattgcaccctgttctgagtagcatgatgaaatctcatcctgccctatagtgtatataggattcagtactatccaccatttcaggcttccactggggatcttagaacatatctccccaaggccgggtgcggtggctcatgcctgtaatcccagcactttgggaggccaagatgggcagatcacttgaggtcagcagttcgagaccagcctgggcaacacggtgaaaccccatgtctactaaaattacaaaaattagccgggcatggtggcaggcatctgtagtcccagctactcaggaggctgaggcaggagaatcgcttgaacctaggagccggagtttgcagtaagctgagatcaccccactgcactctggcctgggcaacacagcaagtctccatctcaaaacaaacaaacacacacacacacacacacacacacacacacacacacacaccccttcaagataaagtgagactaccataaaaccaaccacttctgctcggctcatgagaacacttgttctattttataaaatgaggtgttgcctgattctacaatggcaaaggtgaagtaagatctttaagctaaatttgttgtaattttgtcttttgacattacaaagtattaaaaatgagtcatttcctttgtaattttgcaaatggccaagtaaagccacacttgataacattttagggcttaaaaaaaatcttgaacttggcccagcacggtggctcacgcctgtaatccaggcacagttgggggccgaggagggcagatgatgaggtcaggagattgagatcatccaggctaacacagtgaaaccccatctctgctaaaaacacaaaaaatcagccgggtgtggtggcacacacctgtagtcccagctactctggaggctgaggcaggagaattggctgaacctgggaggtggaggttgcagtgaaccaagatctcgcctctacactccagcctgggtgacagagcgagactctgtctccacggaaatctttagtaaaaggcgaaagatttatacaatttgaagagaaaccagagaatgactctgtctaaaaaaaaaaaaaatgttgaacttaagccggcaaccagataattcaggaaaagattaatcagatgaaggtgttcaagttaaatacagcaacagaccaaaaaggtactctgaaattccagactatatggctctctctacaaccgaagctaacaaacacactatgtgagtgcaatcaaacaaaaataaaactacaattgggaaaagaatgactaggttggtccaaaagaattaagaagaaaataatcatgaaatcaaagctggcagtttatgggtgaaatttttaaccccctggtatagtcaaggtaacgtaaaaagtgtcttcaaaacaaagtcacttgtgtttactactaataatctcagctttgacaaaaattctttgcttggccaaacttactcaggcttttgaattttctgtgaggcccatctgtgcacttccttgtaaaatccagtattagcaaagaaccctgctaagtctgtttagcataacatcctggatatctaatcatcctaaatatctgatcaggttcctcatcctccaccattccccaggtaatgtctgatcgccctggcctgtcttcagcaagaatcccgttaggtcggcttagccagaatcccccttatccctgatgtttccttttagcaattttccatccacgatccccacactgctgcttggctataaattcccattttctcatgctgtattcggagttgagcccagtctccctcccctactgcagggccccactgcagaggtctctatacctattgagatggttctgaataaagccttacttaccattcttaaacaagtatcattgaatatttttttctttaaaaacgtgaatgtctaattttattgtcttctaaccaactcccacccttctccccaccaaacctactcctctcgtaaacctaatctcagtaaacaagtaccccatctttctacttgttcggaactaaattttggtgtcttttacatctctaccctcaatttatcctgaaatcaatgacctctcaccacctccaccaattccactctggtccaagctacattatctctggcctggattagggcaacagttccggattggtatcccagcttctgctcctgctcaacccttcccctacaacaaagtctattctccatccagcgcccagaatgatcatttttaaaaggcaagcctggggccgagcgcagtggctcacgcctacaatcgcagaatgttgacacgccaaggtggatggatcgcttgagcccaggagtttgagaccagcctgggcaacaatggcgaaaccccatctttacaaaaaattagccaagcatggtgggtgatgtgtgcctgaagtcccaattacttcagaggctgaggtgagaggatcacctgagcctgggaagtcgaggctgcagtaggttgtgatcatgccactgcactccagcctgggagacaaagtgagatcctgactcaaaactaaaaataaaaggtaaggttctttactcaaagagtggactcccctttccactgagagtagaaactcaagtccttaaaagggcctacaaggccttatacagtctaatctcccaccacactcacctctttgactttatttctactcctctttgctttttccaccacagccaaatcagcctctctgctgtcctcaaacaagcccagcacacagggcttctgcaagcccttctgccttcctctctgctagcacatccttccctcagagaggtacatggattacccctcacttacttctggtcttggctcaaatgatatcttttctaggaagctttccctggctgcctctagttaaaattgcaaacctctcccggttccctgccctccctcttccctgccctccctcttccgtgctttttctctgtagtacttaacaccatctgacacagcacatattttatttgtttattatctgaggtccccactagaatataagctccatgaaggagcagatatttatgttttcttagaaaagtatctgacacgcagtaggtgctcaataaatatttactaaatacatatatataattatatagtttgtgaagtatttttatgcaaattacagcaattcatttttccttatgccctctcttcttcaaattctccaatctttgtagtaacaatatggatgacagcaaagagctatcagaaaaagagttgttggccacttaacaaagctctttaaaacagataccccatattaatcaactacatctataaattgaaagcttaaagtcaacatctttattagcatagatgaatctaggcgtggaattttaaaataatagcgcagaagagccaagaatcatcaggaagaaaagtctaattcagtttgtcctatcaatctgttaaacaaacaataggaaaatgcaacctgcatttgatcttcaaggaaacactggcccaaattcaacacgaacgcattcaacacaagattcgactcccttaaaattttctatctgcttaaaacaaaccccattaactatcaagtgccgtcgctgggtgtgtatggtctgccgagcggatcggggatgttttgctatgttttgtttaaccagataagaattagcgttaaggaaacgtttcttaaagcctctgtatcccctggaccattaaacaaccccttcgttgggctttacactgtggtaccggggtcttctcgggtaatttcccagcttatttaactcatcagaagcgaaggggcatctcagtcaggctccagtgataccggagacagacggcagatgtctcaggggatcccctggaaagagaggctctcgcccagtcaaagggtgtcacggacaggaggaaagagcggaccgaggcgcacggtgtaggtgacaggtgggcgagcgccgcagggcaacagcgcggggagtgaccggctgggtggtggcgcggaaaccgtcaactcccatcgtcaacctgacagcttgggcccagctgggctgagtagtgcagcggcacaggatcaaaaaataaaataaaggtagcaacacaccgccgtcagcctgctcgacctcgccccccgcgcgctgcgaaataaagttagtgcccagtggccgctgcaatggcccagaggggcccagccgagctcccgcccgcggcccggcggctgtcaaaggcggcccggcgccgcgagaagtcccagagcccagaagccagagaggacgccccgagctggcgcgtcaggccgagtgccctcgcgccctcgcgccctcagcccggcggtcccggccctcaacccaggctgacagccaccagccccaaaccgcctcccctccaggccacgcagaggggccgggacccggaaccttctgccggcagcgtcggcgcccggcggccgcctttacctggtttgtggcagctgcggccgccgcgcactccccctctcccggagaaccccgagccgacgccgctgccgccgccgc

SEQ ID NO: 1852 - DNA, 5805 bp, Homo sapiens
ctgggggtcagagagaagggagaggcctccttctgaggggcggcttgataccggtggaggtaagctggccgaggctctgtgaggagtcaaggtgaggtgctgagggaagactgaggatgtccccaccccagatagaggacccgaaagaaccaagtgccgtctctgctcccagccctggaccacccgggggccgatctggggctgacttgtgaggctgggccgaccccctccctccgccgctcaagctgctgggcactctggagtgagagcttggtgtgaccagggcagggctggttaggagagggcagggcccaggctctgccgggcatcaaggccaggaccctgagggaggctgggcccccccaacccaaccatgacctacagccccaggttccccagccccatcctcagctccactctacaccccaccccaccccaccccaccccaccccaccccaaactccaccccacccccccaactctcccgcggcagaatctggttccgcccctgttgtcaacccagggaagccccaggtgcccggatgtacggccagtgactcccacactgggggtcagagagtagcgggggcctcgctgtgaggggcgggtcgatatcggtggagggaagcgggcccaggctctgtgaggaggcaaggtgagaccctgagggaggactcaagaccccccgccccagatagaggaccccaaataatacagcgccgcccctgtgccagccctggaccaccccgcggggtcgggcgtatcaggctgggcccaggctctgactggcatcaaggtcagaaccctgagggagggctgaacgcctccacacccctaacccagccaccaccaccatgacctacagcctcaggttccccacctccatcctcaccccccccccactccaccccacccccaagtctcccgtggcagaatccggttcggctcctgctgtcaacccagggaagctccgggtgcccggatgtaaggcctctgacttgcgcactgggggtcagagagtagcaagggcttggttctgagtggtggctgaagatcggcagagggaagcgggcccaggctctgtgaggaggcaagatgagacgctgagggaggactgaggacgcccccaccccagatagagggccccaaataatccagcagcacccctgctgccagccctgaaccaccccgggggcggacttctcaggctgtgggccacccttcgccaccccaccacttaagccccaggggactctgggtcagagcttggtgtgaccagggcaggactggttaagagagggcaggggccaggctctgccaggcatcagggccaggaccctgagggagggctgaggccccatagagggagtcactgcccctgcagtggaccctgggaagttccgggcatggcggtcaggcaagcggatcgtgatatctgcatcctgggctgaccgagggaaggggcttggtatcgttagcgtggccgcgggagaacagagggagggcccaggtcctgctgggagacaagggaggcctgaggggacccagtaccccaggacaaggggcccaccccgcccctatctgagaccgaggcccctcctcattcagcctcgggaatccgacagatagagactcaggtccacagaggggtggggcccagccctctaggagaccagggaaggaacaagacggaggacagaggggaccccggagtccagctcagtggggatcttggcctgggcgatcccgggcacggtggccgcatgtggtgcattgtggctggtgggatcgggtgtcaatgggaacagggctgtggtatgaggagtggggcctcaggtgagcagaaggaggagtcccagaggcctgaggaaggattcaccagacctctcatcccagacctaggaaacctgcccctgccgtcagtcttggaaggccccaggcaggacggtgaggaagggaagtgccccctccacccccaacacacactttctcaaagagggtctaagggagaaattggccttggtctgcaagactcacctctggttcagcaaaatggaaggggccagattctgtcagaagcaaatatgaatacctagaggacacccagaccgacgaggccccctggaacctgctcctttggtcagccttgggtatctcatgcatgagtgaccatgaggtggcccctcacttctgcctcccgggtctccgggaggtgggggccttggtccgaggggtttcctcagctcagcagagggagccacacctggtcagcacagggtggaatccagggtcttccaggagtgacggggaggaagtttggtgaggactgaaggtaagaaggtacctccacgctctcaaaaaagaaaggacctcacagacactggtgtcacctgttctcagccccaggtggccccaggcaggaatggcatgaggcatgctctcatttctcccacgtgactgggggtgagaggtctcagggaggtgagtaccttgatcccagggggcactgagagatccaacagagggctccacacctggtcagtagaaggaggactcccaggatcagcaggacccaaggtgtgcccccttcatgaggaatggaggtacccccaacgcagaaagaagccaccccacagagtctaggtgaactctgttcttagatctgggggcgggggggggcctgatcaaggatggtgctaagtggcaagctcatttgtaccacggcaggaagttgaggaaccctcagggggatgaggcgttggtgtaaagggagatgtctgctcatctcaagggtttgagggtcgaggaagtagaagccccagcaggagtaaagatgaataacccgcaggaggactttggaacacccacctcatacctgaagggttcagctggtggggtcagccccggacaccccacgcaggggtgacatatgtggggcctcctcacctctgtttctggatctcagggaggtgaggactttgttctcagagggtgtgtgtggacaaaacagggaggccctgtgttcgacagacacagtggtcccaggattggagagcagtccaggtgaggaacctaagggaggatcgagggtacctccaggccagagaaactctcagatcaagagagtttgccctgcccctactgtcaccccagagagcccgggcagggctgtctgctgaggtccctcctttatcctgggatcactggtgtcggggagggctggccttggtctgagggggctgcactcacgtcagcagagggagggtcccaggccctgccaggagtccaggtgcagactgaggggaccccactcaccaaacacagaggacctagccccaccctgccccttgtgtcagctgagggaagccgctgggtggatggactcccctcacttcctcttcaggtgtctcctggagatagggcctcaggtcaacagagggagggttccagaccctgcaggcatcaagatgaggaccaggcagtatcctcaccccaggacacatggaccccattgaatttagacatctcttactgtacttccgaggaaaccctgggcaggtgtgggcagatgttggttggggcatgtccttctgttctatatcagggatgtgagctcctgatctgagagactctcaggcaagtagaggagtagagtccagtccctgccaggagaaaggtcagggccctgagtgagcgcagaggggaccatccaccccaaaagtgtgtagaactcaagagtgtccagcccgccctcttgacagcactgagggaccggggctctgcctgcagtctgcagcctaagggcccctcgattcctcttccaggagctccaggaagcaggcaggccttggtctgagacagtgtcctcaggtcgcagagcagaggagacccaggcagtgtcagcagtgaaggtgaagtgttcaccctgaatgtgcaccaagggccccacctgccccagcacacatgggaccccatagcacctggccccattccccctactgtcactcatagagccttgatctctgcaggctagctgcacgctgagtagccctctcacttcctccctcaggttctcgggacaggctaaccaggaggacaggagccccaagaggccccagagcagcactgacgaagacctgtaagtcagcctttgttagaacctccaaggttcggttctcagctgaagtctctcacacactccctctctccccaggcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaacatatacatgtatacctggatttgcttggcttctttgagcatgtaagagaaataaaaattgaaagaataa

SEQ ID NO: 1853 - DNA, 5807 bp, Homo sapiens
ttattctttcaatttttatttctcttacatgctcaaagaagccaagcaaatccaggtatacatgtatatattttaattttacaggagagagaaagaggtataaggcaagaattaactacattttcatttcactatttctttatgagctctattttgctgctaagttcaagtttcaaaaaaattattaattcctctgctatgttatcttgtcccaattcacaaaataacagggatttccccatgtgactcaaaagcaagaatcttactcctaaataacataaacagcaatatgtgtgactactgtcattcattaacttcgatggtgaagttcattaaactgaccattaaaagaacatttgaacaattccaaaagggagcaaggataaatctccaaatcacccaatagacaaggaacccagagatgacatacagtgtgctcacttccacccactgccactgagaacactgattgctctcttcaaacacagagccaagaatgggcctcatgtcacatggggcagggcagctgctggatggggccctgaccccacaaactttggccccggctgcggctggtgctcagactccctcttgctcctctcccaaaacctcttcataaagggatgggtagcagatgggctctcttgcattgagcatgaccaaataatttatgaccttctcatagctggtttcagcgtgggccttggaaccccacaggaactcgtagtgcgcaggatcactgccgggcacctgccggtactccaggtagttttcctgcacccaatcttgggtgagcagcttcctgggctccccgtagaacatgtgctccttcccaacatacacccccatcacactcaacgcttcccagataacctcttcaggggcgcagttgtctttggttaggatcacacccaggacaatgatcaggagggcggccttgggcatgctatgaccatcacccagcatgctatcgcacgagaggccaagagcagtgacaaggatgtaggagtggccggcggggtccacctccttcacatcagtgccaaagatcacctgcatgaactcggaggctttgccgaagatcacaggaaagtagcgcttgtaatttttgatgacgctctccagcatttctgcctttgtgaccggctccttgactcgatatttgtggagcaggaaatgaaccaactcagccaccttcaatttcagtgcttcttggaacatgaactccagctgagctgggtcgaccgaggagcttggctcttcctcttcttgactgctggagccctcatcgaattggctccataaagtgtagtagacggaaatggaggaggaagcgcctccctgaggactctggggaggacttgatgacccagcagcagacacctcctcctccttgctgtcagaggaggaggtagtctcctcctcctcgcctgtgggttcctgtgcacccatcaggcccaagtcctctccttgggcttcaaggtcttcatcaggcttgcagtgcggactcctctgctcgagagacatgatgactctggtcagggcagcagtcaggagcgtgggcaggagctgggcgatggagacccacaggcctggggagagagggagtgtgtgagagacttcagctgagaaccgaaccttggaggttctaacaaaggctgacttacaggtcttcgtcagtgctgctctggggcctcttggggctcctgtcctcctggttagcctgtcccgagaacctgagggaggaagtgagagggctactcagcgtgcagctagcctgcagagatcaaggctctatgagtgacagtagggggaatggggccaggtgctatggggtcccatgtgtgctggggcaggtggggcccttggtgcacattcagggtgaacacttcaccttcactgctgacactgcctgggtctcctctgctctgcgacctgaggacactgtctcagaccaaggcctgcctgcttcctggagctcctggaagaggaatcgaggggcccttaggctgcagactgcaggcagagccccggtccctcagtgctgtcaagagggcgggctggacactcttgagttctacacacttttggggtggatggtcccctctgcgctcactcagggccctgacctttctcctggcagggactggactctactcctctacttgcctgagagtctctcagatcaggagctcacatccctgatatggaacagaaggacatgccccaaccaacatctgcccacacctgcccagggtttcctcggaagtacagtaagagatgtctaaattcaatggggtccatgtgtcctggggtgaggatactgcctggtcctcatcttgatgcctgcagggtctggaaccctccctctgttgacctgaggccctatctccaggagacacctgaagaggaagtgaggggagtccatccacccagcggcttccctcagctgacacaaggggcagggtggggctaggtcctctgtgtttggtgagtggggtcccctcagtctgcacctggactcctggcagggcctgggaccctccctctgctgacgtgagtgcagccccctcagaccaaggccagccctccccgacaccagtgatcccaggataaaggagggacctcagcagacagccctgcccgggctctctggggtgacagtaggggcagggcaaactctcttgatctgagagtttctctggcctggaggtaccctcgatcctcccttaggttcctcacctggactgctctccaatcctgggaccactgtgtctgtcgaacacagggcctccctgttttgtccacacacaccctctgagaacaaagtcctcacctccctgagatccagaaacagaggtgaggaggccccacatatgtcacccctgcgtggggtgtccggggctgaccccaccagctgaacccttcaggtatgaggtgggtgttccaaagtcctcctgcgggttattcatctttactcctgctggggcttctacttcctcgaccctcaaacccttgagatgagcagacatctccctttacaccaacgcctcatccccctgagggttcctcaacttcctgccgtggtacaaatgagcttgccacttagcaccatccttgatcaggcccccccccgcccccagatctaagaacagagttcacctagactctgtggggtggcttctttctgcgttgggggtacctccattcctcatgaagggggcacaccttgggtcctgctgatcctgggagtcctccttctactgaccaggtgtggagccctctgttggatctctcagtgccccctgggatcaaggtactcacctccctgagacctctcacccccagtcacgtgggagaaatgagagcatgcctcatgccattcctgcctggggccacctggggctgagaacaggtgacaccagtgtctgtgaggtcctttcttttttgagagcgtggaggtaccttcttaccttcagtcctcaccaaacttcctccccgtcactcctggaagaccctggattccaccctgtgctgaccaggtgtggctccctctgctgagctgaggaaacccctcggaccaaggcccccacctcccggagacccgggaggcagaagtgaggggccacctcatggtcactcatgcatgagatacccaaggctgaccaaaggagcaggttccagggggcctcgtcggtctgggtgtcctctaggtattcatatttgcttctgacagaatctggccccttccattttgctgaaccagaggtgagtcttgcagaccaaggccaatttctcccttagaccctctttgagaaagtgtgtgttgggggtggagggggcacttcccttcctcaccgtcctgcctggggccttccaagactgacggcaggggcaggtttcctaggtctgggatgagaggtctggtgaatccttcctcaggcctctgggactcctccttctgctcacctgaggccccactcctcataccacagccctgttcccattgacacccgatcccaccagccacaatgcaccacatgcggccaccgtgcccgggatcgcccaggccaagatccccactgagctggactccggggtcccctctgtcctccgtcttgttccttccctggtctcctagagggctgggccccacccctctgtggacctgagtctctatctgtcggattcccgaggctgaatgaggaggggcctcggtctcagataggggcggggtgggccccttgtcctggggtactgggtcccctcaggcctcccttgtctcccagcaggacctgggccctccctctgttctcccgcggccacgctaacgataccaagccccttccctcggtcagcccaggatgcagatatcacgatccgcttgcctgaccgccatgcccggaacttcccagggtccactgcaggggcagtgactccctctatggggcctcagccctccctcagggtcctggccctgatgcctggcagagcctggcccctgccctctcttaaccagtcctgccctggtcacaccaagctctgacccagagtcccctggggcttaagtggtggggtggcgaagggtggcccacagcctgagaagtccgcccccggggtggttcagggctggcagcaggggtgctgctggattatttggggccctctatctggggtgggggcgtcctcagtcctccctcagcgtctcatcttgcctcctcacagagcctgggcccgcttccctctgccgatcttcagccaccactcagaaccaagcccttgctactctctgacccccagtgcgcaagtcagaggccttacatccgggcacccggagcttccctgggttgacagcaggagccgaaccggattctgccacgggagacttgggggtggggtggagtggggggggggtgaggatggaggtggggaacctgaggctgtaggtcatggtggtggtggctgggttaggggtgtggaggcgttcagccctccctcagggttctgaccttgatgccagtcagagcctgggcccagcctgatacgcccgaccccgcggggtggtccagggctggcacaggggcggcgctgtattatttggggtcctctatctggggcggggggtcttgagtcctccctcagggtctcaccttgcctcctcacagagcctgggcccgcttccctccaccgatatcgacccgcccctcacagcgaggcccccgctactctctgacccccagtgtgggagtcactggccgtacatccgggcacctggggcttccctgggttgacaacaggggcggaaccagattctgccgcgggagagttgggggggtggggtggagtttggggtggggtggggtggggtggggtggggtgtagagtggagctgaggatggggctggggaacctggggctgtaggtcatggttgggttgggggggcccagcctccctcagggtcctggccttgatgcccggcagagcctgggccctgccctctcctaaccagccctgccctggtcacaccaagctctcactccagagtgcccagcagcttgagcggcggagggagggggtcggcccagcctcacaagtcagccccagatcggcccccgggtggtccagggctgggagcagagacggcacttggttctttcgggtcctctatctggggtggggacatcctcagtcttccctcagcacctcaccttgactcctcacagagcctcggccagcttacctccaccggtatcaagccgcccctcagaaggaggcctctcccttctctctgacccccagtgcgcac

SEQ ID NO: 1854 - DNA, 69204 bp, Homo sapiens
ttagattgtaaaagtttattgatatggtcaaaaagcaaacagccagacatttggttatctttgccactacaatgtgtcattctgaactgtatcttaaaaatgcataacaaatgatatttaaaccattaccagaaaagtaaatgaagagtctacttaaggcacttcatatgaaagctaattcaaaattttcacaaaagtcacactattttataagtgtagtaaattaccttctacacattttagccagaatgctgcctttctccttacagaagaatgtgctcttaaagggagaaaaagcaaatacaaaaaattgtcattctgtcaatgttcatgacaaattatctggaactatacagattacatggcagtagtattcccgtggtcaatctgtacaaatcagggcatcttcatacaagtctcataagaaccacagcatagatttggcctgagacaagtacaagaatagcaggtaaggaattcagaatctcacaatttacaagtgagtaattaacaaaaactggctgctccattaaaaagtaaaaggtcaaccatatcccctcatccatgaaatctagtaacgaaaaacaaaaaacccacataaaatatttcttctgaggctactatatccatctctttctgcaaaccacatggcagggttattagaaggtaaatggcaggtggcagtcatagtatctttttaatgtaatacttgtaagatttccttaaaattattttttcacaattacaattatcctatttccacaatagtggcatttcaggttactcttcataactatgggggaggttatagttagatataatgataaccatgaaaacattcttcacagaaatttggttagcacatatggttatttctactgacagaaaccaaaagacaaaataaaaaaaatcccttcaaattggtactttgtttctccacctaaaggaagagaataaagactaaaataacagcaaaacatagaacagctttcgagaaacgcttaatttctatatacaggcatcagctcaatattttatgatttttctttcccattctaagggagtccttttctttcttacttttttttttttttttgagatggagtctcgctctgttgccaggctggagtgcagtggtgtgatcttggctcactgaaacctccatctcctgagttcaagtgattctcgtgcctcagcctcctgtgtagctgggattacaggctcctgccaccacacccagctaatttttatatttttagtagagacggggtttcaccatgttggccaggatggtctcgaactcctgacctcgtgatctgcctgccttggcctcccaaagtgctgagattacaggcgtaagtcactgcgcctggccagggagtccttttctaactgagcctatttttctcttaggtacaaatggaataagtgacaaactctaatttgtagaaacattttaggccatgtataagttacactgattttagcactaagctatatttttatcacagatgggtcaccttaaaagaaaactaaggagatggaatgaatctgaaatctttctaaatacaaggtagttaacaccatactcaagcagaaattataatcctgtatttagagatacttttttttgagacagagtctcactctatcactcaggctggagcgcagtagcgtgatctcggctcactgcaatctccgcctcccaggtattaagcaagtctcgtgcctcagcctcccaagtagctaggattataggcatgagccaccaagcccagctaattttcatatttttagtagagacggggttttgccttgttggccaggctggtctctaactcctggcctcaagcaatccacctgcctcggactcccaatagatgtcttttcatgttcacagctatcgagaagcatagacattgctggtgtggtagctcacacatgtcatcctcgcactttgggagactgaggcgggcggatcacttgagcccaggagttcaagaccagcctggacaacttggcgaaaccctgtctctactaaaaacacaaaaattagcctggcatggcggtgcacacctgtaaatcccagctacttgggaagctgtgacaggagaatcgcttaaacctgggaggcagagtttgcagtcagccgagctcacgccactgcactccagcctgtgtgacacagcgagaccgtctcaaaaaaacaacaaaacaaaaacaatcatagacagcactgtatttcagtaggaaatatgcaaggaggaggagaaacaactgtcttgctgagggctagacgtgtgctctgaagaatggtgttccattttcagaagaccacatgacacacataatttctctactcaaaaggaaagatgcgtaaagtatacacatccacacaaagatgaagaagctaagaatgaattcctaatgtagttatctgtaacaggcatatgtgggaacacctggtcaggacttactttccccatctttggataaggcaatataaaatcagatgaccaagttaactaaagtagttttgagctttgttctaactaaaacaaagtagtagttttacaatttttataatatacttaattgtactaaattaaatgttccataaagttcactgggaagagaaggttaagaggataattattttcaaatacctcagattttgacagaggattgcttgttaaggcactacacatcttctttggttaaatgattaactatttaaatcacttgaaaaaaagaggtaatacaaaatatacaagttgcattcttcttttcaaacacacacgattttcgtttttcaatttccagtactccagtgtctatatatctctgggacctttttaactcatcagaaagctgaaacaaaaatatattccaatctattagtctctgaaagaaaagtaggatttacttttaatcaataagcagtatgttggttttaacagataaaagagcattttggtacgtacatgataatctttgggtatcaataacaaaaagtgagaaacactgagagacccgttagtcttatgacaaaaggaaatagaataacctcaagttaaaatatctcctgaatagagacactaattaataattttattttttcatttttttagagatggggtctcactgtgttgcccagtctggtctgggactcccacgctcaagtgatcattctgtcttagccttctgagtagctgggactacaggcacatgacactgctattgaatcaactctgctgatcaaataattaacagaagtcccagcaaaattaccttcacatctcaattagtattctgtagaggataaattattataattattatttttgagatggggtctcactctattactcagactggagtgcagtggcactctatttcttaaaaaaaagtagaggcgagaagaagtttttaacattaaaaaaaatcatttcttcttcaaaaggaagtataatatgcagacaaggagctatgtgaatagataatggcataaaatgttctaatcattatgtatttctagaatacatatgagatttctagaataaattaggtatggcaaaataaatctaaaagatgttcctgagaaatcacatactaatattgtccattatactataattaatttttatatgggaacatatctgaattacagctgtttgggcatggtggctggctaatgcctataatcccagccctctgggaggctgagcaggagactcgcttgatgccagaagttcaagaccagcctgggtaacatagcaagaccctgtctttacaaaaaataaaaatattagctgggtgtggtcatgtgcagctgtagtcctagcctcttgggaagctgaggtgaaatgatggcttgagctcaggagttcaaggttacaatgagctatgaacacgccattacacttcagcctgagtgacagagtgagaccctgtctctgaaaataaatgaataggccgggctcagtggctcatgcctataatcccagcactttgggaggatgaggcgggtggatcacttgaggtcaggagtccaagacctgatcaacatggtgaaaccccgtttctactaaaaatacaaaattagccgggcatgctggcacacgcctgtaatcgcaactacttgggaggctgaggcaggagaatcgcttgaacccgggaggcagaggttgcagtgagccgagattgcgccattgcactccagtctgggcaacaagagcaaaactccatctcaaaaataaataaataaataaataaataataaataaatagatgaataaataaaaataaagcctatatctttcctttataagctaaaatagtttggaagcaaagcaaaaagaaggatattataaagcaatatcaactctaatcattccaggtattggtaatcactgtataaacaaaaaataagaatcatacctgtatgggtagccatgatatttagatctaaaaatagagagcatccaactgaagaataatacaacaagtccaataccagccacacacattactgcagaaaaataaaaggagagtaaaatgagcaggttgagtataataaataaccatggcagtctatactttctttttttattttattttattttattttattttattttattttattttattttattttattttatttttgagacggagtctcgctctttcgcccaggccggagtgcagcggcgcgatctcggctcactgcaagctccgcctcctgggttcatgccattctcctacctcagcctccagggtagctgggactacaggcgcccgccactgcgcccagctaattttttgtatttttagtagagacggggtttcaccttgttggccaggatggtctcgatctcctgacctcatgatccgcctgcctcagcctcccaaagtgctgggattacaggcttgagccaccatgcccggcctggcagtctatactttcagagagtgaaaaggaaggggtatacattattgataaatctcaacttttcaacaattttcatccctatttcttaatcttcaggaatctgccttcccctttaatttgctccattacaatgtaatagagtaactcctttacataattatgcaattcaaatgtatgaaataatgaattcctttaaagtcatcacactgaaaggtttactgttagaaacactgttacaatcgacaagaaaatcacccatttggttttttggttttcttttttttttttttttgagtcagggtcttgctctgttgcccaggctgaagtgcagtggcacaatcacagctcactgcagtctcaacctcctgggctcaagcaatcctcccactacagcctcttgagtagctgggactacagatgtgtgccaccatgcctggctaattttttaatttttttgagaagacggtgtctcactacattgcccaggctggtgttgatctcctgggctcaagtgatcttccgcttcagcctcccaaagagctgggattacaggcatgagccacggtgcccggcttacttatttattgaactttaaaacccctaaaagtggccttgtagtattgataaacattaacttagacatctgatgacttcattgtgatagcctcacttgaaagtactttattcatgcacagataactacacagccttatatatgtaactcaataaacatggatttcttatttgaatgagaaaaaaaatctgatccctagccctagattcatagctctctccactaatcccacatgtcatgtcctacattagcacagcagttattaaagtgaactacaaatactaatccccaaatgcgcaagtatggattgtcatgatgtgaagctctttcaatccccggactaaaaatggctaagaactatagagatagggatgtagggaagcatgtgtccaacagcaaaggaagctctagggcaggggtgtccaatcttttggcttcccagggccgtactggaagaagagctgtcctgggccacaaataaaatacactaacactaatgatagctgataagctgaaaaaaaaaaaaattgcagaaaaaaaccctcatgatgttttaaggaagttgacaagtttgtgttgggccgcatgtggcccacagactggacaagtttgttctagggtaacatacttagtgactgataagaaaatcaattttcggccgggcgctgtggctcatgcctgtaaccccagcactctgggaggccaaggcgggtggatcacgaggtcaggagttcaagaccagcctggccaagatgatgaagccccatctctactaaaaactacaaaaaaaattagccaggcgtggcggcaggcacctgtaatcccagctactcgggaggctgaggcaggataatcgcttggcaaagcttgcagtgaaccaagatcgcgccactgcactccagcctaggcgaaaaagcaagcctctgtctcaaaaaaaaaaaaaaaaaaaaaaaaaaagaaaagaaaagaaaatcaactttcagttttgttttacttatggaacaattcttttgccttttctaattgttacacaatatgactagggcttaatgtgtaaatgttaaacaatatttctctttaattcttttctaatttacaaaaaagaagtgcagcttgctgccaatgctcatttaattttatataatcacgctgtttgaggctgaagtaaatctgactgattttcaatgtgaaaataaaacaaaaactgttgttggagttattactaaacagaactaacatcagaatcgtctgaatcatcacaatagtctatttcagaaaaattgaattcatcaaatgaatctttggccaacaactgttcgagaatggtgtaaacattacacgtggaatgctacattttctaggatttgacattttcagtgatcaagaattactatattttgtaaatggaaataccactataatggaaataaaaatggactgatgtctagtatattagtatattattctatttacagcactctgttttcagtagtggtaatggatcacttgaacccagtgatatctaacatatcaattttgtttccaaagttgatatactagagtggatgtgaaaacaataattaaagcacgatattttgtggcagagttatctcagcgtaaacactgcagccacaagcactgccagtgagtattctcagggcaaatgggaaaagggttaacttaaccaaagaagtgaaagaactctatgatgaaaactataaaacactgctgaaagaaactgaagaggacatcgaaaaatggaaagatgttccacgttcatggattggaagaatggatgttgttaaaatgtccatactatctaaagcaatctatagattcaatgcaatccttattaaaataccaatgacaacttcacagaaatagaaaaaacaaaatttatatgaaatcacaaaagaccaatgatagtcaaagctatcctaagcaaaaagaacaaaactggaggaatcatattacttgacttcaaattatactatagagttatagtaaccaaaacagcatagtactggtgtaaaaacagacatacagaccagtgggacagaagacagaactcagaaacaaacccatacacctacagtgaactcattttcaacaaaggtgccaagaacatccactggagaaaacacagtctcttcaataaaaggtgccaggagaactggatatccataggcagaacaaaactagacccctatctcttgccatataggaaaatcaagtcaaagtggattaaagacttaaatctaagactgtacaccatatatatatatatgcatatatgtatatatatgcatatatatacatgtgtgtatatatatgcatatatgtatatatatgcatatatatacatgtgtgtatatatgcatatatgtatatatatgcatatatatatatacatgtgtgtatatatatgcatatatatatacacacacacacataaataaaagacaagagtcttgctctgttgctcaggctggagtgcagtggcatgatcttggctcactgcaacctccacttcctgggccaagcaatcctcctgcctcagcctcccaagtagctgggactacaggcacacaccaccacacctggctaatttttgtatttttagtagagacagggtttcaccatgttggccaggctggtctcgaactcctggcctcaagtgatctgcccttcttggcctcccaaagcattgggattacaggtgtgagtcactgtgcctggcctaagactgcaaactattaatatgaaacaactataagaaaacaatggggaaactctccaggacattagtctgggcaaaaatttcttgagtaataccccagaagcacaggcaaccaaagcaaaaatagacaaatgagatcacatcaagtttaaaagcttctgcagagcaaaggatacaatcaacaaagtgaggagtcaatccacagaatgggagaaaatatttgcacagtacccatgtgacaaggggttaataaccagaatataaaaggagctcaaacaactctacaggaaaaaaactaatgatctgatcgaaaaaacataaaatcttttttttttttttttgagacggagtcttgctctgtcgcccaggctggagtgcagtggtgtgatctcagctcactgcaagctccacctcccgggttcacgccattctcctgcctcagcctcccaagtagctgggactacaggtgcctgccaccatgcccagctaatttttttgtattttttttcagtagagatggggtttcactgtgttagccaggatggtctcgatctcctgacctcatgatccacctgcctcggcctcccaaagtgctgggattacaggcgtgagccaccgcaaaaaaagaaaatatttcaatagacgtttctcaaaagaagacatacaaatggcaagtaggcataaaaaaactactcaacatcaatgatcatcagagaaatgcaaataaaaattgcaatgagatatctatcatctcaccccagctaaaatggcttatatccaaaagacaagcaataataaatgctggcgaggatgtggaaaaaagggaacccttgtacactgttgtacactgttggggggaatgtaagttagtataaccactaagaagaacagtttggaggttcctcaaaaaactaaaaattgaaccaccatatgatccagcaatcccactgcttgggtatacacccacagaaaaataaatcagtataccgaagagatatctgtactcccatgtttgttgtagcactgttcccaatagccaacatttggaagcaacctaaatgtccatcaacagatgaatggataaagaaaacgtggtacatatatacaatggagtactattcagtcattaaaaaaataagatcctgtcacttgcaacaacatggaactggaaatcattattattattgttgagatggagtctcgctctgtcacccaggctggagtgcagtggcgccagcttggctcacttcaacctctgccttccaggttcaaacaattctcctgcctcagcctcctgagtagctgggattacaggtgtgcaccactacgcccagctaatttttgtattttagtagatacggggttttaccacgttggccagggtagtctagaactttctgacctcaaataatctgccccacttggtctcccaaagtgctgggattacaggagtgagccaccatgcccagccttggaagtcattaagtgaaacaattcaggtacagaaaaaaaaatcatatgttctcacttatttgtgggatcaaaaaatgaaaacaattgaactcatggacacagagagtagaaggatggttaccagaggctgggaacggtagttggggaatgccgggggaagtacggatggctaatgggtaccaaaaaaaatagaataaataagacctactatttgatagcacaacaggataactatagtcaataataatttaattgtacattttaaaataactaaaaaagtataattggattgtttatgacacaaagggtaaatacttgaaggatggatactgcagtctccgtgatgtgactattacacattgcatgcctatatatcaaaacatctcatgtatcccataaatatatacacctactatgtacccacaaaaattaaaaataaaatacttttcctgagtattaacacatgctgagtgtagacaagttagccttttattctctaagaaaatgtactcatagactgcgtgtgatggctcacgcctgtaaatcacagcatttggggaggccaaggcagaaggattgcttgagcccaggagttcaagaccagcctggacaatgtagcgaggccccatctctacaaaaaattacccaggtgtggcagtgcatgcctgtagtcccacctactaggaaggctgaggtgggaggatcacctgagccagggaggtcaaggctgcagtgagttatgatctctccacagcactccagcctgggcgacagagtgagaccctgtctcagatttaaaaaaaagaaaaagaaaatgtgcacatacgtatatacagcatcactctgtatatatttgtatcctcctcttttcatacatctaaaagtgcttagagcagttcccagaacatgctaaagaaacgtctattaatttgtgatcattttgttaggtaagaaacttaggagatcaaattgtgactatttcagtatatgttgccaaaatgtttaacaatttaagttcatgtcagtaatgtactttgatggccttttcccaagaataaacactgaaataggcaatttttaaacagtcaggcaaagtctacagccatagcaccctgaacgcgcctgatctcgtaaaaagtcaggcagtgaaaggacatatactgactggattaaaaactataaaatgcttactttggcagcatatatactaaaactggaatcatacagagaagattagcatggcccctgtgcaaggatgacatgcaaattcgtgaagtgttccatatttttttaaaaaaattttaaaaactgatacattaattatttttctaacacgtaaaaattcatttttttagagattgagtctcgctctgctgcccagactgaagtgcagtggtgtgatcatagctcactgcagcctctaactcctggcctcaagccatcctcctgtcccagcctcacaagtagctgggactacaagtgcgttgtaccacatccagctaaaaaaaatctattttaattgagcaaaacaagtatttctcaaattttaagttcagtatcttcatcttttttctagaagttaaagtaaatattagactttatttaggtagggtaatttttatgacatttaacttttttatttatttatttattttgagatgaagtctcactccgtcgcccaggctggagtgcagtagcgcgatctcggctcactgcaacttccgcctcctgggttcaagtgattctcatgcctcaaactcccaagtagctgggattacaggcacgtgacaccatgcctggctaatttttgcttttttagagacggggtttcgccatgttggccaggctagtctcgaactcctgacctcaggtgatccacctgccttggcttcccaagtgttgggatttacaggtgtgagtcaccacgcctggttgacatttaactttttaatcataaaaggaaaatcttgacttatttcatgaaagtaaaaccaaattacattgttagattctctctgcaacagataacaatgtgtgaatattctaatatataaaaagttcatgcaggctgggcatggtggctcacgcctgtaatcttagcactttgggaggccacagtgggaaaggttgcttgagcacaggagatacagaccaacctcggcaataaagtgagaccccatctctacaaaaaataaaattaaattaactgggagtggtggcatgagcctgtggtcatagctacctgggaagctgaggcagtaggactgctggagcccaggagttcgaggctacagtgagtcattattgtggcactgcactccagcctgggcaacagagtaaggcctggccttaaaaaaaaaaaaaaaatgtccagctgagcacggtggctcacgcctataatcccagaactttaggaggctgaggcaggcacatcatgaggtcaggagttcgagaccagcctggccaacatggtgaaatcccgtctctactaaaaatacaaaaattagctgggcgtggtgacgtgcacctgtaatcccagctacatgggaggctgaggcaggagaattgcttaaacccaggaggcggaggttgcagtaagccaagatcacaccactgcactccagtctgggagacagagcaagactccgtctcgaaaaaaaaaaaaaaaaattccttgcaaaccaaataaaagggctaagactctaacagataaatggcaaaagacaaaaggacaatttatagaaggaaaaacataaacacaaatgactagtaaacatttaggaaaatatttgaccttataaaaataaaaggagtacaaaataatacatttccaccttatctgattggcaaatatatatgtatctataaaacagatacatattaatgagattaatgctgataaaattacaatgaaatggctgggcacagtggttcatgtctgtaaccccagcactttgggaggccgaggcgggcggatcacgacgtcaggagatcaagaccatcctggctaacacagtgaaacctcatctctactaaaaatacaaaaaaattagccaggcatggtggcgggtgcctgtagtcctagctactcgggagactgaggcaggagaatggggtgaacctgggaggcagagcttgcagtgagctgagatcgcgccaccgcactccagcctgggcgacagagcaagactctgtcttaacaacaacaacaacaacaaaaccaatgaaacaaacattctttttttttttttctttaagatgaagtttcactcttgttgcccaggctggaatgcaatggcacgatctcggctcactgcaacctctgcctcccaggttcaagcgattctcctgcctcagcctctcaactagctgggataacaggcatgcgccacaacgcctggctaatttttttttttttttgagatggagtctcgctttgtcacccaggctggagtgcagtggcgtgatctcggctcgctgcaacctctacctcctgggttcaagcaattctcctgcctcagctgcctaagtagctgagattacacacgcacgccaccatgcccagctaatttttgtatttttagtagagacgggggtttcaccacgttggccaggctggtctcaaactcctgaccttgtgatccacctgccttggcctcccaaagtgctgggattacaggcgtgagccaccgcgtctggccaaatttttgtacttttagtagagacagggtttcatcatgttcatcaggcttgatggcctcgaactcctgacctcaagtgatccacccgcctcggtctcccaaagtgccaggattactggcataagccactgcgcccggccaaaacaaacattcttaaataccagtagtagaaatctaaattattttaacttgccaaaataatctgtaatgattaaaacatcaagagaattgaaaatactcagacagaggaccacacagttattcttcttctaggaatctaccttaaggaaacaatattaaataagaatgatggctgggcgtggtggctcatgcctgtaatcctagcacttcaggaggctgaggcaagtggatcacctgaggtcaggagttcaagaccagcctggccaacatggtgaaaccccgtctctactaaaaatacaaaaaaaaaaaagaaaaaaaaaaccccaaaaaacaaaaaaactagccgggcgtggtggtgggcgcctgtaatcccagctactcaggaggctgaggcaggagaatcacttgaacctgggaggcagaggatgcagtgagccgagattgcaccactgcactccagcctgggtagtaagagcaaaactctgtctcaaaaaaaaaaaatgatgcttaatgtatcatgatagttactgaagaataattatagttaaaattaggaaaaaactaaacattgaaaaaaatcggaatagttaaattataatatagagtataagtcagccaggcacggcagctcacgcctgtaatcccaacactttgggaggctgaggtgggaagatcacttgagtccaggggtttgaggccagcctgggcaaagtgacaaaaccccatctctacaaaaagtacaaaatataagctgggcatggtggcacatgcctgtagtcccagctactagggaagttgaggtgtgaggacagcttgagcctaggggcggaggttgcagtgagctatgattatgctactgcactccagcctgagtgacagagtgagaccctatcttaaagaaaacaaacaataacagagtataagtttaaaattatgtatatagaaaaagttattagttatttaactccagtttaaaaagggggtgtgaagtgtcaaaattttatatatacagtttttaaggtttttataagtggaaagaaatatattacaatttaaaaataattagtttttcagtggtggaatgtttcatgctcctgtttttttacattttctataatgagcatatattaattttaaaatagtaaaggagtttaataacagatatgacatttaaagaaaaaaatagtaaaggggtaaaataacctacttatcctataagtaagaggaaaagtgattaagagatcactctttttccatagtacaggcagcactgttacattttgagtaaggtgacttactctttcgctttccaatatccatgtcagaggtagcagcttcacataaaagcaccattcctaaggtaactccaccatctaagaaaaattgtttaaggagaaattcgcacagacaaaaaagacataccattttactatttccagtttctcatgaagaaaattaaaatgaatatataaaccttcaactcttcattataaaaaaccaaaataaggaatcttgtatctatacggcatgacaattatttactatgaagatacaaaaaattaaaattggaagattacttcatttgtgcaaagaaaaattgatattttaaacaaatgtcccaccataacttacagatgaaatatgagttttcccgaaattgtactttgaaataacctgtctggacattcagttattgccctgacctcaaacacatttaaaaatattaaatggcttttttttttttttgagacagggtctggctctgtcacccaggctggagtgcagtgacgcaatctcagctcactacaacctccacctcccaggctcaagccaccctcccacctcagcctcctgagtagctgcaactacaggtgctcaccaccacgcccagttaaattctgtaatttttttttttttttttttgtagagatggggttttgccacgttgcacacgctggtcttgaactcttgacctcaagcaatccacctgcctcggcctcccaaagtgctgggattataggtgtgaatgaccacgcccagccctaaatagccattttgaatatttcaccccacctccctaaagaacacatttgaaatatatatcatttagggagaacagtaactactttttatttgaaaattaatttctgaaaaatctctcctggcctagtttagcggttcacacctgtaatcctaacagtttgggaggccgaggcgggccgattgcttaagtctgggagttcaaaaccagcctgggcaacatggtgagaccctgtttctaccaaaaaatacaaaaaattggccaggctggtggcacatacctgtagtcctagctacttgggaggctgaagtaggaggatcacttgagcctggaaggttgaggctgcagttagccgtgatcataccactgcactctagcctgcatgatagaactagactgtgtcaaaaaaaaaattctccatattttcaataatactttattttttaaatttttcccatgccaagatgccaaaagtacatcaataattagcctttaaagcacaaattactactaacctatctaattttatcctattctaataaaaaagaaaaatcctggccgtgcgtggtggctcacgcctgtactcccagcactttgagaggcagaggtaggcggatcaccttaagtcaggagttcaagaccagcctggccaacatggcaaaaacccgtttctactaaaaatacaaaaattagccgggcgtggtggcaggcgcctgtaatcgcagctacttgggaggctgaggcaggataatcacttgaacccgggaggcagaggttgcagtgagccgagatggcactactgcactccagcctgggtgacagaacaagactccatctcaaaaaaaaaagaaaaagaaaaagaaaaatcccacatgtgccatgaccacacttttattcagcttaataggagctgcataaatacaaaatacaacaacccatacaaataggtaacagatggcatggttgaatattaaaataagcaagttcaaattttaaagcaaatagaatgtgttctagtagaaaagagagacagattcaccctgcagtttagtgaatactaacagcagtaaaacactcccaaatcaattatacatatgtacatacatgttgtatgctaccgcatgtgggtatcattaagcggaaagggaaaaatatgtgccctttagatgaggcctgaatttataattggctctaaaatttgacttgtcatcccttcattaccatcttgcattcttttttaaattttttaatttaatttatttatttgagacagggtctcactctgtcacccagggtggagtgcaatggcataatcacaactcactgcaacctccacctcccaggctcaagagatcctcctgcctcagcctcctgagtatctaggactacaggtgcataccacgccacgttcgttttgttgatttttttgtagaaacggggtctcactatgttgcccaggctggtctcaaactcctggactcaagcaattctccagcctgggcctcccaaagtgctggaattacaggcgtgaaccaatgtgcctgtgccccatcttgcattctttcttcaatagcctcttgttagggatgatgcccattcatcatgttttcagttgttcagccaagtctcttctccagcaattttttctgagttctttatctgcaggtttgtgcaaagattgatcatttcgttttttaaaatttttatttattatactttaagttttagggtacatgtgcacatcatgcaggtttgttacacatgtatacatgtcccatgttgctgtgctgcacccattaactcgtcatttaacattaggtatatctcctaatgctatccctcccccagtatttttttgccagtattttattgaggatttttgcatcaatgttcatcaggaatatttggtctaaaattctctttttttgttgtgtgtctgccaggctttggtatcaggatgatgctggcctcataaaatgagtcaaggaggattccctctttttctattgattggaatagtttcagaaggaatggtaccagctcctccttgtacctctggtagaatttggctgtgaatccatctggtcctggacttttttttggttggtaagctattaattattgcctcaatttcagagcctgttattggtctattcagagattcaacttcttcctggtttagacatgagagggtgtatgtgtccaggaatttatcaatttcttctagattttctagtttatttgtgtagaggtgtttatagtgttctctgatggtagtttgtatttctgtgggatcggtgatgatatcccctttatcattttttattgcatctatttgattcttctctcttttcttctttattagtcttgctagcggtctatcaattttgttgatcttttcaaaaaccagctccaggattcactgatttttttgaagggttttttgtgtctatttccttcagttctgatctgatcttagttatttcttgccttctgctagcttttgaatgtgtttgctcttgcttctctatttcttttaattgtgatgttagggtgtcaattttagatctttcctgctttctcttgtgggcatttagtgctataaatttccctctacacactggtttaaatgtgtcccagagattctggtatgttgtgtctttgttctcggtttcaaagaacatctttatttctgccttcattttgttatgtacccagtagtcattcaggagcaggctgttcagtttccatgtagttgagtggttctgagtgagtttcttaatcctgagttctagtttgattgcaccgtggtctgagagacagtttgttataatttctgttcttttacttttgctgaggagtgctttacttccaactatgtggtcaattttggaataggtgttgtgtggtgctgcaaagaatgtatattctgttgatttggggtggagagttctgtagatgtctattaggtccgcttggtgcagagctgagttcaattcctggatatccttgttaaccttctgtctcgtggatctgtctaatgttgacagtggggtgttaaagtctcccattattattgtgtgggagtctaagtctctttgtatgtctctaaggactcgctttatgaatctgggtgctcctgtattgggtgcatatatatttaggatagttagctcttcttgttgaattgatccctttaccattatataatggccttctttgtctcttttgatcttttttggtttaaagtctgttttatcagagactaggattgcaacccctgcctttgttttccatttgcttggtagatcttcctccatccctttattttgagcctatgtgtgtctctgcacgtgagatgggtctcctgaatacagcacactgatgggtcttgattctttatccaatttgccagtctgtgtcttttaattggagcatttagcccacttacatttaaggttaatattgttatgtgtgaatttgatcctgtcattatgttagctggttattttgctcgttagttgatgcagtttcttcctagcatcaatggtctttacaatttggcatgtttttgcagtggctggtgccggttgttcctttccatgtttagcgcttccttcaggagctcttgtcgggcaggcctggtggtgacaaaatctctcagcatttgcttgtctgtaaaggattttatttctccttaacttatgaagcttagtttggctggatatgaaattctgggttgaaaattcttttctttaagaatgttgaatttggcccccactctcttctggcttgtagagtttctgctgagagatcagctgttagtctgatgggcttccctttgtgggtaacccggcctttctctctggctgcccttaacattttttccttcatttcaactttggtgaatctgacaattatgtcttggagttgctcttctcgaggaatatctttgtggcgttctctgtatctcctgaatttgaatgttcgcctgccttgctagattggggaagttctcctggataatatcctgcagtgttttccaacttggttccattctctttgtcactttcaggtacaccaatcagacgtagatttggtcttttcacatagtcccatatttcttggaggctttgttcgtttctttttattcttttttctctaaacttctcttcttgcttcatttcattcatttgatcttccatcactgataccctttcttccagctgatcgaatcggctactgaggcttctgcattcatcacgtagctctcgtgccgtggttttcagctccatcaggtcctttaaggacttctttgcattggttattctagttagccattcgtctaaccttttttcaaggtttttaacttctttgccatgggttcgaacttcctcctttagctcggagaagtttgatcatctgaagccttcttctctcaattcatcaaagtcattctctgtccaggtttgtttctttgctggtgaggagctgcattcctttggaggaggagaggcactctgatttttagaattttcagtttttctcttctgttttttccccatctttgtggttttatctacctttggtctttgatgatggtgacatacagatgaggttttggtatggatgtcctttctgtttgttagttttccttctaacagtcagcaccctcagctgcaggtctgttggagtttgctggaggttccctccagaccctgttggcctgggtatcaacagtggaggttgcagaacagcagatattggtgaacagcaaatgttgctgcctgattgttcctctggaagttttgtttcagaggagtacccggctgtgtgaggtgtcagtctgtccctactgggggatgcctcccagttaggctacttgggggtcagggacccacttaaggaggcagtctgtccgttctcagatctcaagctgcatgctgggagaaccactactctcttcaaagctgtcagacagggacatttaagtctgcagaggtttctgctgccttttgtttggctatgccctgctcccagacctggagtctacagaggcaagcaggcctccttgagctgcggtgggctccacccagttcgagcttcccggccactttgcttacctactcaagcctcggcaatggtgggtgcccctcccccagcctcgctgccgccctgcagtttgatctcagactgctgtgctagcaatgagcgaggctccgtgggcgtaggaccctccaagccaggtgtgggatataatctcctggtgtgctgtttgctaagaccatcagaaaagcacagtattagggtgggagtgacccgattttccaggtgccatctgtcacccctttccttggctaggaaagggaattccctgaccccttgcgcttcccgggtggggcgatgcctcgccctgcttcggttcacgctcagtgcgctgcatccactgtcctgcacccactgtctgacaatccccagtgagatgaacccagtacctcagttggaaatgcagaaatcacccgtcttctgtgttgctcacgctgggagctgtagactggagctgttcctattaggccatcttggctgcacaaaggtcttttgttaatgtgatcatttctttctttttttttttttttttttgagatggagttttgctctgccactcaggctggagtgcagtggagccatcttgactcactgcaacctctgcctcccgggttcaagaaattctcctgcctccgtctcctgagtaagctgggattacaggcacatgccaccacgcctggctaatttttgtattttgagtagagacggggtttacccatgttggctaggctggtctcgaactcctgatctcaggtgattcactcacctcagcctctcaaagtgctggggttacaggcatgagccaccatgcccggccaaagattgatcatttctacaggctttgatttctgggtactctctgattaatgattgagacttgctctggggaaagcttgtctttttatcatggtttatgtgcttttgctttgaatgagctttccttcttgctaaatacctcaaggtcttttgtgtactcttcttagctgtcaagagctatgatgcagttctatgtatactgttttatttcatttactgatctttaaatttttactaacactgcctactatatggcaggcactataaactgttggaaataaaaagttgaacaaaataaagatcctaccatgaagaagattacactctagtgaggaatacaaacaatgaaatacataaattacacagtcctgattaaatgttactccaggagaactgagcagaaatagaggagacattattccataacatacaacaactaggctattaaaagctagtagaaggccaggcgtggtggctcacgcttgtggccaagacgggtggatcacctaaggtcaggagttcgagaccagcctgggcaacatggatatgatatatccattatataaacattaaaaatattgactacttttctttttcttcgtattttcagatttctttgtaatttttatgtatttttataaatataaaggccatacaacatagaaaatgcttataatatattaagatagcaaactccatacacaacatgtctacaagtataaaaaatgaacacccttaccatgaaacattcatatagaaatgaatgcaagataatatgcaaaagtaaatgtagtttatactattagggtttcaggttataggtgaacattttccagactgctactttattttaaaaattcaggaggccaaggtacgaggattgtttgagcccaggagattgagaccagcctggacgacagggcgagactccatctctagaaaaaaatacaaaaattagctgggtgtggtagtgctcacctatagtcccagctactcaggaggctgacgtgggaggactgcttgattctgggaggtcgaggttacagtgagctatggtgaccccactgtactcaagcctgggcaacacaagatttcatctctaaaaaaataaacataaaaaaaatccatatatatttattctgggattccatttattgtgttttctttttttttttttttattttgagacaaagtctggctctatcagccaggctggagcacagtggtgtgatctcagctcactgcaacctctacctcctgggctcaagccaccctcctgcctcagcctcccaagtagctgggaccacaggcacgcagcaccacacccagttaatttatgtactttttttagtagagaaagggttttgtcatgttggccaggctggtctcgaactcctggcctcaggtgatctgcctgcctcagcctcccaaagtgctggtattataggcatgagccaccgcacccagccctgtaggattccatttatgtaagttaaaaaaaaataggtaaaataaacccatagtgttagcagtcaggatagcagttatttctgggtgggaaggtggcaatcaggaggaatgatgatggaaaatgctctgagatgtgggtaaaattttatttattgatgtgagttctggttacataagtgtgttaattctgtgaaaattcatcaaactggactgggcaccgtggatcacgcctgtaatccttacactttgggaggccgaggcaggcggatcagttgagctcaggagttcgaaaccagcctcgccaacatgatgaaaccccatctctactaaaaatatcaaaaaaacttagccaggcatggtggcaggtgcctgtaattccagctactccagaggctgaagcaagagaatcgcctgaacctgggaggtggaggttgtaatgagctgggatcacaccattgaactctagcctgggcaacagagcaagactccatctcaaaaacaaaaaacaaaaaaccaaaaaaaaaaaaaaaaaaggaaattcatcaaactgtaaacttttgtaaacttttctgcataactgcaacacttaaaatgtaattttaaaggttgcttagatcaggcaactgattatatagtctgctttattaatcatgcaataaactgtacattaaactaataataaatatgtgaatattttccaaaatcataactactacttagaggtggcctcagtctattaattattatcaacctggaagctgtaaacaatgttaccggtcttgaggtttcatatttactttaaaagaaagtgggggccgggtgaggtggctcacgcctgaaatcctagcactttgggaggctgagatgggtggatcacctgaggtcaggagttcaagaccagcctggccaacctggtgaaaccctgtctctactaaaaataaagaaattagccaggtgaggtggtgcacacttgtaattccagctactcaggaggctgaggcaggaggatcgcttgaacccaggaggtggaggttgcagtgaaccaagatggtgccactgcactccagtctgggtgacagagcgagactccactcaaaaaaaaaagggggggggggtggggagtggttaggccttttctaatattccttacctctgacaaaattattcattttctcactatttctggtacacagcacttaagtcactgtcttataatctgtatacatgtctgactctgaaaaaagttcactttttgcatcctaataaccaaacacaagacattctatatcccaacaggattgtaatccgttccaaatgtatactaaaccttaggctgatgctcagtcttaaagcagaggtaaaatgacaattttctaatttcttaaacttcttatatatttaaaagtttaagacaaagctaaaagaccaacaaaccccaaatcaactaattaatactttacaattttaattgctcttttgctccattattcaatttcaaagtactagtgagaagaactgattcaagatactgaaaattttctaaggtataataatttgttaatccatcaaaccatacttttcttttctgttctttttttttttttttctttgagacagagtctcgctctgttgcccaggctggagtgcagtggcagtctcggcttactgcaacctccacctcctgggttcaagcaattctcatgcctcagcctcctgagtagttggaattataggtgcacactaccgtttctggctaatttttgtatttcttgttgagatgaggtttcgctatgttggccaggctgaatccatcaaaccataaatgaacattgtctttctttttttttcttttgagacaagagtctcaccctgtcatccaggctggagtgcagtggcaccatcttggctcactgcaacctctacctcctgggttcaagcgattctcctgcctcagcctccagagtagctgggattacaggcgcccgtcaccatgcctggctgttttttttttgagacagagtctcactctgttgcccaggatggagtccagtggtaccatctcggctcactgcaacctctgcctcccaggttcaagcaattctccggcctcagcctccccagtagctgggattacaggcgtgcaccaccatgcctggctaatttttgtatttttagtagagacagggtttcaccatattggccgggctggtctcgaactcctgatctcaggtgatccgcctgcctcagcctcccaaagtgctgggattacaggtgtgaggcagcacgcctggccgtctggctaagttttgtatttttggtagagacagactttccccatgttggccaggctggccgcgaactcctgacctcaaatgatccacctgcctctgcctcccagagtgctgggattacaggtgtgagccaccacacccagcccataaacgaacattttcaactaaaattttaggattaaaaaaaataaagtttgagtaatatttttctttcagtcttcccccgccccgccgcccgccccctgagatggagttttgctctaattgcccacgctggagagtaatcacacgatctctgctcactgcaacccctgcctcctgggttcaagagattctcctgcctcagcctcctgagtagcagggattacaggcacccgccaccacgctcagctaatttttttttgtatttttagtagagatggggtttcaccatgttggccaggctggtctcgaactcctgatctcaggtgatctacccgccttggcctcccaaagtgctgggattacaggcatgagccaccacgcctggcctcagtcttctttcttctcatatggactaggtgtatattgttaatctttcagcccaccatttcatggttgaatagattaattctcccaggtttgggctggatgtgaagcagtaagtatattttccatagtgcataagaacattttcccaaatatccttcaattaaaatcagttaaaatcaaaagcttaatatttttttagaatgctttccttaaaatctctctaatcatcaacatagtataataaaactgggaaagacatacacaaacatttactaaagatagaattttcagtggttttgaatttttttctttatacttatttgtattctaaattttctttaatttatattccttttgcaatcagaaaaaaatatatttaagtttcgttttttttcccttttttattagagacagggtctcactgtgtcgtccaggctggagtgcagtggtgtgatatcagctcactgttgccttgacctcctgggctcaattgatcctcccacctcagcctccctggtagctgggaccacaggcatgcatcaccatacttggctaattttttgtgtgtatttttttgtagagatggggttttgccatgttgcccaggctggtctcaaactcctgggctcaagcaatctacccatcacagcctccaaaagtgctaggattacaggtgtgagccaccatgcccagctgattcttgtatatcaatgtcaggacaccctggctgagaagcacaattccaggaacattacatttgttcaccttgttgatttgttccagagtcagtgcttatgtactcaggtgggtaaactatgtttagtcatattatgaaatttagattcttacttatctgacatcgcttttacctgtctttgcagcttacagaggcatccacttttagatataagaaaataaaaattagcttgggccaagaaagtaaaaatattccttgtcattcaagagaatggaacaacacaaacataaagcagctgcaaagtccacaggaagtatttttccctagcacacacttcagctgtaaaatgtcaaaatatccccatctttgagtaattactgttttcttactgaggaatattggtctttaaatagacttcttgcaattatatgagtaaaaatgaaatattcttgcttggcagatctaagtcactcaatttacacgtataatttctaagtagcctcaatttacaaccaaggtatagagcttcaaagaagaagtttttgaagacaaaaatcccacatttatgttaactttgtagtttccaagcaaacagaaccctgggtctgattgacagttcagacctgatgttgacccctttacacagccttacactgcttttagcctatcaaaacaatgctttgtttaaatttcacataaactccactattctcccaaatcctattacaactctatcttttctttgttaagatgttccatggttcttctaatgtacagtattcctcatattaatgagccaataaacctggccctatcagactacagatttgtccctagtagtctttggtttattgggctggagaggatgatacagtaatgattttcaaaggatattgtgacttgcattaagagaacagccccagccaaatgctgtagagagaatactagactgtgagaaaacagacaaaatacagcaagaaagacttattgtaaaaggatactaaacagaagaacaatgtgtgtttcagctacaaactgggcttgactgcttccatggatataattctaggagggaaaaaagacaaaatggaatctttaagtatacattaaatgttggtatgctaaccctaaaacggggtattttaaactatgaaattattaattcacctgataaaccatgtgacatactccgggtctgtggcattcatcagtaagtctggttactataaggctatttttgtattatctattctcgatttgtcttttcattgtactaatactatgtttatttttgagacagggtcttgctctgttgcccaggctggagtgcagcggcatgatcatagctcattgcaatcccaaagtcctggctccggtgatcttcctgcctcagcatcccaagtagatgggactacaagtatgcaccaccatgcctgctcagctaatttttaaattttcattagaaatgacatattgctatgttggccaggctggtctcaaactcctgggctcaagcaatcctcccacctcagcctcccaaatgcttgaatactgtacttatattttcaacaacagaatatgtcagaaaactagttgttgttgttgttttttcttttcttttttgtttttcatagagatgacgtctcactatgctgcccaagttggtcttgaactcctggcctcaagtggtcctcctgcctcagcctcccaaagtgccaggattacaggtattagtcaccacacctggccccattttttttttaaggagatggatcttgctatgttgtccaggctgggctagaactcctggattcaagtcatcctcctgcctcagcctcccaagtagctgggactacaaatgcaaaacactgcacctgggtgagaaaactagtatttaagtgtacaagaccatgaggtacaataatgtaggctccatgaagacagggatcatgtttttcttatcactatatttaataataattagcacagtgcttagaaacagtggatgctcaggtacttgatcaatttttctatttagttgaaggctgtctttcattcttagctagcttggttagaaggattcaccaaatgggaaaaggaacttcccacttttaagagcactgcggccgggtgcggtggctcatgcctgcaggcctgtattcccagcactttgggaggctgaggcaggcgcatcacctgaggtagggagtttgagaccagcctgaccaacatggagaaaccctgtctctactaaaaatacaaaattagctgggcgtggtggcgcatgcctgtaatcccagctactcaggaggctgaggcaggagaatcacttgaaccagggaggtggaggttgcagtgagccgagatcacgccattgcactccagcctgggcaacaagagcaaatctccgtttcgaaaaaaagaagaaaaaaaaaaagagcactgcatggtcttatcagtgatggaagcttgttaacacaagagagattgaaaagtgaagactaaatccagctccttcatatgctggcactgttctcacagggtaataatcattgagttaactttggtctacaaaggaaagaaatcccagacttcccttaccacatgtcccgtgtggggattcttatgggcatatggtggtcctcttatatggttccacatttgaccagatgtcatagcaagcacaaaacactaggaaacaaaaaaataataaaatattcatggtcaaactgttcttgtcttgattagataacaggaatatgaaaatgtgcatctgtttagttaagacatagaattttttgcagataaatgatttattaaggcttatatttcatcccaaggatcacaattcgataatacttcaaaaggaaaacactattttttttttttgacatggagtctcgctcttttgcccagactagagtgtagtggcgcgatctcggctcactgcaacctccgcctcccaggtttaagcaattctcctgcctcagcttcctgagtagctgggactatagaagcatggaaccacgcccagctaattttgtatttttagtagagacagggtttcaccatattggccaggttgatcttggtctcttgacctcgtcatctgcccacctcggcctcccaaagatatgggattataggtgtgagccactgcgcctggccaggaaaacactatttaaaaattataactatgcagacacaagtttcaaaattgaatactgaaaaggctttttagaataaaattttcaggctgggcatggtggctcatacctgtaaccccagcactttgggaggctgaggtgggcgggtcacctgaggtcaggagttcaagaccagcctggccaacatggtgaaaccccgtctctcctaaaaatacaaaaaaattagctgggcgtggtggcacacgcctgtaatcccagctactcgagaggctgaggcaggagaatcatttgagcccaggaagcagaggttgcagtgagccaagatggtgccactgcactccagtctgggtgacagaccaagactccgcctcaaagaaaaaaaaaaaagaataatattttcagaacaactagagattttcatagagatgacagtctgtcatttaggttgaataaaaggcaggtacaatcagttccttgaagttctggccatccttatgagataatgaatgaaacaaactgattttaagacagaaaattaaaatatataaaactattttcctcaggtaagaaataaaatgctacttctcacataaataaaagcttacctaaaaatacactattaggaattttattcaaataattttttgtcttctgaaattcactcaccaaagctgcaaaagcccatccagttttattaaagagaaattccatattacttcttcgaagatacacaagtccaccaataacagccaaaagcaatcccaacataaggggaccagcataatttgggggtctaatcactctaatctaatggaaaggagagaaaaacatgttaaagtataaaatttttttactaattatatgggtcaaaataaaatctgaaatgaaagcaatcaaaattattgtggttactttcggaaaaatgatcctttttatgttatcccaatcaaactagtctataatataacctaaaataggatagaataggtacaatattctatttaaccacaacataacatcttttagattaagaaggatttgccaagtacaactagataatccatggacttaaggtcgaaagagtggtttccatgctgaattcaatagggtaatagagagtgttctgtaatttcactcattcatcaagatgattctgtttaatgctacttatgaagtgactgccaaactagtaccacctcagtgatatggggacaagactaattagggcctcccagtaagattcaaaggggataatggccaagaaacagtctacatagttgggaaacttacattgacatcagttctgtcggcgatccaccgggcaatctgctcagctgaaaaaccccgcacctgtaactcatatgtatcaccccgtttgggtttcccttttgcaggaaagttgatgaaagttggagctgaattcatgtttagctgaataaaaacgagccatgaaaatatacattatcaggaaaataatcttaattgcagttaacatcttgaaatttaggcattttacaaagatgaggaggcctgggtttaggtaggttaagtgatttggtttgcccaaggaaagtggtaagtggtggagcaggctttaaaagcaaagctgcctgtgaccttaagtattacatactactcaccaaatacacattcctcgctaagaaacctgtattttactccactagaatggaaactttgccataccacagatattttaatctgttcagagattatgcaaaatgaatacatttatgagcactaaaataatcttatgtagctgagtaagctccaaatagagtatattctcaatttggaggaaccaagataataaaataatgctctaaaacagcagtgaaaagcaatacaaaatggtggctatatgcagaaatagtctattctaagaaggtccataaatgtttactgatgagcaccacatttctctattctccatcatgacatcatgatatatttgagaagacaacaccggaaatactaaggtaaagaaaccataaccatctcatctgcattatatctttttttatttttttgagatggagtctcgctctgtcacccagactggtgacaatcttatagagattggcttgcacaaatcaatttttatttatttatttgtttatttttgagatggagtctcactctgttgcctaggctgaagcacagtggcaggatctcggttcactgcaacctccgcctcccaggttcaagtgattctcctgcctcagcctcccaaggagctgggattacaggtatgtgccaccacacccagctaatttttgtatttttagtagagacaggggttcaccatgttggccaggctggtcttgaactcctgactgcaaatgatccccccgcctcagcctcccaaagtgctgggtttacaggcgtgagccaccgtgcctggccttacaattataattttaaaacctcagccaataaaataatccaactcccatgctttgattctttagttaaaatccttctaacagtaagttttcaagctttcccataaggtgagagcatgtactgactgttgcttatcattattttggtctctttggctgtataatgtggtaaattaatgaattaatagattactcctttggttaccaatgtccatagatttatatgccttggtcagtaggcacaaaatccctagaggtagataaattctggctatcctgttaaaattcaatttctgtgattgcaaagctaggaaccaaatcttatacaatgttcagtctaccaaatgctgcccaaattttaggccaaactctttattcaatatttgtttagttacaccacctctacatttttgaaaatgtgtataaaaaataaaaactggccgggtgcggtggctcacacttgtaatcccagcactttgggaggccgaggtgggcagataatgaggtcaggagttcaagaccagcctggccaacacagtgaaaccctgtctctactaaaaatacaaaaattagctgggcgtgacggtgggcacctgtaatcccagctactcaggaggctgaggcaggagaatcgcttgaacccgggaggcggaggttgcagtgagccgagattgtgccactgtactccagcctgggtgacagagctagactccgtctctaaataaataaataaaaaataaaaaataagtaacatataaatacacttctcttgtaaaaaatatttttaaaaacattacatggttataaggaccaattctagtacattctggcagccacagttaccatttacagatatttttgaatttattcatatatatgtttataccaccagaaaacatataatattgctgttttaacataaatggtatcatattaatggtattttcctggttgtcttcctttttagcaactaaaaataatgttgcagtgaacatccttgcacatatctccctgtacccatgtgaaagtgattctctagaaatgggattgttaggtcatgggatagaaatattttttaattaaaatggatatagtgcccaggcacggtggctcacgcctgtaatcccagcactttggaaagccgaggcaggtggatcacttgaggtcaggagctcgagaccagcttggccaacatggtaaaaccccatctctactaaaaatacaaaaattagctgggtgtggtggtgggtgcctgtaatcccagttactcaggaggctgaggcacaagaattacttgaacctgggaggcggaggttgcagtgagctgagattgcaccactgcatttcagcctgggtgacacagtgagactctgtctttaaaaaaaaaaaaatggatatagccaaattgtcttccaaagtggctgtgccaaaatatacttctacttaacaatgcagtaatgtatccatttccctacatccttgccaaaagttgatgtgatgggtgaagactgtactttatcattatcatactattaatttgtgtttccctgtttactaataaaacatctttaaaacaaattagttatctgaaaacatctttgtttttttttcttgagaaggagtctcactctgttgtccaggctggagtgcgttggcgcaatcttggcccacacaatctccgcttcctgggttcaagcgatcctcctgtcttaccctctcaagtagctgggataacagggatgcgccatgacatccagctactttgtttttgtattttcagtagagacaaggtttcgccatgttggccaaggtggtctcgaactcatgacctcaagtgatccgcctgcctcagcctcccaaagtgctggcattacaggcgtgagtcaccatgcccggcctgaaaacatcttgtagcccaacgatacaatcaacagagtagaaagaaaacctgtgaaatgggaggaattatctgtaaatcatttatctaataaggagttaatattcagaatagtctgggcatggtggcttatgcctgtaatcccagcactttgggaggccaagacaggtgtatcacttgaggccaggagtttgagaccactctggccaacatggcgaaaccctgtctctactaaaaatacaaaaattagccaggtgtggtggcgcatgcctataatcccagctatttgggtggctgagacacgagaattgcttgaacctgggaggcagaggttgcagtgatccaggactgcgccactgcgctccagcctgggcgacagagtgagactctgtctcaagaaacaaacaaacaaaaacaaaataaaaacaacaacaaaaatttggaatatataaagacctcctacaactcaacaacaacaaaaaacttgatttaaaaaatgggcaacacaggtgggtgcagtggctcatgcctgtaatcctagcacgttgggaggccaaggcaggtggatcacctgaggtcgggagtccgcaaccagcctgaccaacatggagaaaccccgcccctactaaaaatatgaaaaaaattagctgggcctggtgacgcatgcctgtaatcccagctactcgggaggctgaggcaggagaatcgcttgaacccgggaaacggaggttgtggtgagccgagatcgtgccattgtactccagtctgggcaacaagagtgaaactctatctcaaaaaaaaaaaaggcaacacacacacacaatgggcaaagaacttgacatttctccaaagaagatatacaaatggccaacaaaacacatgaaaaaatgttcaatattactatcattatggaaataaaaaacaaaaccacaatgagataccacctcacactcataaagatggctattatccaaaacaaacaaacaaacaaacaaaaaaccccagaaaacaagaagtggttgcgagcatgtggagaaactggaaaccctgtgcaccattggtgggaagtaaaatggtgaatctgctatggaaaacagcatggaggttcccccaaaagattaaaaatagaattaccatatgatctagcaattctacttctaagtatataaccaaaagaactgaaagcagggtcttgaagagattatttgaacactcgtgttcatagcagtattattcacaatagccaaaagctggaagcaacctaagtatccactgacagatgtatgggtaaacaaaataaggtgtatacatacaatgcaatattattcagctttgaaaaggaaggaagttctgacacatgctataacatggatgaacattgaggacatgatgctaagtgaaataagccagtcacaagaacacaaatactatataattccacttatattaggtacctagagtagtcaaattcatagagacagaaagtagaatggtggttgtcaggaactgggggagtggggaactgaagttgtttaatggctataaagtttcagttttggaagatgaaagaattctggagattggttgtacaacaatgtgaatgtatctagcactactgacctgtacatttaaaaaatggtaaacataataaattttatattatatatatttacaaaacaaccccaccaaaaccccttgtagactctgaaattccttggaggttaatgaaccaaaataagatacactattttttggtaggtatcagttttcacatacgcttagcttttgcatactgtggcatatgacactgttacttagagaaagatttgaatctcttccacagatggacacactaccatccttatacctttggctctaaaatctagctctaaaatagagtaatggaaattaatattaaaaactattcaaggtacgaaagtgtacgtaacaaaaacaaaaatagacaaatgggactatattaagctaaaaagcttctgcaaagcaaaggaaacaacaaagtgaagagacaatctgttgaatgggagaaaatatttacaaactattcattcaacaaggaactaatgtccagaatatacaaaaaattcaaacaactctaaaaagaaaataaaacaaaaacaaaaacaaaaaaaattcaaatcactcaacagtaaaaaagcaaataatcccattaaaaagtggacaaaggacatgaatagacatttctcaaaagaagacacacatggccaacaggtgtatgaaaaaatactcaacatcactcatcatcagggaaacgcaaatcaaatctacagtgagatatcatcttctcccagttagaatggccattattattattattagaaaagctccttttctgctcatctgtctgttgcctccttgcaatacattttcctactttctctaataaatctgcctttctttaccttaaacgaacaaacaaacaaaaacagatgcaaggatatggagaaaagggaactcacggccaggcacggtggctcattcctataatcccaacactttgggaggccgaggcgggtggatcacctgaggtcaggagttcgagatcagcctggccaacatggtgaaaccctgtctctactaaaaatacaaaaattagctgggtgtggtgatgtgcgcctgtaatcccagctgctcaggatactgaggcaggagaatcgcttgaacccaggaagcggaggttgcagtgagccgaaatctgcactccagcctgggcaacagagtgagactccatctcaaaaaaaaagggaactcatacactgttggtgggaaattaaattagtatagccactatgaaaaacagtataaggccaggtgtggtggctcacgcctgtaatcccagtactttgggaggccgaggtgggcggatcacgaggtcaggagatcgagaccatcatggctaacacggtgaagccccatctctactaaaaaatacaacaaaaattagccgggcgtggtggtgtgcacctgtagtcccagctactcgggaggctgaggcaggagaatggcgtgaacccgggaggcggagcttgtagtgagccgagatcacaccactgcactccagcactccagagggagactccgtctcaaaaaaaaaaaaaaagaaaaacagtataaagatttcccaagaaactaaaaatagaactagcatttgatccagcaatgccactactgggtatgtatccataggaaaggaaatcagtatatcaaagggatacctgcacccccatgtttactgcagcacaatagcaaagttatggaatcaacctaagcatccatcaacagacgaacagatcaagaaaatgtggtattaggccaggcgcagtggcttgcgcctgtaatcctaccactttgggaggctgcggcaggtggatcagttgagctcaggagttggagggagaccagcctggccaacatggtgaaaccccatctctactaaaaatacaaaaaaattagccaggcgtggtggcgcacacctgtaatcccagctactcgagacgctgaggcaggagaatggcttgaacctgggaggttgcagtaagccaagattgtgccactgcactctagcctgggcgacagagaaagactccatctcaaagaaaaaaaaaatgtggtgtgtatacacaatggaatactactccaccataaaaaagaatgaaatcatgttacttgcagcaatatggatggaactggaagttattatgtgaaataagccaggcacagaaagacaaatatggcatgttctcatatgtgggagctaaaaaaattgaactcagggaggtacagagtagaatggcagataccagaggctgggaagagtgtatgtgtgtgtgttgtggtgggcggggtgggggggaggggtgcgggagcgggcaatgaagagaggtcagttaatgggtacactcatacagttagaaggagtaagatctaatgttccatagcagagtagcgtgactataattaacaaaaatgtattacatatttcaaaacagctagaagagaggacttgaaatgttcccaacatatagaaatgataaatactcaaggtgatggatactccaactatcctgacttgatcattctatgaatctaacaaaatatcacatgtaccccataaatatgtacaaatattatgttatcagtaaaaaaactaaggtagaaaaaaatgggttttctatttttacaaatcactaacagaagttatgtgttaccttgttaaaataaatggaattaaaaattgtaatttccaaaaataactgcagcctaaatagtagagaattaaaaagcaatttttttttttgagacaaagtctagctctgtcacccaggctggagtgcagcggctcactacaacctcctggctcactacaacctccacctcctgggttcaagcgattctcctgtctcagcctcccaagtagctgggattacaggtgcccgacaccacacctggctaatttttgtatttttagtagagatgggatttcaccatgttggccaggctggtgtcgaactcctgacctgaagtgatccccacgccttggcctcccaaagtgctgggattacaggtgtgagccaccatgcctggcctcaatttcttaaactccagaaattgtttcctttagtctaataaatcctaaatgcactaaccttttaggttacaacatttttataaatgcactgattttgatttgtggagatggctaagtgagactggaatatgaatagcacaatgaatgatatactgtaaaatggaaacattaagccatttttttcaacatttaccgaatacccgttatgtgcttagcactgatagctacaggatatggctctgccattaactaagtagtaactatattcttttatttatttatttatttatttttgagatggagtctcgctctgtcgcccaggctggagtgcagtggcgcgatctcagatcactacaagctccgcctcccgggttcaagccattctcctgcctcagcctcccgagtagctgggactacaggcgcacaccaccatgcccgtctaatttttgttgttttttttttgtagagacagggtttcaccgtgttagccaggatggtctcgatatcctgacctcgtgatctgcctgcctcggcctcccaaagtgctgggattacaggcgtgagccaaccgcacctggctgtaactatattctaagggagactgtcaaacaactacagagctaactctactgtaagacaaaatgtggataaatgtataacagaaatttaaggcaagtgatataacaatacaagaaaaggagtgactcactttttatctggaaaagttgagaaagcttacagggagtatctgaaacaaggcttaaaatgtaagcagaattttgagagtggagagaaagcagacagggaagaaaattgttgtaacccaacaatcaacagtgctgacatacgagagtgcatcaggccaggcgtggtgtctcacgcctgtaatcccagcactttgggaggccaaggcgggcagatcacccgaggtcaggggtttgagaccagcctggccaacatggcgaaacccctgtctctactaaaaattaaaaaaaattagccaggtgtggtggcgcgtgcctgtaatcccagatactctggaggctgaggcacgagaatcgcttgagcagaggttggcagtgagccgagatcacgccaccgcactccagcctgggtgacagcaagactccacctcaattaaaaaaaaaaaaagagtgcatcaaagaatatgattatgggaaaggtgtgactggagtaaagagcacatgaaattaggactaaggaattctggcttcagtctatacactactcctttcaaaagtgtgttctatggaatctagccaaatgctccattaagtggtccaataatatgagaaattctgtgtattagagcccccattggaaagtataacacatatcagcatcagcatgttaacatctctgatctctcaaaagctgtgttgggagacaattcttcatgagtttctcatgtttctgcacatcttgtggacaagggccctaactgcctttgttctggacaatcttctcaaggatatttgtatatctttggaagatagttgaaatggccttcgcaaaattatgactgagacagtgaaagagatctaacttaactgactccgacttggttctaacctccaagctgtccttgttcattcctggccataggctgaactaactttaggagaaacttagtttatagtttaaacaaagactgtaacagccctttcccaaagcagacctccttcttgcctgagaactagattgcctttgtaggactaatattagccacaagatgaaaaattatggtttaggagtcatgtagctagaggctacaagattctgaccctccctaaactgctcctaatatcatcgcttgagatattttgcagactctgcacttgatggatcagctgacaccacccagatcaataaactggctcatctgatcttgtggccccctcccaggaactgactcagcacatgaagacacctttaactccctatgatttaatctctgagcaatcagcactcctggctcactggcttccccccacccacgaagctatccttaaaaactctgcaccccgaatgctcggggagactgacttgagtaataataaaactccagtctcccacaaagctggctgtgcatgaaatactttctctattgcaattcctctgtcttgatgaattggatctgtttaggcagcagcaaagtgaaccccttgggcggttacacagtctccctccacagcaaaggggaggcacacttactatccattacagaaaatgtgggttcccagagcttggtgttcctctcccataatgcagcccattggccctctttgttattgttgttttcttaagagttggggtctggctctgctgctcaggctagagtgcagaggcacgatcacagctcactgcagcctcaaactgatctcaagcaatcctcctgatccagccttccgagtagctgaccactggccctctttggattgccctatgggaaatggggtttggggaacctatgacattttggctacttgttgtgagtagtaaagtcctttaacttgagccaggcatggtggcacaagcctgtaatcccagctactcagaaggttaaggtgcaaggattacttgagcccaggagttcaagactagccagggcaacatagcaagacccaatctcaaaaacaaacagcaaaaagtcctttgctggactctgactcaggagtgtcatattttctgccagcatccatgaaactgtggcaggttaacttgttagcttgcaagtagggtaagaacttagatccttcccagcttttgaaccctgaagtaaaaagaaaacttaattttgtttaaaccagggtttcccaagtttatttttttccaagaatacttattaataccatgtagaaaaaactctgggaaatgttatagcaggcaatatggacagagcgctaaatggaaggtaagtggaccagttaaaaggttactgcattagcttgaatgagagatgaatgtgagccttggaatgtaaagggggtatggctatgacacacgttgtacaagaagatgaagatgacaaagaagtgtcattaatgatacagaacataagatgaggcttgggtgaaagtggaagagaaaacagtttaatttgggatataataaatttttagattgggaagtcattcatatgaagatgtatagcaaggcattatatccagctttttccttttatgtttgatacaattgagtaaaatatgttcaaatatatgaattagacacatttataaacaaagacaaaattgaatctatgtccttaagtatttatatgcaaggggaaagaactagtagagatgctgaagctaaaaatggaccaggtgtggtggctcacgcctgtaatcccagcactttgggaggctgaggtgggtggatcatctgaggtcaggagtttgagaccagcctggccaatacggtgaaaccccatctgtactcaaaatacaaaaagtagccaggcgtggtggtgggcacctgtaattccagctattcaggaggctgaggcagaagaatcacttgaatccaggaggcagaggttgcagtgagccgagatcaagccactgcactctagtctgggcaacagagcgagactccatctcaaaaaacctgaaactaaaaagaaaaattaaaaaattaaccaggcgtggtggcaagtgcctgtaatcccagctacttgggaggctgaggcaggaaaattgcttgaacccaaaaggcagaggctgccagtgagccaagattgtgccattgcactccagcctgggcaacagagcgggactcttgtctcaaaaacaaaaaatagttgtgagaggtcatgattgacagagcaggtgggtatgtgatccagggcccaggaaaaaggttcagtttcaaacaacaaaagatctacttttctactaagactagaggtaaggggacaaaagaaatcaactcaagatggaccagaaacttaaatctaagacctgaaaccataaaaattctagaagataacattgtaaaaactctttttttgagactgagtctcactctatcacccaggctggcaatctcggctcactggaacctccgcttcctgggttcaagtgattctcatgcctcagcatcccgagtagttgggattacgggcgcccgccaccacacccggataatttttgtattttagtagagatggagtttcaccatgttggccaggctggtattaaactcttgacctcgagtgatctgaccaccttggcctcccaaagtgctgggattacaggcatgatccaccatgcccagctgaaaaactcttccagacattggcttaggcaaagaattcatggctaagaccccaaaagcaaatgcaacaagaacaaaaataaataaatgggacctaatttaactaaaaagcttctgcacagcaaaaggaataatctgcagagtaaaccaacaacccacagagtgggagaaaatatttgcaaactgtgcatctgacaaaggactaatatccagaatctacaaagtactcaaacaaatcagcaagaggaaaacaaacaatcccatcaaaaaatgggtaaaggacaagaatagacatttctcaaaagaagatatacaaatggccaacatcactaattatcagggaaatcaaaaccacaatgaaatactactttacacccgcaagaatggtcataattaaagcaaaaaaaaaaacacaaaaaacaaaacaaaaaaaaacaaagatgtggtgtggatgtagtgaaaagggaacacttttaacactgctggtgggaatgtaaactagtacaaccactatggaaaacagtatggaaattccttaaagaactcaaagtagaactactatttgacccagcaatcccactactgggtatctacccaaaggaaaagaagtcattatatgaaaaagacacatacacatgcatatttatagcagcacaattcacaattgcaaagatatggaaccaacctaagtgtccatcagccaatgagtggataaagaaaatgtggtacatataaatcatggaatactactcagtcataagaaggaatgaaataatgtattttgcagcaatttggatggagcgggaggtcattattctaagtgaagtaacttaggaacggaaaaccaaatatcgttatgttctcacttatgagtaggagttaaactatgaggatgcaaaggcataagattgatataatggacgttgggaactttgggggaaaaagggtcagagggggatgaaggattaaagactacgtatttgggtacagtgtacgctgctcaggggatgggtgtaccaaaatccagaaatcaccactaaagaacttatccatgtaaccaaaaaccacctgttgccccaaaactattgaaataaaaataaaaattttaaaaaagaggtaaggggataaagatatctatagtatagatagctatactaaagacttcaatattacataatggtgggactcgtgctgtgatttaaaaaattccttaataaattatatacttaaaatggttaaaatgataaagtttgttttatatattttactacaataaaaatgtatgttatttaaatactactcaatttccatattctagtaggttagcattgataactacattttatggttagctcaagtttaacttttagtttgctactctagatcttacataagagcaatcccatttaatgtcttatagccactgaaaaaaatatattccactttcactatattttacctatttttatatagcagaataaaccaaagatcttaccatctgaaatacatcagagccttcatcaaaatccaccatggcaaaaaatatcctgttggtgaatgcactggagtatcgccaggagtttgccaggatctggaattcttcatcagcttgcctggatgcaatgagattcgtaaagataacatataaaacaatttttgaaagcaatctcgtttatcatcagtaaaacaggtccaagcaagcaatagcaggttttccaatgggagaaataataaaaaacactgacaagtaggtcagactctgctgacagggttaagacaaatcttgttttggcataagagaagccttatcccaagttagggatttcatgagaagtagtaattacctgactccgcttcatactttgtgcctgtttcttatcccaaaactctttcaacaatcattggaaatatatagctaatcgcctctacaataactttccataccctaaattacttctaagagttcaaagacaagacagaagtgtattccctaaagaaagcagaaatacaatattaattcatttttaaaaatctaaagtgcaaaagctacttggtaaataacacaatcagataaattattaggatgaaagataagaagagtctaggaattgaaattaattgaggccagctcatacctgtaatcccagcactttgggaggctgaggtgggtggatcacctgaggtcaggagctcaagacaagcctggccaacatggcaaaaccctgtctctattaaaaatacaaaaattaggccaggtgcagtggctcatgcctgtaatcccagcacgttgggaggctgaggcaggcggatcacaaggtcaggagttcgagaccagcctggccaatatggtgaaaccctatctctaccaaaaatacaaaaattaaccgggcatggtggcaggcacctgtagtctcagctactcgggaggctgaggcaagagaatggcttgaatccgggaggcggagattgcagtgagccgagatcacaccactgcactccagcctgggcgacacagcaagactccatctcaaaaaaaaattattgaaacctcaagtcatctttgaatttttccatatctcccatatgctttcagttctcatgatctgtcaattctcatttgcgataaaagtttcactccatatcctcctatttttattgctatcatctaaggtcagatttttgttatctaatagtaggatatttaaaaatactgactctggtttctcctccttcaatccttctttttttttgagacagtctcgctctgtggcccaggctggagtgcagtggctccatcttggctcactgcaacctctgcctcccagtctcaagcaattctcctgcctcagcctcctaagtagctgggattacaggtgcccaccatcatgcccagctaatttttgtatttttagtagagacagggtttcaccatgttggccaggctggtcttgaaatcctgtcctcaggtgatccgcctgcctcagcctcccaaagtgctgggattacaggtgtgagccaccgtgcccggccctcctccaatccttacactgcaatatacatccatcttcctaaattactactttcctgaaacacttctcagaaatcactgttgctttcttattaccttcagaatacattctctaatctctttcactagttattgaaggttctttatcacatagcttcaaataatacatctagtttttatctagtcttactactaatcaatctcaaacagtaacctttagtcccaatattttatttactcctatccctgtacccttgtgtacatcatgcttctaaccagaatatcctgcctgtatcaacatcttatccatttgtctagccctagcacaagtcttatttcctccatcaggccaatccaaatcactcctattaaccttctttcctgaaattttacagtatttattatatgtacagttgatctggtacttaatcacaaattgccttatattgccatctaaattttcatatgtgtaactcatttccttaaccagatgataagggtaggttatctattttacaattctcatcccaacagcaccacaactacagtataattcatgttgctgttgtttaatttttatttgttgaatgagtgtagaaaaatttgagttaatattaaatttggtctcatagaaaataagatgccagtaaaaacttaggttagtaagaattccattaatttgcatttaatagagaattatgaaggagtttgtgtttgttccctgctatttttgtatactcttgattgctactgagtgaactgacggaattagaagtaattctagatttcaagtttattcatagttattacttacgattcctttttcttcttttatttatttttaatttatattcagcacatactccacaaaataagcactatggaaccaaataccttgactataccctagctccagggagaaaatcgttaaagaaaagttatcaaggcttggggtggcagaacacaccattctgaaacaagctgtctattcctttgcatggctatcaggctgtcagaatctggagaacctccaagtttttactaaactaattcttcatacagtagctttgtcattttatttaaagttaattaccagatcagatacactgatctaaaaatataaataaaaagacactaaaaagcaaaagctattttattttttagtatccaccattttgaattgttcatggtgtttttatttaacagaatagcaatctttgctcctaagatcattaagaaacaataaaataaaatcaagaaaccattgtttgatgaaaacttaagcaagattagtctccatctccaaggtttacaatcactataaaacaactgggaaattagaaacatcgctaaatcatggatctttgggattaaaaaaataataattaatatacccatcaccttacctatttattattttttggtggtgagaatatttaaaatgtttttagcaatttcaaaatctacaatacattaactatggtcaccatgctgtgcaatagatcaccagaacttacccccctcatctaactaaaactttgtacactttcaccacatcctctcctaagactctgaaaaccaccattctactctgcttctaggagttcaacttttttagatttcacatgagatcccatgcatcttttttttttgtttgtttttgagacagggtcttggtctgttgctcaggctggagtgcagtgggatgattatagccttctgcagtttcgacctcccaggatcaagtgatcctcccacctcagcctctggagtagctgggactacaggcacatcaccacacccagctaattttgtttatttttatagatacaaagtttcactatgttgcccaggctggtctccaatgcctgggcccaagtgatcctcccatctcagcctcccaaagtgctgagatcacagacatgagctaccacacccagctgcatcttttttttaaaaaaaaaaaaacattaccagctgggtgtggtggctcacgcctgtaatcccagcactttgggaggcttaagtgggttgatcacgatgtcaaaagatcgagtccatcctggccaacatggtgaaactccgtctctactaaaaatacaaaaattagctgggcgtggtggtgtgcacttgtagtatcagctactcgggaggctgaggcagaagaatcacttgaacccaggaggtggaggctgcagtgagtcaagatcacgccactgcactccagcctgggtgacagagcgagactttgtttcaaaaaaaaaaaaaaaagaaaattaccagttttcttgaattccaaacttggatgaagccaccattattgcattagtaaacatcttaagcattgggtagaccagttaaaattgtggagcctgtttcttccaaaaatagtaggatatttgctttacctaccttttgggattttgacaatacaagagtatgaagctgaaagcacttacaaataataaaaaaatactacatcaatgctactggcatacagttacataagttgatactgatttttttttttttttgagacagtctcgctctgtcgcccaggctggagtgcagtggcgcaagcttggctcactgcaacctctgcctcccgggttcaaatgattattctgcctcagcctcccaaatatctgggactgcaggcatgcaccacaatgcctagctaatttttgtatttttttttttttagtagagatggggtttcaccatgttggctgggctggtcttgaactcctgacctcagatgatccacctgcctcgacctcccaaagtgctgggattacaggcatgagcccccatgccccgccaagttgatactaatttataagatgactgtttgatctttaagttacttttatgatggctaccacaattatttatccatgcttcccccactgatacggataatcaagaattgactataaaagagcagtagtattgctaccatagacatcctgagtaaggtatacacattatttaagtacctactgcactaacttggcccttctgggattgagaaatggttaacgttatatgagttatttaattttaaagcgtagttggagttcatacttgcaaacgacacactgtctatgcagttggagagcagtgaacatgacgataacggagtaatttctcggtggggctttcacaaggcgacggaacttgtctccattcattcttattacaggtcttttgttagtccattccatcagctgactaaccttttcagataacaccatctaaaaaagacaaagtgagcatgctattaatatactcaacttggcatttaaagttcttttaatgaggcagcttacttaaaaccaatactaacaagcagaggtatacagaaaatgtgagacctaaagccaaaatttggtagttgggctggatgataattattcttaaaatacattatttcataatattttgtcagacattacacttttgatgtaattaattatgaatgaatgaatgaatgaataaacgaatgaatgacactgtctcgctctgtcatccagactgcagtgcagtggcacaatgagggctcactgtagccttgacctcctggcctcaagggatcctcccacctcagcctcccaagtgcttggaatacacacgtgttccaccatgctcagctgatttttgtattttttgtagagatggggcttctccatgttgcccaggcaggtcttgaactcctgggcttaagcaatctgcccgcctcagctaccgacagtgctgggattacaggcatgagccaccacacctggcctttatatatatatatatatatatatatatatatattttttttttttttttttttttgtagagacgggggttttactatgttgcccaggctagtcttgaactcctgggctcacatgatcctcccaactcagcctcccaagtgttggcattacagtcatgagccattgcacccagacagaattatttattatttactaataagataaaaataacaaaacctttcatttgccaaaaattccaaagaatgttgagttaaaccaatggccagttttatatacaattttacttctctcaaaaaacatacagtgaaaatcttgaaaataaagagtaaagtgggaggaatcactctattcaattttaaggtttactatgtagccacaataattaagacagtgtggtacagatgaagggatagtatcacagaacaacagaacaaaaaaacaacccagaagtagacccatacaagtgtagtcaaatgattttgcacaaaggtgcaaaaacaactcagtggaggaagaatagccttttcaacaaatggtgcagaagcaattggtcatccatagccaaaaatatgaacttcacaccttatataaaaactaactcagccgggcatggtgactcacgcctgtaatcccagcactttggaggctgaggcgggtggataacctgaggttgggagttcgaaaccagcctaaccaagatggagaaaccccgtctgtaccaaaaatacaaaattagccaggggtggtggcacatgcctgtaatcccagctacttgggagactgaggcaggagaatcgcttgaacctgggaggcagaagttgcagtgagccgagatcgtgccattgcactccagcctgggcaacaggagtggaactccatctcaaaaaaaaaaaaaaaaaaaaaaaagaaactaatacaaaatagatcatatacttaactgtaaaactataaaacttttatgaaaataaataggagaaaatattcagaagctaagggtaggcaaaggtttcttaggcctgacaacaaaagcaggatccataaaaaaaaaaaattgatatactggacctcatcaaaattcagccggatgtggtggctcatgcctctactcccagcactttgggaggccaaggtgggcagatcacttgaggctaggagtttgagaccagcctggccaaaatggcgaaacccagtctctactaaaaatacaaaattagctgagtatggtggcacatgcctaaaatcccagctgctcagaaggctgaggcatgagaattgcttgagactgggaggcagacattgcagtgagccaagatcataccactgcactccagcttgggtgacacagcgagacactgtctcaaaaaaaaaaataaaataaaataaaaaattttactctctgggccgggtgcggtggctcacacctgtaatcccagcactttgggaggccaaggtgggtggatcacttgaggtaaggagttcgagaacagcctggccaacatggtgaaaccctgtctctaataaaaatacaaaaattagccaggcatggtggtgggtgcctgtaatcccagctactcgggaggctgaggcaggagaatcgcttgaacctgggaggcggaggttgcggtgagccgagatcacgccactgcgctccaacgtgggcgacagagtgagactctgtctcaaaataaaataaaataaaataaaataaaataaaataaaataaaataaaataaaataaaatatactgacaatatcaaatgctggtgaggatgtggagaaactagatctctcatacatcactggtgggaatgtagtatggtgcagccactttggaaaacagtttggcagtcttaaaagatcaagcaactgggtgggtgcagtggctcacacctgtaatcccagcaatttgggaggccgaggcgggtggatcgcttgaggtcaggagttcaagaccagcctggctagcatgttgaaaccacatctctactaaaaaaaaaaaatacaaaaattagctgggcatggtggcacatgcctgtaatcccaggtactcaggaggctgaggcatgacaatcgcttgaacccgggagacggaggttgcagtgagccaagatcacatcattgcactccagtctgggcgacaagagcaaaactctgatgcaaaaaaaaaaaaaaaaaaaaaaagaaaaaaaaatttagccgggcatggtggtgcacgcctgtaatcccaggtacttgggaggctgaggcaggagaaatacttgaactcaggaggtagaggttgcagtgagctgagatcacgccactgcattccagcctgggtgacagagtaagactctgtctccaaaaaaaaaaaagaaaaaaagaaaaaaaaaaaagccaggcgcagtggctcatgctgtaatcccagcactttaggaggccgagatgggtagatcacctgaggtcaggagtttgagatcagcctggccaacatgataaaatcccgtctctactaaaaatacaaaaaaattagctgggtgtgttggcgggtgcctgtaatcccagctactcaggaggctgaggcaggagaatctcttgaatctgggaaggcggtggctgcagtgagccgagatcgtgccactgcactccagcctgggcaacaagagtgaaactctatctcaaaaaaaaaaaaaagaaaaaaaaaaagaaaaaaaaatctggcaactaaagatacatttaccatacaacccatcaaccacattatttggcatttgtcctatagaaatgaaaatttatgtctacacacaaaaaagagctagagtttgttcctttttggctaatcatcatgaggcagtggaagagaagcatggttagtcgacaggatttaagtttgaaattaaatgccatcatatttatcattcccctcatcttcactctcaatgttttctttttcttttttctctcgagatggagtcttgctctgtcacccagactagagtgcagtggtgcgatctcacctcactgcaacctccccctgctgggttcatgcaattctcctgcctcagcctcccaagtagctgggattacaggcacacgccaccacgcctggctaatttttgaattcttagtagagacggggtttcaccatgttggccaggctggtctggaactcttgacctcatgatctgctcgcctcggcctcccaaagtgctgggattacaggcgtgaatcactgtgtccagccccaccctcaatgtttaatccttgccatgagtagtaagaaggcaggaagggataacaaagaaaacaaaaatctcaatgtagagttaatgctaatttatgattttgctcatctttatagagatatgtatagaaaaagctgggaaatcatgcagtggttcatcattcagaaccatttgaccagttatatttcccgttacctatattctagcacttaccattttaagacactttgacgtttgattccttttctagactattagctacaagagaacagagacccacaattctttaccatacagtaggcactcagtaaatgtgtactaaatttataatcagtgaaatttaactgggaattgactgacttgcttacattaacatgtaagaaagaaatgattaactgcacacgtaaacacttacatagaaacaaaactttttttttcactttagaaagtaacatggattctaaaaatgcatgatttgccttttttttttttttttttttagacagagtctcactctgtcatgcccaggctgaagtgcgatggcatgatctgggctcactgcaacctctgactcccaggttcaagtgattctcgtgcctcagcctccaaagtagctgggattacaggaacgcactaccacccccggctaatttttgtgtttttagtagggacggggtttgaccatgttggccaggctggtcttgaactcctggcctcaaatgatccacccgcctcagcctcccaaagtgctgggattacaggcatgagccaccatgcccagcctggtctgcctttaagcatacctgaattcatctaatactgaccacaattttatgtcacaagtacatctctatgaatgatggaaaaaagctgcataaaaattagttttgtaggccaggcgcggtggctcacgcctgtaatctcagcactttgggaggccaaggcgggcagatcacgaggtcaggagttcaagaccagcctggccaacagggtgaaaccccgtctctactaaaaatacaaaaaataagctgggcgtgatggcgggtgcctgtaatcccagctactcgggaggctgaggcaggagaattgcttgaacccgggaggtggagttgcagtgagccgagaccgcaccactgcactccagcctgggtgacagagcgacactcagtctcaaaacaaaacaaaaaaaacattagttttgtagcaaatacgaaaaaattctggtaagggccacaaaaagaatatgccacacacgaaaaaccgaacacactctaaacccacagaaaaagatatacactcttgaaagattggttgttaacaggccaggtgcagtggctcacgcctgtaatcccaacactttgggaggctgaagtgggtggatcacttgaggtcaggacttcgagaccagcctggctaacatggcaaaacctcatctctactaaaaatataaaagttagctgggcgtggtggcacatgtctgtagtcccagctaccggggaggctgaggcactagaatcgcttgaacccaggaggccgaggttgcagtgagccaagatggcaccactgtactccagcctgggcaacaaagtgagaatctgtctcaaaaaaaaaaaaaaaaaaaaaaaagaaggaaagattggttataacaaataattaacaagactgcggaacaatgaaacaagtagttggtaaaggctgtgggagagaatgaaccaggaggaagatagagaatatttgatttaaattgagactgcacagatcaaatttattgtttttccaacaaaatgaattgctattatttgataccgttttaatgattctcagagcacagaaaatatgggttcacattttaaaatatgcaatctatattttgaagcaatcattaatttttgccatattttgttttttttatatatagatatttattatactttaagttctagggtacttgtgcacaatgtgcaggtttgttacatatgtatacatgtgccatgtggtgtgctgcacccattaactagtcttttacattaggtatatcacctaatgctatccctccccctccccccaccccacaacaggccccggtgtgtgatgttccccttcctgggtccaggtgttctcactgttcaattcccacctatgagtgagaacatgcggtgttaggttttttgtccttgcgatagtttgctgagaatgatggtttccagcttcatccatgtccctacaaaggacatgaactcatcattttttatggctgcatagtattccatggtgtatatgtgccacattttcttaatccaggctatcattgttagacatttgggttggttccaagtctttgctattgtgagtagtgccaaaataaacatacgtgtgcatgtgtctttatagcagcatgatttatattcctttgggtatatacccagtaatgggatggctgggtcaaatggtatttctagttctagatccctgaggaattgccacactgtcttccacaattttagaccaatatctctgatgaacatcaatgcaaaaatcctcaataaaatactggcaaaccaaatccagcagcacatcaaaaagcttatccaccatgatcaagtgggcttcttccctgggattcaaggctgcttcaacatacgcaaatcaataaatgtaatccagcatataaacagaaccaaagacaaaaaccacatgattatctcaatagatgcagaaaaggcctttgacaaaattcaacagcacttcatgctaaaaactctcaataaattaggtatagatgggacgtatctaaaaataataagagctatttatgacaaacccacagccaatatcatattgaatgtacaaaaactggaagcattccctttgaaaactggcacaagacagggatgccctcactcaccactcctattcaacatagtgttggaagttctggccagggcaatcaggcaggagaaagaaagaaagggtattcaattaggaaaagaggaagtcaaattgtccctgtttgcagatgacatgattgtatatctaattttgccatattttcaagttaaatttgacagttaccagcaaatacaaatatgatttgactattttattcagggtgactacatattctgtatggggctgagaaaaacaagtgtgaagcagtaacaggtatttacacagttttacatcctcctatctctattcaaccatatagatatataatcatgccaacaaaagaaatataagtgctttgaattagttatcaatatgtggagttttcctacacaaaaattcttgaataaacgttttcaagcaggtctacataaaaaatttatggccaggcatggtggttcaagcctgtaatccctgcactttgggaggctgaggagtgaggactgcttgagccctggagttcgagaccagcctggtcaacatagtgggacccagttactacaaaatattataaaattggtcggatgtggtggcatgtgcctgtagtcccagatactcaggaggctgaggcaggaggatcacttgagcccaggagttagaggctgcagtgagctacgatcacacatcactgaactctagcggggacaacagagcaataccctgtctctaataaatatatatttatatatataatttatatatatttatatatataaattatatatttgttatttatatataatttatattatattaatataataatataatataattataatatgtattatattaatataataacataattatattataatatatattattattaatccaggctatcattgttagacatttgggttggttccaagtctttgctattgtgagtagtgccgcagtaaacatacgtgtgcatgtgtctttatagcagcatgatttatattcctttgggtgtatatccagtaatgggatggctgggtcatcccatctgccggcagatcacgaggtcaggagatcgagaccatgtataataattattgtaatatatattataatatatgttattcctcttcctgtttattaacagactagaaagaccagacttctggctattctttctcgaaataatttatcaagtagaagaaactagttcaaaggaattatcttttttcaggctcttataaaacaaaatcacttcaaaaggctgcttaatgcagaggcaattagattacttcctgaattcattttcttttttttttttttttttttttggtgacagggtctcactctgttgcctaggctggagtgcagtggtgtgaacttggctaactgcagcctcaacctcccaggctctagtgattctcccacctcggcttcctgaatagctgggactacagatgtgcaccaccgtgccccactaatttttgtagagacggggttttgccatgttgcccaggctggtctcaaactcctgagctcaaatgatccttgccctcccaaagtgctgggattacaggcatgaaccaccttgccccgactgggttcattttctttaaaatgaattgaaaacagatcacaacaaatgaactagttttaaacttttacaggctgggagtggtggctcatacctgtcatctcagtgctttgggaggtcaagtcggatggatcacttgatgtcaggagtttgagaacagcctggccaacatcgtgaaaccccgtctctactaaaaatacaaaaattagttgggtgtggtggcacacgcctgtagtcccagctactcaggaggctgaggcacgagaatcacttgaacctgggaggtggaggttgcagtgagctgagactgcaccactgcactccagcctgggtgactgagtgagactctgtctaaaaaacaaacaaacaaaaacttttacaataaaattacatgaacatagcctggaacattataattagatgctataatccttattcacaatgacgtaatattttaagatattctaaagcaagcctctcttggatttatggagaaaataatagctactatttggaatgtctagcgggtgtcaggcagttacttcttgctttatagaatatataattaagttcaatcctcaaaacgacactataaggtaagtactctttttacatttgcttatctgttgagaaaacaggattggagaggttaaacaacttgcccaaaatgccacagttagtaagatactgaggtagaaactcaaacaggccatgatcattctaaaccagggtttctcaaaagcaacactaccgacgtcttaggccagatcattgttgtgaggagtgatcctgtcagtgcactgtaggatgttgaatagcaaccctggcttctactcactacatgccagtagcaccctcctctcccagctgcaacaaccaaaaatatctccacacactgccaaatatctcctggggagcaaaatcacccccaatcccacaatattgttcttaaaaaaaaaaaaaaggccgggcgcagtggctcaggcctgtaatcccagcactctaggaggccgaggcgggtggatcacgaggtgaggagatcgagaccatggtgaaaccccgtctctactaaaattagccgggcgcggtggcgggtgcctgtagtcccagctactcgggaggctgaggcaggagaatggcgtgaacccgggagtcggagcttgcagagagccgagatcatgccactgcacttcagcctgggtgacacagcgagactccatctcaaaaaaaaaaaaaaaaagagagagacagggtgtcactttgtcacccagactggagtgcagtggtgtgatcatagctcactgcagcctcaaaatcctgggcttaagtgatcctcccatctcagcctcccaaataactgggactacaagtatgcgccaccatgcctagctaatttttaaaagttgttgggcacagtggctcatgcctgtaatcccagcactttgggatgccgaggtgggcggatcatgaggtcaggagttcaagaccagcctgaccaacatggtgaaaccctgtctctactaacaacacaaaaattagctaggcgtggtggcgcgcgcctgtaatcccagcttcttgggaggctgaggcaggataatggcgtgaacccgggagtcagagcttgcagtgagctgagatcacgccactgcactccagcctgggcgacagagcgagactctgtctcaaaaaaaaaaaagagagacagggtgtcactttgtcacccagattggagtgcagtgacgtgatcatagctcactgcagcctcaaaatcctgggcttaagtgatcctcccatctcagcctcccaaataactgggactacaagtatgcgccaccatgcctagctaatttttaaaaactcttgttgggcgcagtagctcatgcctgtaatcccagcactttgggatgccgaggtgggcggatcatgaggtcaggagttcaagaccagcctgaccaacatggtgaaaccctgtctctactaacattacaaaaattagctaggtgtggtagcacgtgcctgtaatcccagcttcttgggaggctgaggcaggagaatcgcttgaacccgggaggcagaggttgcagtgagccgagattgagcccctgcactgaaacttgggtgacagagcgagactccgtctctaaaataaaataaaaaaatctcttttagagatagggttttgctatgttgctcaggctggtctcaaactcctggccccaatagacactcctccctcatcctcctgagtggctgggattacaggctcaaaccactatgcctagctcaagaacaactgttttgaactgaaaagaatgtacaattttacaatcttatttttatgtattcaaaaatctttaaaaatcattactgatcaaaatacaacataaaagaaagatttagtgataaagtaacccaaaacttcctagagcaagcctttatcataatggataataaactttttaaacctgtgtttctcaaagtgtggttggtataaaggagcttgttaaaaatgcagactttggccgggcacagtggctcatgcctgtaaccccagcactttgggaggccgcttgagcccaggagttcaagaccggcctgggcaacatagtgagactctgtctgtattttataaaattaaaaaaaaaatgcagacttctggccaggcatagtggtatgggcctgtagttgcggctactcaggaggctgaggtagaaggatcatttgagcccagaaatttgaggctgtagtgcactatgattgcacctggtgatagccactacacttcagcctgagcaacatagttagattccatctctaaaaaaaaaacaaaaatcaaaatccatatttctagatttcatcccccagtacatttgattcagtaagtccagggcagattccaagaatattgaattttaacatgttacacatgtgattctttatatacactgaagtttgagaatcacagctctacattctgattcttatgggttaggactacatgttatataaatttctatggacagcaaagggaaattaaataaacattaagtgaaccaaatgatgaataacaggaaaaagcatgccatttctaataataaaccaacccgtgatcctcctggaacggttgaagaatgtgatattctacttaactcaaatataatgccttaatacttcctagacacttccttcactggtcctcttttttgtcttctttagttaatagatttataagggaatttcttgttttctctctctctcttttgtttcaatttagagacagggtctcattctgttacccaggttagagttcagtggcatgattgttagctcactgcagcctcgaactcctgggctcaaatgatcctcctgcctcagcctcctgagtagctaggaccacaggtgcatgctaccatgcttggttattttcttttatttgtttgcagagatggggtcttgctatgttgcgcaggctggtcttaaactcctaggctcaagcaatccttccactttggccttcccaaagtgttgggattacaagtgggagccactatgtgtggccaggaatttcttcaaatttgaattgaaagctttcttgatcagggtaaatctctattcctaaagaagctttttcctaagggtgcctctggttctttgtcaagagcccattatttgggtatggaaaggcatggttgagaaataaaaattttgttcctctattgccactacactaaatcccactattcattttccagattcttctttatcttccaaagtcacaaccttcaaatggaaaagttaaaaatttcacctgtgcacttcagatcattctaataatacttgaaaattattaggaagaaacatatcttccaaagactataacatgtaaagataagaggtttatcaagtgaactgctcagcaactccaaaaaagcaattaattcgcaaacaactcctaatgcaaatacttttcccgctaatagtttttttgagacagagtcttgctctgccacccaggctggagtgcagtggcacgatcttggctcactgcaacttctgcttcccgggttcaagtgattctcgtgcctcagcctcctgggtagctgggactactacaggcgtgcaccaccacgcccagctaattttgtacttttagtagagacagggtttcaccatgttggccaggctggtctcaaactcttgacctcaggtgatccatccaactcggcctcccaaagtgctgtgattacaggcatgatcgactgtgcccggcctccactaatagttgttaaacattcaagaaaatatactgatctaaagctttcaatttgtattggatatattttttataaaacaaattacaggcttactatgaaaaaacacattgaatttacaagatattcacaatcaatttatttccctccttctccttggcgtacattagtctattttctaccattcaaataaaacaaaaatagcaataatactcccaattgaaatacttaccaacaaagtaaagtaagtttaaagtctttctcttctcttgaaacattttaactagtatgtccaaaaaaaatcacctcactactagaaggcaatgtctctaatcctatttgtaataatcaagtgttatagaaatctataactataagagattaagaggaccaagaaagggcagtgagacatcagtttaatttcatcttacctgcttgcataatatttaacttgattagctctaccaaagtagcttaagctttaataaccagaaattgtcctattgtcactatcactcatcaaaaatggaatataggatctattaattacgatttaaagctaaaatctgatcctgccattcaaatttcttttgaatttcagaagcaagaaagctaagtattaccagtctgaattcctctaaaatgcaactttccccaaaagcatgtttcttaaaaaaaattctgtgggtacacagtaggtatatatatttatggggtacatgagatactttgatataggcatgcattgcataataatcacatcatggtgaatgaggtgtccatgccctcaagaatttatcctttgtgttacaaaccatccaattatacttttaattattttaaaatacacaactacattatattattattattattattattttgggacagggtctggctctgtcacccaggctggagtgcaatggtacatcttggctcactgcagcctgtacctcccaggctcaggtgatcctcccatctcagcctccctagtagctgggactacaggcacacaccaccatgctctgctattttttttttttttttttttgctaggaacacggttttgccatgttgcccaggctgatctcaaactcctaggctcaagcaatctgcccactttggcctcccaaagtgctgggcttacaggtgtgagccaccacgcctggcctcattcttttttaaatttaaatttaaatttttgtgggtacatagtaggtgtgtgtgtatgtatgtgtacatatatatgtacatatatatatatatatttttttttttgacatggaatgactctgtcgcccaggctggctggagtgcagtggggcgatctcggctcactgcaagctctgcctcccgggttcacgccattctcctgccttagcctcctgagtagctgggactacaggcgcccgccaccacgcccggctaattttttgtatttttagtagagacggggtttcaccgtgttagccaggatggtctcgatctcctgaactcgtgatccgcctgcctcggcctcccaaagtgccaggattataggtgtgagccactgtgcccggccttaggtgtatatatttatgaagtacatgagatgttttgatacaggcatgcaatgtgcactcatcacatcatgtaaaacgagatatccatctcctcaagcatttatcctttgtgttacaaacaatcctattatactcttaattttttaaatctacaattaaattattattgactatagtcactccgttgtgctatcaaacagtaggtcttattcattatgttttttgttttttgtttgtactcataaagaatccccacctcccaccaccacccccagcttctggtagctatcattctactatctccatgagttcaagtgttttgatttttagctcccacacgtaagtgaggatatgcaatgtttgtctttctgtgctcggcttatttcacttaacataacgacttccagttccatccatgttgttgcaaatgataggatctcattcttttttatggctgaatagtactcccaaaacttattcgtgtctttgttctaaccatcagggtttattcataaaaattcttcatattttcacctttcctaatcatctaccagtcttcagatgttagtatgaagtagaacaaaacaaattcttagttaaggtatacatttccaactccctccttaaattaagagatctggaacagatctggaaatataacgggcagataattactgaagaagacagtgaacagagaagtgagcatttttaatccttaaatgccatctgctccattatcagttcacgtacttcctggatagagctaaaatctatccttgtcccctttccttagtttttaattttttggtggtgtctccatttaattgttctgcaactgctactaagcctgtttctctaatcagatattttctagagaactgcagggttttttgcacatgtgatactttcatgagtcatttctcaaagcaaagtttttccaatgatagcctgccttgttaaacatcccaaaaagatcaactgcaaaacatttaccacccagaggaatataatctcactttattttctaacatttacttaacatcttctatatgccaggtactgcattaggtacttcacatccctcatctcatttaattttcacaatagccaaagaaatcagcattttttccattctactgatgaggaaaatgagactcagagtaacttgttaaacatcattgggggtggattaaagcatatcctctttaaaactacagacttttttggaaaactggggagggagatctatctgccatcctagcattatgatgaccatttttattatgcttcagtatgcattgcgtgttcatcactttccacatttcatattattattattattatagattcccagaagtaaagaaatatgaataattttatcaaagaccatgcttcttcatttttatcatgctgcctctctaagataacaccagatgcgaggatgaacaacttcccttccacaacagggggaaaggattcaccataaaataaaaccagtcgctgcaaaaacaagcctttgttgcctagcacaaaacataggctttggaactagacagaccagtgtgggatcccagctcagtttcttagagctgtgcttctatgagcaagcccccaaccaccctcttgcttactgtcagttccctcatctatctatctatctatctatctatctatctatctatctatctggggtgggtagagatgagtctggctatgttgttcaggctgggctcaaactcttggcctcaagggatcctcccatcacctcaagggatcctcccacctcagcctcccaaagttctgggattataggcatgagccaccatgcctggccagtcccctcatctttaaagtccccttatctttcgaaggggttaatacttactctgcaatgttaatgtgtgtattatagataatgagtgtaaactatagtgcctggcatgtagaatgcattcgataaatatcagagaataaatggctgggctcagtggctcacgcctgtaattctgtcactttaggaggtcaaagcaggaggattgctggaggccaggagtttgaaaccagcctggtcaacatagtgagacccggtctccacaaaacatttttaaaaatttaaaaagaaaaataagtccacgttccaatgaaaacattgttaaaggtataaataataagcagggtagcattccatttagcaatagacaactatgaggaacttgagtgatttttaatcatatttatttaggggaggtatcttttaaaaagaatatacatatatgcacactttttttttttttgagacagagtctcgctctcttgttcaagcgattctcatgcctcagactcctgagtagctgggactacaggcatgtgccaccctggctggctaattttttttgtatttttagtagagacggggtttccccaagttggccagcctggtcttgaactcctgacctcaagtgatccacccgcctcggcctcccaaagtgctgggattacaggcgtgagccactgcacccagcaaaaaatagattttaagatcagacattaccctattatttaaagtcaaatttattatagtagatagacctggaatttttttaaataatgttttcaaaaattgacaaaaaaatgttctgcaacagaacacccatattttgaaactgtgtctaaggagtatcatagtagtctttttaaagacagcctaaaccattctcagagagggaaggaggaaaaactaaatcatctttagcagcctatataaattccatgcttactgatgagaaaatccaattttatgttgtgaaatctaagaaaacctacaactgaaagaacagattcccggctgaacacagtggctcatgcctgtaatcccagcactttgggaggccaaggtgggtagatcacttgagtccaggagttcaaggccagcctggacaacacagcaaaaccccatttctacaaaaaatataaaaattaactaggcatggtggcacatgcctgtagtcccagctgggaagtcttaggtgggaggatcacctgagcccagtgaggtcataaggctgtactgagctatgatcatgccactacactccagccttggcaacagagtgagaccctgtctgaaaaaaaatttttttaaatatatatatacatttataaaaagaaagaacagattcctgattttatataagtacacagttaatctgatgtttgttgaggacattttgacagaaaatgctggatgtgaggtaaagaaaaattaagaagtttttgcattcaagatgcttacagtgttagggcaaagactggcatataaacaaggacaatacaggtcaggcatggaggctcgctcctgtaatctcagcactttgggaggccaaggtgggaggatcacttgaccccaggaagtagaggctgcagtgagtcatgatagtgccattgcacagcatgcagcctgtgtaagaggccctgtctccaaataaatacatacatacctacaatgactatatgctgtgctgaattcatctcagttcacctggaggcaccaagaaaactttagccgaggaagaaagaagatactgtttgagctaagacttgaagagtaggaatcttcaggtgaatgaaagggtggggtaagagaaaaggaagatattctcgcataagtcttgtacatgcatgaaaagggtgaatgtacttccaagagagtacagaaagatcaaggaaggcatgtaatttattgccttaacataaaattcaccatattgaccattttaaagtatacaattcagtgctgattcctttaaaaaaaaaacaaaacctattttcagctaggctgttgtgcttccagttcagtgagagagtcaatgaataaatataatttcactggtagaaatgctaagttttaaaaagccttcactttttaattaaaaagaataagtggactaggcacagtggctcacacctgtaatcccaacactttgggaggccaaggcggaagcaacacttgagcccaggagtttgagactagcctgtcaacacagagagactccgtttctacaaaaagataaaaaagtagccagggatattgtggcacatgccggtagtcctagatattcgggaggtggaggtggaggtgagaggatcactagagcccaggaagtcgaggctgcagtgagccatgatcccaccactgaactccagcctgggcaacagagcgagacccggtctcaaaaaaaaaaaaaagtggtcatcgtggaaattcaggtaataccagcaataccagcatgtaaagtaaaacgtgaaaacgttcccctcatcgataatcccaactgcctagagatagccactgttaaggtattgtcatgtatccttacagagatttctctatacatacacatatacttatatataggggatgctgttgtttttaacataaaaaatttctaagacataaaattatgcattgctctgcatcttcttttccacataaccatagcttaggatcctcccaaagaaggacatcaatttctagtttcagtgtctgagcctgctcacttcacgatacttttgacaattgtatatttttattgtactctttgccaatctaataagcaactcattaagtttaacttcctagcttagtttttcttcttatggaatagttcaaatacttagaaacatagagaagatagctttctttcttaattcagctcaagtagacaagtatctgaagtgcttaactggtatttttagagtatgtgcacagtttttctctattagaggaagcacagaatgtacaggaaatagagttagaatgactgacgtagggtttgagtcctcgttcattttctaaatttaagactctttttctcatctataaaattagagggtataagtaattgctagtagtcttaaagtcctaagagtataggactccaaatcacaaacgtttgaaaacgcattgttaaaattcctctacctggattgcttaatggtgagaatactgtatctcctccacttcctaaagcctatgagttccacaagatcttagttttgttcatttatgtatatcaagtgcctagaacattgcctagcatgcttacatttgtggaatgattgaaaatggttaggagctttcaatctggtaaattgccttgaaacaattatttggacaaagtaataaatctggcataatttcactctttggtctaactctcacactcctgaaatgaaaatgctagaaaatagagaactcttacacatcattcagggagttacatcggccagcagtatagagtctcagatatcctactcctgggatctaaagtcgaactccccacccccaacacctgacggggcccacactcaaaagtgtcaaaactcatagctatgcacattcacaagactgtagaagtcgggctgtcacctacgctactccactctcagattctacatccccagaagacaaagagttacagttccttctctcacgaattccacaactccgaaaaccgcgtaattgaagccaccaaaggcatagaagcggcagggaaagggggctgggaagaggcgaacagaccctcttaagccccagtcattgggaaaagcccatgctgctggaaaccgcgttctcacctccttctttctttgggcagaggctgagggaacgtcgcaaacgatgagcagcgccaccaccatggtcacagagacacaccaaaaccgccaacgcgctgccatgttcgctcctctcccttctataagtgaaactttgctccggctaggtctgagggtggggcgtgagaacaggcaaatcggccccttgcctttcctcattggtccagctcagccctgccgggagacccctcacattacgtcacagcgcgctggcgctacac

SEQ ID NO: 1855 - DNA, 78753 bp, Homo sapiens
cgaggctccgtgccccgccccccgggtgccccgcccctttgcgcggctggcgcggccagcaggccaggctcccctcggcaaacctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcaggtgagctcagggccgcggcaggccgggcgcgcgggtcgagcggggtgggctgcggtggggaggtgggggcgctgtcggtggggctgagcgcggcgggggccgccggcgtgagtgagcggaggtggggaggacttcggtcattgaggcggagcggaactcagcagctccccggaacgcctggggtttgagagcggggcccagggctctggagggtggaggcaaaagtggcccagcggctgcctcgctccctgttcccacccccgcccctggtgaaagggagaagtcgaggttgaccccggaggatagtgagagaaggaaagctgtcaggggacccctaggatggggcagtcatccagaggacttaaaatgcaaaagaaagggatgtggacactgctctgggagacctaaggaaggctgggaagaagcgcaggcgaggtgatgaatgcagagggtggggtgcaggaattcatgaacattttgcaaggtattgggaaagactgacgccgaactcatcatctccctccatcaaaccaggttaccacgttctcttcttgacttcaccatgaacatgaaactcgaagtaaaactattttccttgttaggtttggaatggctgtattagggttcctgaagttttggtctcgagactcctttaccctcttaagaattattgaggaccccagagagctcttatgtgggttagagataatacatacatgtaatacatactgatatttaccacctttgaaattaaagctaagacatttaaaaaatattaatttatttaaaaagaataacccattatatggtaacagaaataatactttcgtggaaaaacaaattttccaaaacaaaaaagtctattagagaagtggcattggttttcattttgaagatctctttaatgtcttggcttaatcacagagctggattcgtttatgtgcttctgcattcagtctgtcgcactattacaggtcacagaacgctggaaactgcagtgtccactcctgaaagaatgaatgaaaaagctaaataaagtcttaatattgttatgaaaaatctttatgaccttgtggaccccgcgaaagggtctcaggaactgcactaggggttcccagaccccacttagaaccattactttataccattgttgtaactttggcctgcctttgaaccccttagcagttttttgaacttctcaaatgacaaagatttgtcttacagtataattatttgtacacatctttataaatgccttaagaacaaaaactgtctcttaatattctgttatgtatagaggttagtaaatacttgatgagaggaaagtcattcattcaaaatggtatttattaagtgcttattatttgctagaaattttagaagataaaaaactaacaaatattcaattcctaatcataagggtttatccaggaatggactattatttggggacctttacaataacatattaaatgctgtgttgggtatgaatgataatggatttttatcttttattgaggacatggtatgtaccacaaaatatactaaatgtttacatgctgctgctgctgcttcattcttctttattcttcttatttttgcattatcttttttttttccgagatggagtcttgctctttcgcccaggctggagtgcagtggtgtgatcgtggctcactacaacctccgcctcccaggttcaagcaattctcctgcctcagcctcctgagtagctgggattacaggcgtgcgccactacagcccgctaatttttttgtatttttagtaaagacggggttttgctgtgttagccaggctggtcttgacctaaggtgatccagccgcctcagtcttccaaagtactgggattacaggcatgagctaccctgcctggccacattattttcttaaaccctcctgacaactcttgtttcagagtttgggattgaggcaaaggataatagtgacttgggattattgcttgtgcaaaggagtaatgatgtgaggagggaataactagcaaggcctagcagagaagtggcataatttttttctgttctaggaaaaacacgttgggcttttggatatgcaaaaaaaacaaatacaaaatattgttatgctaggtacataaaattttgaatttctggacttaccataatgtaaaaaattgtctttgggggcagatctccagagtattacggtgctaacgagtactctggttagggaaggttctgggcttcctgaagaaagccaggtatggaggactcctacatggccatgaaggagagagaagaaagtcagcaaggccctgccagggaagaagcgtggctgctggaatccaaaagcagcggatacttgatgttgggtgttgtgttttcctcgcctgccttcagtcagtttttgttaaaggctacaaaatggtcttagctttgtttgggggaactaaaggaaatatttgaggccacttttctgtggagtcacacagagagaaggggacagttgcctaacaagaggtggcaagcacaaagggcatgcagttgtggaatctgagaatttggggtgggaagtctgatgagaggcagatgagtttcacctgtctttcaagatggtaaagattagttttgaggaggttggctggggtgagaagggttggagaatttgggaacgttaagctcatccctatggagatcagaagaattaaacggactttttttcaaaaaacagcactgggagcttgggggctggacagtgaagcaaggtcagctggggatgcttactctatttaagacaaaaaagttattgtaaagtgatttcatgctgttgggagaagatctgtgatactagaaggtcctaaaggtattttttctctggtgccaaagacaggaattatagtgtgagtgtctagtccgtgtgggtgacaagtcccacgaggctgtgaagtgctttcttcagtcactggatctgcagccctagaatctcgaaatgttgcccattctgtttctttttcttctcttcacttttttttctgacactttacatctttcctcaaactgggtgaaaatttaataatacaaataagtaaaccacaagaaaagagcccgttcaaactgtctacaagagattagaaataattgtaaatgttttcattgctgatgactcagagtaaatccttgttgatagcttagttccccacaaccatgtacatttgggaatgtgctatagtcagacccggccctgattccattcaagactgacctggacaccctttgctgttagtgtagatagacacagactctgagggtcttgcccaagctatgtaaattctttggtggcatggaacatctgagccctaaggatggcagaccttccaggaggttctaaatgctgcctaaaattctgttaagtagggagcttagaaatggggctgtggaacctggaccatggaaaaacagtcattgcatacctgctgagtagaaggtgcacttttagctgcagaaatcctgctttcatgcagtttattataggaatgagaacgtgtaaaaggctctaacagaaggtttcctcccagcctgggaaacatactgagaccctgtttctacaaaaaaacaaaaaattagccaggcatagtggcacaggcctgtagtcccagctactctgcaggctgaggtgggattgcttgagcccaggagttcgaggctgcagtgagcctcaacaattattattgaaattcattcagtaatcattcatttatgaataattaatatggacaagacagaattttattgatttaggtattgtcaacctccagcatggtcgacagagaagaccttgtctctaaaacaaataaactaaaaaaggtttccttctcgccctcttggtcttatccttcagtcccatgactttacatttatttgggttgattactcctaatttctatttccagcccatttctctgctttgaactcctagattcacgtatgtaaacacttgtttgccatcttctcttgaatgactaagacacgtcttaaatataacatgtccaaaatttaacacgtcttcccttataaacctctttctttcagtttctgcaccctctggttgttcagtccaaaaacttcgaattcattcctgactccacttttacacacaaatcgtttttgtcagcccatccttcctgctgtaccttcactatatatatgtagaatccaatgtccactgctggcacgctgggccaagccacgttgtctctcaactagattattccagtagccacttaacttctccctgttttgctttgctcccaccccagtctgttaccaatatagcagtaagaattattcttttaaaacatcacatcaggtcttattcctcctctgctcaaaactctcctattgtggccaggcgtggtagcctcacacctgtaatcccagcactttgggaggccagggtgggaggattacttatgcctaggacttcaaaaccagcctgagcaacatagatagaccccattaaaaaaaaatgccaactctcctattgtttttccatctcagagtaaaaacaccattagctaccagttcactcttcaacctgatatcttcttgtctccatccctctctactctggtcacatgtgctttcttgccttcctttggacacagtagtctttgtacttgctgcctactcaggctgagatggtctccacaggtaaccacatgacttgttcacctcactgagctcttctctgatcataatatttaaaattaccctctacatctgctcagtgttacctgtctacttgcgttacctccacaacacttaagaccattggttagttggatacatacacaaaaagatatctctgtgtttatttaaatttatgtctgtacttctctagaatgaaagatccaggaagatacagaattttgttttgtttgctgctgtatcctcaacacctagaaaaaacagtggcctattttaggtgatggagaaatagatcaaattaatgaataaagattccaaatagtaaatgtaccaagaggagaagcagaagaacctaaaaacagcattatggtttgtcccctaaagggtgtataatacattctatttgattatatatttttttaaagataaaaatagagatatttttaaaaagtaaagtacatttgtttcagtcataaagcagtttttaaattaaatcaaaaattctaaattaggactttcagaaactacttcaaagcacactcttacaggaatgtaacttaaaaaggaaagaaagaaaagttaggtatgtataagcatcatcttagctgaaagccagtgcccatacggaaaatcagtaaaaacaaaaagagatacagagtcttctttttctcctgtgcctcttgtaatggaagagaaatcatctgtacttcaatttgatctttgttcttttgggggggaaggaaagccaagtgtttttaattttctctatatcaatatagacattaattaaagcatcacttggttgcatttgatgagatggcttcttaatttcatttatcagatcctggtaaacttctgaatcataaaaattatatttagcatacagcatccctatttttacaaatctcattctaattatttacaaaattagtaatccttgtattgtttctaatacaggttctttcacttgggtatttcagaaactagtaaaataaaatttcacaaaataagagcactaacaggcagcttcacctttttatgttttctgtcatcatagtcaccattgtttcttaaaagaaagaacactttaacacctaaaaatggaaaagacaattttagaataaaagacagctttattgtccttatttttatcattttaccttggactgcagattgtgctgccactggtctacagtccagaatttgagactggttgacttgtgatatgatgattcacatttaacaagaatggcatattgaatataataaaattgaactaggatgcttagaaaagaatacctagtaaatatagtgatcacaggaggccttagaggacattttcaggttaccaaaataatagttactcaaaaaaatgtttaaggaaaagctaaaattgtttcagaaataagcatagttaagaagttagctttaatattcttttaatatccccatattcttattgcataataagagctaacctttattgaatgtctgttacttgccaagcactgtgttaagcacttcttacatggattagctatttaattctaacaaccctatgaggtagataatattactaatgaaattaatttgatcgtatacattttttccatatgaaataatcaacattatcactgaattttaaatcttgggtaacagtataaatgctatgacagcatcttcataagactactcaaaatgaatgaggattaatatttcaagcaataaaatagtttgctaaccttgattctgtcacaccctggcactattatgtttcacctcttgcatctgttcaggctttcagccttgacaattatgattgaaattcattcagtaatcattcattaatgcataattaatatggacaagacagaattttaggtattgagggattttatgtctgcgtgtgtgtgtgtatacacacacatatatgtttaatatgatggggtttctgttttcaaggagtttactataatctagttggataaggcagcttttcttcatgctcatgaagaaaagctcaccgttctaaggtgaaattatgtgagataaaacatgaaacaagtctgcacatgactgcttaaggcccaaatccaggctgctacccgtttcatatagcccatgatctaagactggtttttgtattttacgaattgtaaaacaaaaaacaacaaagaagaatgtgtgatagagactctatggcccagaatatctaaaatatatccttgctggccacttagaaaaacagttgtctataaaataagtgcagttaggagactgtgtctataaagtgtgtttggtggactggtgtggtctaggaggaccttgtagagaagctagagttaatatgggactgtaattcaaattggcaggaaaaggagcaggatctgcaaagatggatgaggtgtgaattctacagtatatcatgcagattatctaaacactttggttggctgttgttggttatgtttctttgggaaagtttttctgtcgttgattgctcggttttttcttgattcttttgtctccccttgaatgtttaatacttgtactttccccttctataaaatgattacaattcatatcattgttccattcttcatggccttctatgatctgatcttaacctgtctttctaatctggtataccactactgcacacaataacatggaaaaggaaattgtatatgtatgttaaatactggtatttttaaaagaatagttttaataaaaggacaataagacattctttaaaggaagggttagcaaactatttccatagagggcccaatggtaaatatttttggctttgcagccaggtattcagctctgcagttgtatcaggagagctgccatagacatttgtgaatatgtgaatgaatgagtgtagctgtgctccagtgaaactttatttacagaaatcaggtagctgaacacatttggcccacaggccatggtccctgcaataggatatttctaggtacttagaagtactttggtttttttctttcttttttttaagaccgagtctcgatctgtcgcccaagctggagtgcagtggcatgatctcagctcactgcaatctccgcctcctgggttcaagcgattcttgtgcctcctgagtagctgggactacaggcgtgcaccaccacacaccggctaacttttgtatttttagtagagatggggcttcaccatgttggccaggctggtctcaaactcctggcttgatgagatccgcgtgccttggcctcccacagtgctgggattacgggtgtgagccaccgtgcccagcctaagtactttgaatgtcaatagtactggttctctttctaaatatactttttaaaaattatcaaaagagccaggagtggtggctccagctctttgggaggcagaggcaggattattgcttgagcccaggagtttgaaaccagcctgggcaacatagcaagacagcatctctattaaaaaaaaattatcaaaaaataaatgcacataaaaaaatcaacagtacaaaaggggttatagtgaaaagtagatcatccagccatgagctctactgtcttaccctctgtgaggcaactatggctacgagtttcttagataccttttcagagtttactctccatgtataagaacacacacaaatgatcttggtaataacaaacgctgttctgtatcttccttttttcatatgaatacacacatagacatactaccttgttaatacaaatagtagtgtattatacacagttttttatgttaattccttcatttctcagtatgtcttaaagacctatgcctttacctcaggctcagtttttttaatgaattaacagtatttcatttgatatacatgccataatttatttaaactagtaattaaggatatttttagtatttttcaattgctaaccttgtaacactgattgttctatccgcttcatttggggtcattttgtatttcatcatctttgaagaaggagtaaggaaatttttctggccttcctattccccattcctaaattaaaggcaaaaaaacctttgtcagtatcaaggctcaatttctctcacatcctgtttctgggtttctcattctcctgatttaataatcatgggacacttggggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaataatcatgggagctgagtgggagaagggaataaagaggaattccccgtgatgaaagaggaggaaaggatactcgcattcattatgtgaatagtttgtcaccacccacccactcacttgtgatttattccatacagcaccaccgtggtccagatatatagcaggtgtatcatgtggaagaaagctgttgacttgaattctttctgttgctttcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggtaggttttgttcttaggattattctccaggagttcatggagccaaacttagaagaaattatctcttttgaccaggtgaactgtgttaagtatttttggaaaatgtaaatgtgtagtgccttgtttgctttcccaggttgaagcaaatgcaatgcatgaatattggttggattgtggttgaagaaaccagctacatgagacatttttgagatagttggaaaaatttgaatgtaactacatatttgatatattaagtaattatcatatgataatgatactataggagaatgtcctttttttaaaaggagatgcattttaaagtatttagggagaagattcctatgacatacattggaatagtgcagccaaaaaaatgaacatatatttattcctatgtatttatatagatgaagtaaagcaagtatgacaaatgtttaagtttttttttgccgcagtgaggcttttgaatgttgattaactcaaccttgtactcttatgagtttttcctgaattaccgatattggatgaggctttgtacttcccacatcaggcgaggcttaggaaacagtccctcttctccattcagctgctctcctctcagctgcagatagagttggtctacagcagtggtggagggcaggagggacatgccattgaagttgcctggttgtggcagcactgcagacctccttctttacctggggatccagtgggccattatttgtcccacaggaagcaaagaggctggttgagcttggaaaggcaggttgagcttggaaagacaaaggacctgatgcactctattttacgtggttttgatgtataccatttcaatatataaccagcttggttatgatatatttttaagttaacatgaggaacttaaaaccataaatgagatgttattttttattgttagttgtgggatagggaattaggaacacatggtatagtggtatgctgtcagttacatgtaccagaaaccccaacccaaataggcataataaagagaatacatttctccttctaattgaaaagcttagagcaggtttggcttcaagagaatcaaggaacaatcctgttctcaacgcattggttggtttttgtctttgctcttcctttcttggcattggcttccttccatgactgactctccacatagcgcaagacgtctgctggctttttctgggctccttcattcttgccccagcaaaacccagagggttcatctagttaactagcttcggtcaaatgcctagctcttaacctgtcactgtgccaaggagatggaatgtgctgactcgcctggcttgaagccaggagtggagttgggttgagtctgctttcctggaaccacatggatcaccaaacaaaattgaaactattagaaggaaaaaggaagtagcagatactggggaggtaaccaaaaagtttactacaaatggaaagggccctggattataaataaggagacttggactcccaatcatcccctgctttacaaggccctctgtagatggtaaaataggcctctgataaatgccctatgaatttgatacacactgtattggatgcttgctttctatttcccagcgcctcttcctaccaacagggctggggtgggaataactagctgctaatgccaccctcccaaatgcaactgttgtttggcaccaaacagtaaactttcttttttaaacctggcccattactgatagaaacagtagagttcctaaagtggtatttattaatttttatattgctggtgcttgaagtagcacccaagagttgtgacatttgaaatctactagtctaggtttcatactgttaaagtccaagttctcatacctagtaaagtctcatacctagtaaagtctacttttgcttactttactaagttctcatactttattgaataccagggcctctgaaagcttaggaaacctttctgggaagtaaatataacatgtatttcattctctttttcaataattatgcttaattactctaaccgttatttgccaagtctataatatgaacataagtattctctacctcacagagttataggagctgcatgagataatgttgtgttgaatttcatctatacaatgacaggggcctcatatctcttttgatttgtgttgtgatcactggcctgagagctagggtttcggaatttttaagtttcccatatgtgaaaccgggcttgactgaaattgagtcatatatttacttaggtgtaacaatttgcctgaattttaaaaataacacaatattttatatttttatttttgacaggccagcaactaataaagtgccaccctaataaacattagtaatcttcctttgaaaaatccatttttgctctttgtgtttttctccaaataggattagcacttttctatcagtgttccccagtgaagattatcctgatgatatttggcttacagactttctcaagattatctcatagggcttttttgcatttgaggagagaataggaaaggaaagcagtttatttttttctttttgtttttaattttctcttcagtacatttgtgagctgtagggaaatattatttgttttattttgttttttaaattttttgtgataaagggtcttgctctgtctcccaggctggaatgcagtgatatgatctcggctcactgcaacttctgcctccggagcctcaagcaatcctcccgcctcagcctcctgagtagctgggactacaagcacgcaccaccatacccagctaatttttgtatttttggtagatacggggttttgccatgttgcccaggctggtcttgaactcctgggctctaagcagtccacctgccctggcctcccaaagtgctgggattacaggcgggagccaccgccctgtttctgtgttaccacttgtgcactgtttctgtgaagttttatgtcatgttagccgtataatatccttaggaattggttgttgcttgaatgttagttattgatttaacagcaaacattttgagatctaataaagctcagtaattttaggaagaagtaattaatttgttagcttactatctgcatctaatatgcataatctaagatttactcttttttttttttttttttttttttgagatggagttttgctcttcttgcccaggctggagtgcaatgtcatgattttggctcaccgcaacctctgcctcccaggttcaagcgattctcctgcctcagcctcccgagtatctgggattacaggcatgtgccaccacgcccagctaattttgtatttttagtagagatggggtttctccatgttgatcaggctggttttgaacttccgacctcaggtcatccacccacctcggcctcccaaagtgctgggattacaggcgtgagccactgcgcccagccaacttactctatttatagatagtagaataaagaaatataagaattacagagaagaattttaatattttaataaagatattgagaataaaaactattttaattatattaagaagataagctctgatagaatcaacttaattggtggtttgcctcgtgtattcaataaagtttactgtattgcaatgcccttgctgtgctaggcattatgctaggtactgtgagtttagagatgaataaaacaatcgtttccacctgctgataggtcatagtttagtaggggagacaaacatataaaagatcatatccaagacagttgtaaaaaatatatatatatagtaagtttatctgatctccagttttctctctttgctatattcttgagtcttagtgaaaatacaaaatagaaatattctaatgttttctctcttttttgcattggtactatttcataggaggacattacttcttattccacaggaagtctgatgattttcctctgtccttacagagagaagcctggtttgggttatgctgtgaactggcctttgaggtctaaatgcagggagatggggaaactttagatttattttgattaaacgagaaactatagtcttacgttgccatattctgttccaagtgacggtggaacaacagtcagaggtagctctgaaaggtaactgtaactgtcatgtggagtttctctgtcttttgagaaactgaccaagtttcttttctggatttgttttggtgcccagaaatagctagagcagtatccatgcatctctaactagagcagtttctgtgatgaggacccagcttcagcagtcactcagcatgtagtctgagtgtaaactcactctggaattataattttatatattttgtgaaggagcctcagaggatcgaggtttttactctctgttgctttctttcttgtcgagcatttccactgcacatgggttggccaacttgcccctcagtgtggtcttacttgaattatatgatagagaaatcgcttctagtttttatttgtggatggtgttcatcccattttccagcgctagtaaattgtttccctacttttattcctttgctcatctcagtgggaattgtagaagggggttaaatggatgtgttgaaagggttttgaaccaaaggtctgtaatgatttttttttttagatcttatttaagtttcaaagactgattccaaagcaaccaatattgacatctgtatagatagacttagatgtgtagttcaaggtgcttttgtttcttttgttgttgttgttgtttgtttgctttttgagtctcactctgtcacccaggctggagtgcagtggcgcgatcttggctcactgcaacctcatctcccaggttcaagcgattcttctgcctcagtctcctgagtagctgggattacaggcacgcgccaccacacccagctaatttttatatttttagtagcgacgaggtttcaccatgttggccaggctggtctgaaactcctgacctcaggtaatccgtccgcctcggcctcccaaagtactgggattgcaggcatgagccaccacacacagcctatttgtttcttttgttttaagtgaaaacattgtgagtgtagaattataggcttcatcagtcctagttacatacatcacgaaatggttgcctggagaagtgatgcccttaacctggaatgggcagagcagaggctgaacgatgggagctgtttagagagaactagcattgttgatgtggatctcattaagatgaatcccaagttgcttttcagctccagtgctgcaatattgccattttatttcactcttcatatgaaaggtgcctcactgagggtacctatgagatgtctgtggcagggtcatgtgccatcttttcagtggcaccttttccatttgcctctactccttttttatttcatacctttttttctcagatccgttgtaacatacgcattgttatgttttggctatttttattactttatctctaaaataagtgcaaaggttgtttaatgttattctttagtttctaaaatacctttacttcacattttatcttcacaattctgtgaagcgacagaacagtgctattgtgaacatttaaattttaaccaacaaacatttacatggaaaatgagatttccaaaagtgatcatttggccaaagtcacaattattgacaaaggtaggattaaaaaccaggtctgctgaccctgacctgaactcaataccatttccataatgctaggaaatttctgaattaagaaacttagttctgtattattacctcagttgcctctttgacccatggacttcaatttttttcttcttgccaacttaaaaagtgctcaaagactggatcttatttgtaagggacttttcttatttcatgaatatgaggaaattggcaattattcctaaaagaaaaatatcaagaagtgaaaagagaaaaagatggtatggatgtgcatgaggataaggaataagtagagggagagaaagggctggtgagcaaggcctgaaggaatgtctttctggatgtggagtgtggaggggagtctcaggcaatgtaacagaataagggatgtgatgtgggaaactagatttagctataatctatacagatttcaattgacatgtaagagaaacatatgtggacatactttgtgtaatgccgtaggagggacacacatggacctactttggttatatactgggggaaattgttagaggaagaggaatgatatttatttgggcacactgtagggcatgtgggtactcttctgtgatagcatagaagattgcagagtaactttgaggacaagttttagatggaagttgataaaaatctttttttgtttcatggcctctgaaagtagatggacttcagtgtatggaatagatctgtttttggaaaaagtatttattgataaactacatcaacatttaaatgcgtcgtgagagagaataacttcaagggaagctatgtgtccttttgtcaaaaattatcctaatttatctttcttataatttcagcagggttttaaatttttgttttattgcttaatagcatgtacttgtttatcggcatatgtgtgtgtagttgaaagcacgatccttggttccatcgtacctagtcacattctcccaggcttacaggaaatcaagtaacttctctgacttctttgtagatgttatctgaaaaatatgcttgtttaccaggaagctgtgtgttcaccgtttaaaatagaactttcatttgtatgccttcgtacagcctacgtagcactataccatattctttttttacctttgttcagcaccttctcactagtgggtgctgcattggggtggctaagggttgaccatgggtccctgtcgcacaaggctttgtgggaggaaggaaatttgtgtggttaaaacatgggaggtattgcaactcattttcttgactattcaccaggggtggtttccaaatcacattttgcctttcaattctcagtctttgaagcaataaattgtatatatatgttacacacacacacacacacacacacacacgcttattaataaagttgttggtgcaggacaggcttataaactgttaatttagatgtacattaaaagctactttgtcttggccaggcacagtggctcacacgtgtaatcccaacactttgggaggctaatgtaggaggatctcttgaggccagcagttccaggcaacatatgaggccaacctgggcaacataatgaggccctgtttctacaaaaaaaaaaaaaaaaaaaaaaaaaaatactaattttaaaaatcacttagtcttgtgtcccatacaaaggaaggataacttttagaacctggccatatgatccctttccagtagtcacctgcttctttgtaagatactctagaggaaaaaccctttccatccttcttgtctcttatctccttgtataatggcagagaatatttgccatggtatattcatgagccgtgtcctggtgtgggattgctctttgtgtgatacactttctcagtaaggtaggctcactgtggcagaaagcgggattaccgtgggagatatattgagaatcaccaagaggccggtcatggtggctcactcctataatcccagtgctttgggaagctgaggtgaggtggattgcttgagcccaggagctcaagaccagcctgggcaacatggcaaaaccctgcctctacaaaaaatgcaaaaattagccgggtatggtgatgcacacccgtagacccagctattgggggtgctgaggtgggaggatggcttcagcccaggaggttgacactgcagtgagccctgatcatgccactgcactccagcctgggtgacagagtgagaccctgtctcaaaaaaacaaaaagacagaatcactgagaaagcaaaacataaggtttaaaacctttaaaaggcaagaaaacctaggtttgcatcctggttctgccattttacaatgtaaaaaaaaaaaaaaagtctcagagagtttaatttaccccaggtaatttgggtgaccttctgcaaattacgtacctttttttcattgtaacatagatgtaattagtatctaccttgtgtggttatttcaaaggttagtgataaaaatgcctggtgcatgtaaagcagtcagtaacttgctgctgtagtaatttctgttattattatatatattcaacaaacacgtgttgaacacccactaacacccactgcagtgccatatgtgggcacaattctaggtgctgaatgaactggtgactaagaccatcaaggtccttggccttgccctcatggagcttctattttaatacctaagacggacagtaagaaacagggattttagagagtgaaggacactgaactgggtgaatgtaatagataactggggggtgggagggtacctaatttagagacatttcccagagaagctggtgatattttagtaagaaacctggatgatgaggaaagagcctgccatgaaacagtagaatagtggaagccagtggggtggcggttgcgggggatggcaaagcggagcttgtggggagaacccagcagaggactggtaagtggaaaggcagaaaagagcttggcttatagaaggaaggaggcccagtatggctggagcttggtgagcctggagaagagcggaggggccaaaggagcagttcgtggaggactttgtagccatggtaaggaatctggattttttattctaagtacaggcacactttgttttattatgcttcactttattgcactttgcagatacttcactttctgcaagttgaaagcttgcggcacccatgtgtctagcaagtctgtcagtgccatttttccaatagcatgtgcctacttcatatctctgtgtcacaccttggtaactcttacaatatttcgaactttttcattatatctgtcgtggtgatctgtgatcggtgatctttggtgttactactgtgattgttggtgcctggtaagatggtggcatccaggtggcggtcttaagaccagatcagtatggtgttggtggtcttaagaccagatcagtatggtgttggcagatcagtatggtgccgctaggcaggcactgactagctccaggcagctcaaccttgggagcttcggggccccgagaggtggagcctgtgagtggggcatgcactccatgtggaagccagagcctcctcccctggatggagtgtacgagatccctggaccggagcccatcccctctgtgagagagatgtacttcacgcccgggctgccaccgctgatcttcctgccctgggaccctgggtagaaacacccaaaattctgttcaccccgttcacgaccctgggaccctggctcgaagcacccaaagttctgctgctcaagctccattcacgagcagccaccatacaaagaccaggcctgctatgtctttcaccagcgttgccgccttctcaggggtgtcaagcaggccctctggcttaccgaggccaagttaataaaatgccttcctgagaaagtacttggccttgttgatgatacaaggaaccacatagagaaccaagatgagcgtcttctgaatttgatctctcatgcctgtctctggcactgtactgagtacggccccaggagagaggcctgctgtctggtcattgtggacagtctgataaagttgtgtaagtctcagattctcaggcatccttctctggccaggcagatttgtgcccaaaactccacgttatccaccacctggaattgtgtctgttcttcagggtcatggttctagtggagccggctgagtgccaaggatcctctgcccccgccatctcctccagagaagaggttgaagctactaaaaatcatgttctcgaggccttctgtcccctctccccactactgatcttcaggaatgcaatgtttctgatgtgaaagatgacacaggattctgggagggctatccttacccctatctccatatcctgcacttcctggagaaagccgatttgcaaccacatagccttcaaccagatcagctgtgggccaagatgatcctgtttgcttttggcattgccctggctcaggcccagctcctctgtggcaatgacaccaagatctcggagcagcccgtggttgtgcagagtacatgcacagacggacgtgcattccatttcctggtgttacagtagaacaccacagacctggcctcttaacaagtgtggcaagagtttggtctgggtggaatcatgccagctactctctcagcatttttggtgtctcccagtgataaaaaagaaggtgggaccgggcccagtggctcgcacctgtaatcccaacactgggagtctgaggtgggtggatcacgaggtcaggagatcgagaccatcctggctaacgtggtgaaaccccgtctttactaaaaatacaaaaaattagctgggcgtagtggcgggcgcctgtagtcccagctactctactcaggaggctgaggcaggagaatggcatgaacccgggaggcggagcttgccgtgagccgagattgcgccactgcactccagcctgggtgacagagcgagactccgtctcaaaaaaaaaaaacaacaaaaaattagccaggcatggtggcacgtgcctgtaatcccagctactcaggagatggaggcaggagaattgcttgaacctgggagatagaggttgcagtgagccaagatcgcgccactgcactccagtctgggcgacggagcgagactccgtctcaaaaaaaaaaaaaaaaaaaaaaaaagagggtggttgtggaatgcgttgggctgactggtttccagtgggagacatccaggaagtttttagctctgtatttacatggtgctacgtgagccaaggaccattctgaggcccgaaacccacctttgccttctcccactgaagagggcctggggtccccctggagcctcagtgctcatctagcctggtggtctcactgacaataaagagcccttgcattgcaaaggaaaaaaaaactattataattgttttggggtgccacaaattatgccactataagaagttgagcttaattgataaatgtcatgtgtattccaactgctccaccgactggccattcctctctctctctctctctctctctctctcactctctccctccctccctccctccctccctgtccctcttcctctcccacctccccactccctctttgggcctccctattccctgagacacaacaatattgaaattaagctgattaataaccctacaatcgtctctaagtgttcaagtgaaagaacagtgacacacaacaatattgaaattaggctgattaataaccctacagtgatctctaagtgttcaggtgaaaggaagagtcacatgtctctcactttaaatcaaaagctagaattgattttacttaatgaggaaggcatatcaaaagctgagataggctgaaaagctaggcctcttgtgccagttaaccaagttgcgaatgcagaagaaaagttcttgaaggtaattaaaaatgctacttcagtgaacacacgaatgataagaaagcaaaacagccttattgctgagatggagaaagttatagtagtctggatagatcaaaccagccacagcatgcccctaagccaaagcctaatccagagtgaggccctaactcgcctcatttctgtgaagacagagaggtgaggaagctgcggaagaaaagttggttcatgaggtttaaggaaataagctgtctctgtaacataaaagtgcaaagtgaagcagcaagtactagtggagaagctgcagcaagtcatccagaagatctagctaatgccaggcatggtggctcgtaattgatcatggtgtctataatcccaccactctgggaggccagggcaggaggattgcttgagcttaggagtttgataccagcctgggcaacatggtgaaaccccgtctttgcaaaaaatacaaaaaattagccaggcacagtggcacctgcctgtagtcccagccactcgggaggctgaggtgggagaattgcttacacctggaaggcggaggttgcagtgagcgagatcatgacactgcactccagcctaggtaacagagacagaccttgtctcaaaacaaaaaagcaataaaagatctagctaagataattaaagaaaatggctataataaacagatttttcagtgtagatgaaacagccttctattggaagaagatgtcatctagaactttgatagctagagagaagtcagtgcctggctgactcttgttaggggccaatgcagctgacaactttacgttgaagccagtgcccatttaccattctgaaaatcctagggcccttaagaatgatgctaagaaactgcaaagtttttgtcctgagtaaccagatggatggtggtaggcagtaagactggtttaccatctttgagatggggaaactgtggggactggcagaggagtagattttgtgtcagaagggatttgggacatataaaattggtggtggctataggacattcaaatttaaagccaggatagccaaaactcctatattttttagatttattacttgttctcttttgtcattgttgcaactttttcctgtcacatcgaaacttgggaaatcagaatctttgtattttaaagttgtgatgtaaaactctcctggcagatgaatggtaaatgtggggacattaaaatacagtgttatgaatttgctggcttcagcaagagtgcttatcccattttccacctttcctaccaacatgtatcacagatttcagaaaaattctgaacttcatccgtcctgtactaacttggcctcgacataaaggattaatgaatatgaatgtcctcccttggcaagagtttaaaattctgagaggctctactatatttactaaagattttctagggcttctcgaggccctcaaatgtgctaggtatacaataaatatttactcatttttaattttgcttttatttagtatctttgtgctgtgactttcatgaacattattttttttcctagaaagtttagtacctttgatgtattaagattactgttatttacactgtttcctttttacttgtaatcttgttttgtttctttgcattggtgggtggtagaagaaaaagacactgttatgaggtcacattcagtatagacaaggaaagaaaataaaagtaggtgcaggaaattaagttttataagttttaattatctttttctttacttcctaaaagccagctaacccagttttattaattacaacttttgcaaatgtaagcttttctagctttggtttcttttatgtcagttatctattgctgcattaataaattacccccaagtcagaagtgaaaaacaacaactgtttattatctcacacagtttctgaggctagtagtccagaagtggcttagctgggtagtcctggctgagggtctctcgtgaggcagcagtcagactgtcagccaggtctgcagtcatctgaaggtttccccagggttggaggatcttctcagatggctctctcacaggtgttgtcaagagacctcatttcctcactggctgtggcgggagatctgtttctttctgtagagatatggtttggctgtattcccacccaaatcttatcttgaattcccatgtgttgtgggagggacctggtgggaggtaattgaatcatgggggcaggtctttctctgctgttcttgtgatagtgaataagtcttatgagatctgatggttttataaaggggaggttccctgcccgcaccttcttctcgtttgtctgccgccatgtgagacatgcctttcaccttccaccatgattgtgagtcctccctagccacgtagaactgtaagtctattaaacctctttcttttgtaaattgcccagtcgtgggtatgcctttatcaggagtgtgaaacagactaatactcttaccacttgagcctctctgcagggctacctgaatggcctcctgccacagtcatgtgcttccctggggcgagtgagtgagagagaggcaagagaaggagttgggggtgttccattattgactaggattttcttccaaattcctgtcaaaagtcttccaagcttagatgttggcagttattcctcaaatgaggaatgtttgtgtcacaggtatatcaaatatatatctcactgctctgtttctgtgtctttctcttccaaaatcattttcatttcaatactaaataataatgcagtcatttgaagacgttttcaatggtgttgtctttgtccattgcatgcttccataatacagtaccacagactgggtaatttttaaagaacagacatttatttctcacagttttggagcctgggaagtccgtgatcaaagaaccagcttctgatgaaggttttcttgctgtgtcctcacatggcaaaagagagagaacctacctgcaaaccccgttattacagcggcattaattcattcgtgagggtagagcctcccgctaggccctacctcccaacattgttacattggggattcagtttccagcacatgaatttgggggcacatattcagacaatagcagacattgcaacttaacacgtctgttactaacagtgcacgtaacttgactgaagtggcagccatatgagcatttatgaccaaacatttccatgagctaacactgagaactaccctgtggctgtgcctgacaggcatctgttataaggtgcatcctgatttcagaagtgttagaatatgggggaaaaaagcttctagaaattgaagaaatatggtaaataattttctcccccacccaatcatggggaagtacaatagatcaaagtcttctgcaagtaagtttctttcctctgattttacaaaagctgcaactcacaaagtgtaaattgattgagaaggagatgtgaatgagtgatttatgacaaagataaatatgcaagttatttctaaaatgtttcaatttttggtttcagatgtataaacaaggaaaatccctcttgtgactttaattttttttttttttttttttttttttaggaataaagattactgtaaacccagagtcaaaggcagtcttggctggacagtttgtgaaactgtgttgccgggcaactggacatccttttgttcaatatcagtggttcaaaatgaataaagaggtaattttttaaatatatcttttaattcttccaaggagagagaatgatagagaattaattaacattatcgtcctaaatgtagttttaacagtttggtaaaagagtctgatagacattgctaggttattactgaagtagtcaatagtcattattttggtaagacagttccagaattgtctcatgaaaacattgtaaacaataatgaaattagttctccactctaaaaattgtggaaaatagggattacttagggcagcagtgttagcgagtataaaacatcaccagtacattcttgtgtatacaaactcttcacaacagattatgttccaaccaaaatctttaaaagattttcaaggctatatggaaagttaatgtgctattctttttaagaattccacatcactgttttatctgtatcagaagatttaggaccttgtggtagattctgaagtaaaattcagatgggcagaatgggccatttattccttttgtgaaatgattggatccctgcagcacccaacaaataatttaaattcacattttagaattctcttttcttcagagttccttgagccatcttgcactggggatttctcagtgggctggctgcctgcattgtgtcccacttctgtgggcttttatcttcgatccccccatccctctctatcctcctcccacttccacagtaccttgaaagtccatattcttttcactctgttagtcccagtaattcagctttcttccaaacttgatgtcacgtctccctttgcaaatctgaaactaaataaaagctgttctgagaatgacttttcctttaattggattgcctcatactgtaggtgaattctgtggttttatacgattttgtttccgtctgttacacagaggtaagacagagcaactgtggaatgtagtaaaaagattgcatgtagctttggcactagataggtctgtgttggaactctgactgccattattagccatgtgaattcctatcatcagaggttgtgagaattaagtagacaggatgttttacgtgcctaggctcttgaaagattgcacctaaaggtatttttttatcatattttctcaattgcaaagttactttcattttattaaatgccctttgaggagaaatagtggaaaaaccctactacattaagtatatcatttgtaagctatgtcctgattggaaaaaggtagaaatgtaggggatggaaaatgcatcttagagttgaagagttgtaatggattttaaaactcttaagttttgtaaaaccacatgatcataggagtattgtaggagatgtttacttaacaagtgcttgttgagcacctgttttgtgccgggccatgttctaggtgtgatgatacagcactgaccagaaggtctctgccctcaaagagcttacacgccagtggggacagagcaagtactgttaattcctgtgagttaagagctatgaggaaaatcaacagggtggcaacataatatgagaagctactaaggttttaagcaagggaagtaacatggtaggattcgtggggttttttgttgttgttgttgttgttttgttttgtttttttgttttttttttgagatggagtctcgctctgtcgccaggctggagtgcagtggcgcgatcttggctcactgcaacctccacctccccggttcaaacgattaccctgcctcagccttctgagtagctgggattacaggcgcgcatcaccacgcccagctcattttttgtgttttaggagagacggggtttcaccatgttggccagggtggtttcaatctcctgatctcgtgatccgcctgcctcagcctcccaaagtgctgggattacaggcgtgagctgtcgcacccgactaggattcatgtttttaaaacataaacttgcggcttgaaggaagcagagaacagcaaggtgagcagttgtcttaatacctgtgcttgactggaagtagcagtagcgtggagaagagaaggtggatcacagtgcataattcagtgtatattttagagagagtcaactaagctgacagattagatgtagagcatggggagaaggaagagaaatcaaggatgaccccttaggctttccacctgagcatctgagatgtgttatatactgaggtgttgaagattggaaaattaattgacagaagacagattaacggagaaaaagcttatttgtgtgcatgcaagagctttcagaaggagtagcttgctaactggttaagttatgtagctaatttagtagggaaaggcaggggccctgtgagcataatggatgggtttcttcaggaaagacaaaggggagaagaacaagggaagatagcaaagtttgtggtaatgttgttcatgcaggcaccagtggtatctcctcttcattgtgaccgtaaagtccccaaagagagatttatggtacttttactcttggtctgttgcctgggggtaaaagctgccccacgagggaatttatggcagcctcatttcccagaactttctgttttgggtcagataaaggaagactgagaagacttctttctgtatctgttgagtcccagatgtcttcagtttaatataatcttcataccaactcaggggttctgagtgggtctccacagatcttcagcccaagtagcctttgttaagaggatacatcttccattttaacaggagggaacagagcagttataaataagtacagacatggataggtttgtgatttgttggcagaaaaaggaggtaatttctgtctgaagtcagtgcctaagagaactaggattacaggaagtttgaggaaagagtatacatcaatagtctagaaggaaaacacacttaggacgatatagtaggattgtcaggcagttgtaagtgcagcctgtcatcccagttgtcacatcctgagcaaaatactcttgctttggtgtaggtactgaaaggggagagagtagagttcagtaacttggggtttggagagggaggaggtgagcttgttaaagtacaggttgaatatcccttgtctgaaatgcttgagaccagaagtatttcagattttggattttttttaggtgctgaaatatttgcattgtatacttaaaagttcagcatcccaaatctgaaatgttccagtgagcatgatggaggtgctcaaagagttttgaatttgggagtatttcagattttaaatcatcagattaacctgttctttgcaagggagttattgtaatgaggcacttgagtaagccccttggcaatgtgccaaagttgggtgtagctgatcaattgctgggagcagaaaaagcattaataaaagaaaccttactattggaggtggggactgtggatggccatcccgtcttactgtctcattgatatgctttccatagctcttctctgtctagaccttgaaggagattggatattgtttggttaaggagtttatcctcttacagaattttgcagatcagaaggtccggggtctcaaggtgaaataacttgcccacgtcttcccagctaatgtggtcagagctgaaagcaatagccaagcccaattctctgtgttttctctatgccgctgtggtgtttgtatgttgtatggctgctaaactcataaatgttgcagttgtagattctttcaatactcagtgattgatctcttaaatgccagagcaaatagttttctgttagtgagcctttggaagatgtttgggggccagcttaactctctggtttatggatttgtaaaagactggatttttaatacttcagtcctaaataactcaaagcgttactgtttttaactcagaaatgttttagaacttgggggaaaaatgttgcactttcaaagcttcatactgaaatcatagattttgtacagcatattttataaggtgtgtttttgatgagtcatccacttctcttattgattctttcacagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagtaagtaacgaaagaagctgaatgttgggatggggattccccatattttattttattttaaatgtttacttttaaacaatttcaaagtatcaaaaaacatagcaaaatttcacataggtacttcatccattataatgtcaaccattgttaagatttgatccatgtgttttgtctttcttttttttttaatttagtttttggttttgttgttttttaagacaaagtctttttgttgcccaggctggagtgcagtggtgccatctgatctcagctcactgcaacttccgcctcccaggttcaagtgattcctcttgccttatcctcctgagtagctgggattacaggcacatgctatcacacctgggtaatttttgtatttttagtagaagtggggtttcaccatgttggccaggctggtcttgaactcccgacctcaggtgacccacccgcctcagcctcctgaagtgctgggattacaggtgtgagccagcatgcccggcctgctttaattgtccttctgtgtgtgtgcgcgcacgttcacacatgcacacacacatatatgtgtgtgtgcagatactttaggatgacatagacaggcctcagtctggtcgctgccactgacctcttcaagtttgccttccttcatgttccattactctgccctcacacacggcacctatattcaacttcgtttctccctgctgcttccatggtctcgaaatgtcttgcatattcacactccacatctttgcgtcacttcttccttccatcttgaataccttttctgtctgtcatacttttatgactctttcaagcctcagctccctctgctgccttggcattctgattttacctctattatagaactcgttgcattgattttgaaattatttgtttgctagctgtctgagcagtgtagggataaggagttcccttttctctttctagttcttagaacaaagcctggcaggtagtagtcgcttaccagttatgcaattcattgaccaccctcatgaggcacagccttgggcttcgatgttacagctattttaaactaagcatgagagagagcccctgaccccaaactacttacacaactatcaggaaagattatctgctacaacagaaagcaggaagactttcttgctaccacctctttctcccaaaagttaatcttttgaacgtatttctatattttggttgtttgtgttgtcaggcttgtctccctatctaactgaactcctgaagggaaagtctcggtcttaataatctttcgtaaaaacaaacactcaataaccaatagcactcagtagatgtttgttgacagaatgaagaaccagggtgaattctgtttaacaaagtagagacggaaatatttccatcaaaaacatttaatattcttacatttaaagcacaaattcaaagctacctaaaaatctctgaaggattcttgatatctagaacacttccttatttaagaaacagattgtggatctggcatggtagctcacacctgtaatcccagtactttgggaagctggggtgctggggcgggtgaatcacttgaggccaggggttcaagaccatgctgggcaacatggcaaaaccctatctctacaaaaaaaatgcaaaaaaaaaaaaaaaaaatggggcctgatggtgcacacctgtagtcgcagcaactcaggaggctgaggtgtgaggatcactcaagcccgggaggcggaggttgcagtgagctgggatcacaccagtgcactccagcctaggtgacatagcaagaccctatctcaaaaaataagaaaaagaaacattgtgaaactaacatcatggaaaaatgctatttcctgaagttactcttactcatgaatactaaatatgatcattataaaaagtagatcagtagataagcacatagcatttgagacctgatagtcttgagttctataattaggatatgaatcaagaagaggtcagtttgttatgaatttgaatgttgtggtcttcagttttgtaggagaaaaaactctcatatagtagtcttgctgctcacttttcaattcttttccataatgcgtatttttctcccaaactattgtattgctcctaaaaaatgatcttgtggaaaaaaactctagcgttgatgtcagcactaaaggccatgtagtgagtgtatcattcactgcaaggaaacattcatcagactgctttgctactcactctgctccatctttttagtgcaataactagcattgatcaagacaaaaaaccagtctcctctaaagagtagttgtcagatattattttgtttatttggtgcacagtcaagaaccatgttctttgttgtatttgctggacaaaaagaaggatagggaggaaaacactttttgttaaaagagttaaaatgctgctgtctcattcttttctctcactttagtcttccgtaaactcaaatgacgttaaggttgttgagaaataaaatatcggtcaggcgcaatggctcacaccagtactcccagcactttgggaggccgaggcaggcagatcacgaggtcgggagtttgagaccagcctgaccaacatggtgaaaccctgtctctactaaaaatacaaaaattagctgggtgtggtggcccgtgactgtaatcccagctactcaggaggctgaggcagtagaatcgcttgaacccagggggcggaggttgcagtgagccaagattgcaccatggcactccagcctgggtgacagagtgagactccatctcaaaaaaaaagaaaatatcaccattttctttaaataaaaaatacctcatgcacctctgcattagcccattctcacactgctatagaggtactatctgagactgggtaatttataaacagaagagttttaattgactcacagttctgcatggctggggaggcctcaggaaacttacaatcatggtggaaggtgaaaggaaagcaaggcatgtcttacatggtggcaggagggagagagagcaaacaggggaaatgccagacatgtaaataaccagatctgtgagaactcactgtcacgagaacagcatgggggaaactgcccccatgatccaatcgcttcccaccaggtccctccctcaacatgtggggattacagttcgagatgaaatttgggtggggacacagccaactcatatcaacctttctcaattttatttaacttttttatcccattttttattaaggggtaatttatatacagtacaatgtacagatacgtgtacagtccagtgagttttaacatatatataacatgggtatatgtacccatttaacatatatatagtcattgaccagtctagatattttatattcagcttcttccactcagcataatgtttttaaaatttactcatgttgttcagtgtatcattaggcagtcccatctttttgctgagtaacattccattgtatggattgactagtttgtttattcattctcctgttgatagacatttagtttgtgtccagttttggaatattatgaataaagctacgatgaatattctcatacaagaccttttctggacatatgttttatttcttctggatagttacatagaagtggaattgctgaatcctagagtagatatatgtttaatttttcttaactgccaaagtttccaaaatagtttaccattttgcattaccaccaacagcgtataagatttcaggttactcgccccatatcttggccaacattggttgttagctcttattgatgaattaagcttttggtcattatgaaatgctcctttatctctggtaatcctctttgtcttgaagtttactttgtgtgatactaatatagccatggaagctttcttttttgttttgttttgagaaggggtctcactctgtcaccgaggttggagtgcagtggcacgatcatggctcactgcaacctctgcctcccaggctcaaatcatcctcctacctcagcctcctgagtaactgggaccacacacatgcaccactgcacctggctaattttttgtatttttggtagagatgggatttcatcatgttgcccaggctggtctcaagcgatccgcccacctcggcctcccaaagtgctgggattactggcatgagccaccgcgcctggccagaaccatggcatttctttcataagcttttttgtatagtatatgtttttcattcttttagtttggaatgtctttgtttaaagtttcattttagatgacagaatacaggtaagtgttgctttttgctctagtctagaaaaaagtctctttcaaggtgtttagtccatttacatataatgtgattatgtttaagtctgacatcttgatgttcgttttcagttagtctcatctgttctcttttgatcctcctttcctgacctcttttggactgggattacaggtgtgagccaccgcgcccggccaaaaaagcattttttaatattccattttatctcctttattgactttagctgtgtcttagtgttattttttagtggctgttttagagattacagtatgcctctaacttattgtagtaaaccttctacatattctaccttaaaatataagaaccttatatagtatactttcattgtgccccccattgtatatttgttgtcatatattttacttcgacatttacttttgagcaatcttgtaaaagtacgtgtgtgtgtgtgtgtgtgtgtgtgtgtgtgtgtatttatttttattattatactttaagttttagggtacatgtgcacattgcgcaggttagttacatatgtatacatgtgccatgctggtgcactgcacccactatctcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgttatcatgaataatgccgcagtaaacatacgtgtgcatgtgtcttcatagcagcatgatttatagtcctttgggtatatacccagtaatgggatggctgggtcaaatggtatttccagttctagatcactgaggaatcgccacactgacttccacaatggttgaactagtttacagtcccaccaacagtgtaaaagtgttcctatttctccacatcctctccagcacctgttgtttcctgactttttgagatggagtctctctctgtcgcccaggctggagtgcagtggcacgatctcggctcactgcaagctctgcctcctgagttcacgccattctcctgcctcaggctcccgagtaggtgggactacaggcgcccgccaccacgcctggctaattttttgtattttttagtagagacggggtgagtcactcttatcacccacgctggagtgcagtggcgtgatctcggctcactgaaacctctgccgcccagattcaactgattctcctgcctcagcctcctgagtagctgggataacaggctcttaccactgtgcccgggtaatttttgtatttttagtagagatggcttttcaccatcttggccaggctggtcttgaactcctgacctaatgatccacctgcctcggcctcccaaacttctgggattacaggcgtgagccaccgcgcccagcccacgtgtgtataatttttaaagattttgtttaaaatattcactgacatagttacctgttgtggcactcttgagtctttccttctgacccaggttgctatcaagtaaaatttcccttctggctgaagaattcctcttaatacttcttatggttacagtctgctgtttttctgtaataatttgtaaaaattatttgtgtaataatttgtagacaaattatctcagcatttgaattctgttaatctgttgtcttcatttttgaaggatattttcgtcgtgtatagaattttagaggtgtgttggtttgttttcaccactttaaagatgccattccattgtcttttggcctccattgtttatcatggaaatttatttattccttttataattgctcccttgaatttttcctgcttggaattctctgattcttggacctgtaagttatctttcatcgattttgaatcatttttagccataatctccaaatatttttcttctactttctttctgggactcttaattatatgtatgttagactatttgatattgtcccacagatcttgtaagctctttttttttctttccttcactttatctcttttgtttccagttagatttcttctaacctgttttcaagattactgattttttggtgtgaccagtttgctggtaagcccatcgaatgcactgatgagtggaaatcttgatattttaaatttctgttatttccatttggctcttttttttttcttcaatttctcactgctgaaattgtaagttggccaccatcttctgtgcaagttgattaactgcctttttctccagatcctttaagatgtttatcttcgaattaatgtgagtctctatctgataattccagaatgtaggtcagctctgcttttctttttctttttttttttttaacaagtaaacatggtttattttagaaatgtgaggctatttcaacattagaaaatttttttttaattatactctaagttttgggatacgtgtacagaacgtgcaggtttgttacataggtatacacatgccatggtggtttgctgcacccgttaacctgtcatctacattaggtatttctcctaatgctgtccctaccctaactccccagcccctgacagggttacattttctttcttcttcgtaagtctcataattatttattcaatgctgaacattgagtataaaagaaaaatagcattaacatatgagattaacatattacacattaacatatagagattgaaattaatatttttatgctcaggaactagacacacccctcgtaatggctactagaataggggtatgagtccatccagtttgtagttgttaggtctgtgctttagatgtattcagtttactactgacggaattgagggtagaatgaggatttccctttggcaggactgaaattgacatatcgagaagactagaaatctctgttttacagctctagtgccaaactgcaagagatctctctccactttacatccagagtctcagcttattggaccactgaagcatttttgttcaccaaccccacccttgtctcttctatgtctcagggggtctgagacccccctgcctagctgccttgcccccagccagccttggaaagcaaaggcactgcattcactgagggcctcgtgggcctccaagggtttccctcaggcctctgttgtgccgtcagccttcaacaggccctgtggacctgcacttcacaggtgatcttttagctctcctctcctccttcgccttctgcaagagcacttgagaagggccgaagacagggagttggtgagtgaggcagaatcttttgcagctggggttccttgaggatctaattggtcatgcccactaggggtgaccagccatctggttttcccaggactttcctagtcttagcacttttaagtgctgcattctgggaaacctttctgtcctaggcaaactgagaccactggttaccctaatgccagctcacagtctgcctttaaaattttgtaaaacattcagctggcttacccttccttgtcaactcagttctaaaggcattaggtggcaccaaacatggtagacatttgtgtggggtgggaggcagtgggaagggactgggatgacccagagcaggatatcaaagccccggtaaggtgtccatgtgggagtggagcagtctccagaaataatcctgatgaattaagagagcaatgcatatctttctagactatttttgtgcatgtaataatatatctataagtggaatcatattcattcaatgaatattactgatcacctgtaatgtgttagacactgagtttcataatggagacttgttgcataaaattgacaagctctttgccttcaggaaacttaaagagtattaaatgagtgttaagtaaatgatgtctaatatctgcctggggtagaaatgttagtgataactcaccaatatttattcagtgcgggttacaaaacttatttcagtatgtcaaagaacggaacttagagctttccatgttaaatgccaatatcgttcaagatgttaataagttgtttgcctcgatcaaaaagattctgcagccaaacacatttagaagacacttgaactatattcctctccttaattgacaattcatactaacacttttaaagctttgagaagtcctgcaatcgagaaatgtgtttaacccagaattttctaagtttatttgtccacagcattcttttggccacagaatatctcgtaatatttctatgagtgctatagtttttttaaacagtttgggaaatgttattaaaaattgtaacaaatgaagggggaacttgacacatctctttaattatagggaaattttatttttatttttaacctagagattttattttttcttttaatttaaggaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtaggaagttgattttggggtcttttgggggagttaacatgtaaaacaaatggtacaattgaaatataaggtgaacattaaaactcatatcctttcagatgttttaatgttttcagtatttttatttaaagtcccttatgatttcatattaactagctcttatatttgctaaagtgctagaattcaactcaggcttatatgtaaaatgtcaaatagtattgcatgaaactcagcactgttggaatcattacaacatttacttgctggtatttaacctgatgaatggagctaatgtaacaaatgtctaaagccttctaagatgttatgttttggagcgtatttttaaaacacaaaatgattttttctccaagccattaaaatagaagaggaagcatttacatgttctaatattgatataggtgccttatgtggatttggaacaccaaggaacctactggtgtcatgtatataatgatcgagacagtcaagatagcaagaaggtagaaatcatcataggtaagaagtatttccccagtgttctgacaagtggactataatataagctatataaactgcaacgtttaattaagcaaaggaaattatactttttaccccatactatttaatgatgtgttaagcattagaagttatattgtttatattgaaatttgaaagaatgcatactaaaatcataatctaggttcacagaaagcaaaaagaatcaggaaaaaaagccattttgtttaaattattttagttacagtttattttcaacacttatgataaaatatgtattctttaaagctttagctacaaaaaacttgattcagtgggaaaagatttttggccaggtgcagtggctcacacctgtaatcccatcacttttggaggccaaaggttggtggttcagttgagcccaggagtttgagaccagcccgggcaacatagtgagattccatctctaatacaaataaataaataaattagctaggcatggtggcatgcacttggtcccagctacttgggaggctaaggtgggaggattgcttcaggctgggaggttgaattaaaaataataataataaaagaaaaagatttttaataaaacatttttaaaaacaaacattatacacatataaaggaaagaaaggttattaacaatcccattcttaactgcgtaatttgggaatttgttatatttcagcttaatatatttatagttatattgttcatagttggaggtattgatgcatgtgttggtttgccaacattatctctatgatattgatctctatttgcttgacggctgcccttcttaagatcatgaattacaatatattcaaatttgttttttctgaaacaaggaagaacagatgaggcagtggagtgcactgaaggtagtgtaagtctttggtttgaaaccaaatctcctgcatgctagttactcttgggattggtggagtgcttttagcctactgagtgcagtgatggaaaaaatactagctgtaagaaatgattttgattgaagaatattgtattttaatctttgaagttttataaatggacagacatgattaaattgacacagtattacaataactaatcttcagttgactttcttttaatattacatataagaacaaagttcctgcattgtatcttttgagtagtgaacatttgcaattaattcttaatgttaatttttatctacataaaatttgtaagaaagataggtggctacgtgatcatggatatttgttttagattattttgtctgtcctttagccatgattagatgctctcaaatgaaatttagtttttataaaagtttcaggagaggagatttattgtttaacatatgttctatgaaatattaaatattctgtattaatataaaattgatcaggattttttgaagctacaggactctagataatctaccatgtcacctttaccataatatgtaaagggaactgaaaatctatttcaacataaacttctaatttgttttaattagccaaagcattgtacttaaattgtaatgagtaaatattaaaatttggatcatctttccttagtgtgatgtcacattgttttgcaaaattagatttgtggatggcaaagtatttttttcaatttctgcctctattacataagcttaggctctacttgggtaaagtaaggaaataatgttaaattttatattttctgattttcctgtccttcatgtctctatagtatcactctgaaatactataattactgttttcatcctaatatgtagttgcaaacaagaattctctcttgtaagagagttctaatcccatgatctgttaaccctgtttgagggaagccatgtgaagaaatcctaatcgaactcctcttcctctcctaatcctttttgcctaattgcatggtttttaagtcttcctaatgttggaaacctcttaagaataaatataagctagccccgctgtttggctccaaggtgatgcatgtgaattatcaccttgctgtgctgcttctgtacctgcagtattctctataatttttgcagtagcaagcacactattaaataataattttcaaataactctatttagaacatatagagatgaaaatccagttacgaagtttctccagaagtctcagatgaaaaaattagatccaaatttttttcaatgaaagtccacaaaattgagaattgcatatgaacagtgtcctttattatatatatatttttacctatttagcatggtgtcctctatttcattttgtgtattttattcaagagacttgatcagactattcagccataaaaaaggaatgaaatgatgtcacttgcagccacatggatggaacagtcattatgttaagtgaaataagccaggcacagaaagacaaatatcatatgttcttacttatctatgggagctaaaaaagttgatctcatggaggtagagagtagattgagactggcaagaggcttgggggtggatgaagagaggttggttgataagtacagacctgcagttagaaggaatcagttctagtgtttgatagcacagtagggtgacaataggtaacagctatttaccatgtctctcaaaatagctagaagtgaaatgttccccacacaaagaaataagtgtctgagatgatggatatcctaaataccctgatttgatcattatatatcatatgcatgtgtcaaaatatcatatgtatcccataaatatgtacgattattatgtatgaatgaaaaaaagatacttgatcaggatgaggggtgcgggttgaataggtggatttttttagggcagtggaactattctgtatgattaatgatgaatacatgtatacaaattttaatcatttaggaggtcagaggagggggattccaagatggaatacagactataagaaaagaacctaactgtattgcaaatgtatggtacagcctcactgaagaggggtgaaagagtacagtgctactgacctaaataactaagtaactgggaatgagttgagcctaatactgaaggcaaaaaaaattgcacataacacatgtgctgactcagaccttcttcaattgattttatgtaacatataagaataaagtttctacattaaaaaagtatgaatagtatataacatttgtaatttattgttaatgttaatttttatcttcataaaacttgaaaaaatagatagctataatgtcattacttattttacctatccattggccatgataagatgtcccatggggtacaggttaattctgaaaccactatttctcccaaaaacaccttacaccttgagaaactatgaatctaaccatgagaaaaacatcaaatctcagttgagtgacattctgcaaaatacctgacagttactcctcaaaaccgtcagtgtcatcacagacaaggaacacctgagcaggtgtcagaaccaagaagatacaagcctgaggagacacaagcagttgtaatgtgagatcctgaatggagtccctgagcaaaaaagaccattaatggttcattagttgtgacaaatatactattctagcataagacgtgacaaatacactaggctaacataagatgttaataatagagaaattaggtatggggtatataggaactctctctgcactaccttcacagtagttctgtaaaccttaaaatgttctaaaattaaaagttgacttaaaaagatcatttgagattactgtttttaattagccagaatatctaaaactatgaataaattatgaaagagcctagtttttgtcacttaatgaaaacagtgatggcttagaagtcctaaatgataagcacagcaatattcactattctttgctattcagtatttgcatggcttcttcatttaatttgaaaagttgtaaactgataaaacactataacatgattcactggctcaaaactacttggattagtcttactatttgtgctaaattggtgtttagattacttaatctattttctcttactttgttttagatgaattaaataatcttggtcatcctggtgagtaatacaaacataaaactttagttttagatttttaagttgttgaatgcagcaaagttaccgtaggtactcttttgctacagtaatactagtaacttttttctctttattgaaataatataatttaaggttgaaattaactacatgaagtacaattttatacaagtgatacattaaaaatattttaggttataaaactgtaagggtagaaaagaagtgtttgaggtaacataaaacctcaaggtattatcattgtgtattactccttatatcataacaaggaagttaatgggggaagtacgtgacctttaatctgaaagcaggaagcagtgtttgacagagtgacaggggtaacatttctgaactgatcagacccctgggacctttttcttggtgcctcagtcatacagcatatctgaactagttgggtgggtgcctatatctggagtaagaagtgtgtttgtggggatcattggcatcgtacaggtcggttggtcagtgaccatttcttaatgagtgacagttgtcaagagtatgtagaactctgtaggctaattttaattagaacagatttctaataagttaagccttcacctgagataaaaggcatatcaacagtgagaactacatgaagacacaggatatcaacctcgtgtaggctttctgaaagacaatgatggaacctgtggatagatctgaaaataaaacctttcaggaatagtttaagaaggtggttatgtcatttaatatttgtagaaaaccctattacttctccacttatttctcattattttagcatcattactagtttgcttagtgtcatactcatattgcattagcaaacatctattattgtgaatgccattgggctgtgctgactgtatataagcaaactagacacagcagaaagtccccattacctgtgcgtcattctccttgctgtagtgtcctcaaattcacataaagcctcaatgagacctgcctcaagtaggtcttgaactgtcaaaaaccatcctagtaattgtttctcttactgggggagaatagggggtctggatagaatcccctttcctaaattagtctgttaattcttgcttttctttaatgaacattatgaaaagttatttcagaaaaacttttgtaaatagccaccactaagattctaaaattttcctggccctttgagtttttcctcatttcccacaattcagggagtaccaaaaatttaggtttaaaagaagaatgttgtatagggaaagcttttaataggcttcagtggcatgtatttgaccagtagtacaaagttatctcccgacagtagtggacacacaactgatgaactacatctttccctacatggtgcttcaggtgcggggcgggattttattttatgtatactagagggtgaaagcatagaatccagaaggagactccctaagttagtatccagatttgctacttactagcttcataactttgggcaagtgactttaatctctctctgccttaatttccttatctatataatggggttaataatagtaggcacctcatagggtagagtgaggtttcattagatctgttatatataaagcatatagaacggtgccagctgaggcatcaggaaatggtaactactgctacttcctattgtgaacaccaccatcgtttttttccattcaagagtgtttttattaaaaatctgaagagtagaaactatattctgtaagtgatgctgctgatgttatatacttttcatgtatctttaactctggaaatataccatggatcttacatgttttgcttttttatctttgtatagataataaagagcaaacaactgaccagcctttgggtgagtagaactttaaaatgcattatcaaagtataattattgtgtataactccagaaggaatttaagacattttaatttggttttttaaagaaatgtgaataacattgggaccaaatgttttatttttttgtatctgtaaaagaaggtttagaagaggaggcttaaaaatgattacaaattcagtttctagggtcaagtcaacttctgtggagtgatttgtgtgtttctcacgatatgcaaacagacatgcgtacaaaaagaaacatgtacatgctgcatagttagcatagaggaggaagtggttagtgctgtctcttggtgagggatagaaatcacaaaggctgcagtagctttagcgtttgctcccctgtcttctccaatggaaagagaaaagaatttaggataaaatgtaaacgaacagttgcatttgaagaatgcctgggacaagaaaatgtaagggagaaaactttagcagataaaagtttagcagattaacatttaaagatggtaaaaatagctaacagcttgatgctggcagaagccagataaaatatgtctaaaatttgtccattggattcagctactgaagatgtgattggtggctttgagtggaatgttgaaagtgcctaatatgtgtcagttactgagttatgctgggaatttaaacatggatacaatgtataaaatagtggaaaaagaaagattcagaagtgaacaaatgaagacagtacatattaatttgttggaaagaaagagtggtttgaaattaactagatagggcatatattcaaagtgttttggtaggaggggaaaatgtgaggatatttacatttggaaaggaagtatctgttgagactgtgtagattagagtgatccatcaaagagaggacaatttatagagcaagttcctagaagagatgatagggatttgggccaaggtgaaaacaagagaaattggctttaatcagaatgttgaaacctcttttgagattaaaaagaaggagagattggtgaacagatagatttattgggaagctgaggacatttttagtttatgttttttgtttctaagtaattaggcgtagtaatatgcttaaaagattgaggaaaaggctgggcatggtggctcacacctgtagtcccagcactttgtgaggccgaggcaggcaggatcacctggggtcagaagattgagatcagcctaaccaacatggagaaaccccgtctctactaaaaatacaaaaattagctgggcattgtggtgcatgcctgtaatcccagctacgtaggaggctgaggcagaagaatctcttgaacccgagaggtggaggttgtggtgagctgagatcgtgccattgcacttcagctgggcaacgagagtgaaactctgtctcaaaaaaaaaaaaaaagattgagggaaaaagagtaaagtaaggctgaatatagatcttattctatggcagaggcttagaggctaaagaaaatggaagcaaggtcttacaagtctgatctacaagtgaatgtgtattgagagtccaactaagacttttaaagagtaagaatttataatggttcagatcagttgtgtgctttttctgtagcagatctcagctttaaaatagagaagataggctgggtgtggtggtacacgcctgtaatcccagctactcgggaagctgaggcacgagaatcacttgaacccaggaggcggaggttgcagtgagtggagattgtgccactgcactccagcctgggcgacagagtaagactcttgtctcaaaaaaaaaaaaaaaaaaaaagaaacctgctatgtttcattcatagtggtaagttttcatgtattccagctccatgatcttttctttagatcctccagacagacctcactgattaagaaatacctattaaaatagtgttctgaacaaaggcatagccatcatattctgtagagaggagcatacatatgtcttaggtacacaaaatgacaagatccaaatgtaactgggttagttgctgaagatggtttaatcacaaatatgcatttaatagtaatgctaataaactaagtgttttcacctagtgaaatgtttaatttaaccctgagatgtaggtatttttcctcatttttagtagatgaaaatttaaaactgtaagtgtttaataaaacttgctcaggattatacaatgtagtagttgagacaggattgaaacccatctatctctcattccatagcctccgttagctccattatgccaggtattctttctcaaacatgtcccaattgaaagaataacaagataaatggaatatcaggtcaacttctatcattgaagttcactaaacatttatctaatgtttcatctgtgctttatgacaggcatcccccacccccaggctgtggaccagaactggtctgtggcctgttaggaactgagacacacagcaggaggcgagtgagcgagcattaccacctgagctctgcctcctgtcagatcagcagcggcatttgattctcataggagtgtgaaccctattgtgcactccttaggagaatctaactaatgcctgatgatctgagatggaacaatttcatctcaaaaccacccctcccctgacaccgtccatggaaaaattgtcttccacaaaactggtccctggtgccagaaaggttggggaccgctgcttaatgaaacaagagaacaagccttggtttgtgaattcaaggctttggatactaataggaggcagacattaaatgaataatatagtacatgctacatgcctagtagaaatatgtaaagaatctagaaattgttcatagaagatggtgatcagattagtcgaggagagttagagagggctttacctaagaggcaaagccaaggtgaggattttcaaggacgaattgggagctctcaaggggataaaatgaaaatatatgggatgagagttcattcagaaatgaaggagagggaaaaaagggtgaagacatggtaagaatggaggcatgaaatagatggtgtgggtgaggaacaaagttcagtattgctagaaggtagaaaactagggaaggagtggctggaggctatactggtaatgtagttatttattgctgaataacactgcaaaatttactagcttaagaacagcatcagttttattatctctcattgttctgtgggttggactgggtttagcaggtggttctgctggtctttcttggggtctctcatgcaactgcagtcagatgaggctgggactgccacattcaagatggctttgcttacatacctggcaccttagtgggggttggtgaaagactgtgaagactgaaaaaatctccctccctctctctctctctttctcttcctcttactctgtctctctgtctctccctctccttgtctgtctctctctgtcctcccctcctcttcccgcccccaacttctttctcttcgtttccctctccctctttcctttggttccttctccctccctgagtggtctctccatgtagctgttttctttatgtcgggctggatctccaaagtggaaactgtcagagcttttaagggcttagaccctgaactggcagaggggtcacacatattatgttgctcaaagaaagtcgtgatacagcccagattcacaggtgggggtgactgtactacacaagggcaaggatactgtggtttgctgggggctacctgctaccacatctggaaagataggcatggactagaatgcaaatggccttgaatgccaaactacatcaccagtctaacccccagccactccttccctagtcctctaccttccagcaatactgagctgcctgttcctcacccacaccatcaaactgggactttattttgtaggacatggagagtcattaaaagatttaatacatgtgatttttaaataaatacttaatagcatttactatatgccagctccttttctaggtgcttctgaatattaactctatttagaaaagtaacataataatcagaattattagacatgggattaatgatataacaccagtttttgaagaatatattacattaaactttggaagacgtttaggatcatgagttaaaatgtctttctgaagtggcttcattattcttttgctgaatccactggcatttttgtttcacttttccaataaattgtttgtgttcaagaagttgtgggtagctcttacagtaaatatttttctacagaaaaactctttcatttatgttatcacttgaaaaccattataaattgctttatatttgccgtcttgaagttttctttattcctcactcttacctcctcaaattcaagttttattgttcgtttctctgtcgtgtcctttttcctctccctttctactacttctcgatcttccatccaccccagttcacctgtcacccaggaactgttttacaagtagattggacaggtaagatttacttacccaccatctttttcaccagtaaagtcaaggaaatgctgtaagacatcttaggaactagctattaaaaattatcattggaggaaaattttagaagtgttatagacaattatcgatacatatgttttaagacctgtagttctcacactgttgaacccgtgcattctgtaaactgtaccaagtattctttcccaaatagagaacaaaaccagtgaataatgatttgatatcagcaaaaacatcccatgatgcttagtttgacagttaattttatttccccaaagacccagtgatttttttattatatacttataattgttttctaccaataaaaatctatgatgtgtataattaaatgatggtattccatggaaaaatggaattatttacaagcattttactaccccagtaactttttaacctcttgctgtaaacctatgatttggactataatgatgtaaagcagagacaatgcattctcacatttcccctcaccttagaagaagactgatttgagtctgtcactctgttgaggttggatccttattctaatagcattgatggactcaaaaaaatgtgctgtggatcagccagctaagagtcttgctgtagcaggtactttagtgtaagaatactagtttattttaaaagaaattttaaaaaggccaggcgtggtggctcacacctgtaatcccagcactttggaaggccgaggtgggcagatcacctgaggtcaggagttcgagaccaccccgacctaagtggagaaaccccatctctactaaaaatacaaaattagctgggcgtggtggcgcatgcctgtaatcccagctactcgggaggctgaggtgggagaatcgcttgaacccgggaggcagaaggttgcagtgagctgagatcatgccattgcactccagcctgggcaacaagagcgaaactccgtctcaaaaaaaaggaaatacaagtgatgttaagttttatgctgcctcctattgaaatccatgctgagtattctccgctttttcattgaattaataatgcggcttaagtatcatttcactgttatgtatattcataacactgggcagttggctagaaatctctgaacatgtacatatagaatagagatgacatgatataaaattactgaggcttttcacaaagtagagttttttttatcctttgagagagtcacagtcttttaaattgatgctagttttaacactaggtttaagtgttccatggaaagaaaagcaatttcaccagagagatttttggtgaaataatcatctcaattatttgaaacatctgaaattacatattgtagacgtcgagtcagcaatgtgattattcatgcctgtttcaacttcataagagtagtattcataataacttacaaataaactacttagcagcactttgtggcaggggttggttaccaagtcctggcctgcgtcagagggggtggcctgcagttctacccaggcggctcttcagccagttggctggggctgcaggtgctcttgtcaccctgtctctctgctccctggcatttctgtcactgctgctactattacgggtgctgcacacgccccactgtcagccctcaagaagaaagccgtcagaggctattattgtcacgggatggtcttgaggttttggtgtgttctttatttttttttttttatttttttcttccctttgataccagtgggtcttgagtttttaaccattgaccccattccaggctatcaaagaaaggtaccgtgttgaagacctcataagcactaagctaggtctggctttccacactgttttagatgggctgcacacctggttaagctagctgctactttttaaggcatagatacagatctttttttctcttatgaacaaaaaaactgtttctatcagaatacattatctttgagcaaagtctcagtgcactaagttcaaaaaatgaacttttaaggtactcatacacaaaatcttcacatacccctgaaatagcctcatctgagtcaaatgggggagtatttttaaaagatgctaagaggagacggtagtacatccacatggctactgcagaaaccaagaatacagtacccgtgaagttctctctctctttgatatttcccctcattcactctgatgggattcttcctgtcccttttttagttatcttgtttttagcctcttccattctcagcaaaacagaacctaatttgatgggaacccaatttcaaatattccttgtttaaattttctccaaaagtctagttgaatattatatcccttttgttataatttaataaaagtaaactttaatattaattactgttatgtttcatatacagctaataaatatcctttgcctggctctcaaaagtgtgaatatgcttaatttcagtttgatgattttagcatctgtgttcctcagagaatattgatctgcttacataaatagttctaaaatgaaattaaataatgaaatcttatttgaaatgaaataatgcaatcttaaagcatactttttattataataccatctccataggttttgttttaatctttatatcttctttaaacaccccctttctttttttttcaaagcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatggtaagatatttataatgtttgtttttacaattatccattattcttttcattatacaagttaggttaagaattgaaaatcagataaagataaggtaaacatgttgttgaatggaagagttttatttttcttattaagatgatacatttgatcttcattccatctgaataactaattagcttcatgtctttacttttatgtttcctgttttgtcaaaacatatttttcttactagaattcttacctgtcttttgtgatttttttttaattgatagagccacagtataataaaacttgataaccacacagcaaaatttacattcatatgcgtaaaatattacagtatgtggggttttctttgaggggggtagcataaaaggttctagtagaatgtatattttgtatgtttccttttcctaactattgcatggtcttttctagtcttttagtgagaactagattttaacaaggaaatgttggtggatggggcatataatagtaatttgtaaattaaagttctatacagatatgcttagaaatgtacctctacaaaaattcttacagtaaatatttaatgttttttccccattctttcacctaaatatattaacactgcatatatggtaaagaatttcaaaggagacagaatgtgctgtcactagctaatcatttatttggtgatttatttctttcaatatgggaaggccagctgttgagctcatctgaaccgtgttttgcaggattgtgcttccatgacattgtgcaataacatcagattgccagggaagtgacatttccaggcctgttgttaggcatgcaatgataaacaaaaagtaccggtttggctcctgtatctttccagttattttattttaataatttctgaatttactcttgttatttataattagattgatatgataaggcaagtttggtcagaatttttaatggtgctcaaagtagaatttttaatggaacaaaagctttttttttccccccaagatttaccacactgttgtgtaagggatggggaaaagtctcaaaatcttacttaaatgagtttccctctctaaatagtgaggatttagagaaagacaaatgaagttaacaaggtaaacacctcaaatgtgagatttcagctattatgctgatgtgttaataaaactttatttataactcttatggactgatgactaatgggtgaatccatccatttttttcttatgaaaatatgaaagaatatacaatgcaaatatgccaccttggtaattggcttatacaggttgagcattcctaatctgaaaatccaaagtctaaaacttcgtgagtgccaacatgatgccacaagtggaaaattttacaccttacgtcatgaggggtcgcagttaaaactttgtatcatgcacaaaattatttaaaatattgtataaaattaccttcaggctatgtgtataatatgtatatgaaacataaatgaggctgggcatggtggctcatgcctgtaatctcagcactttgggaggccgaggtgggtggatcacttgagcccaggagtttgagaccagcctgggcaacatggcgaaaccccatctctactaaaaatacaaaaattgggccggacgcagtggcttacgtctgtaatcccagcactttgggaggccaaggcaggcagatcacctgaggtcaggagttcgagaccctcctgtccaacatggtgaaatcccatctctactaaaaatgtatggtggcagtcatctgtaatcccagctactcaagaggctgaggcaggagaatggtttaaacccgggaggtgaaggttgcagtaagccgagatcacaccactgcacttcagcctgggtgacagagcaagactccgtctcaaaaaaaaaaaaaatagaataaaataaaataaaaacacgaaaattagctgggcgtggtggtgcatgcctgtaatcccagctactcaagaggctgagacacaagaatcgcttgaacccaggaggcagaggttgcagtgaaccaagatcacaccactgtactgcagcctaggcgacagaatgagacttggaatcttggtctcaaaaaagaaaagaaaaacataaatgagtttcatgtttagacttgggtggcatccccaagataacctcattatgtatacgtaaatattccaaaatctggaaaaaaaaaatctgaaacacttctggtcccaagtctttcggataaaggatactcaacctgtattttcaatctggcatcaggggtgttgtttgtttttatattatacaattgatctcagcttttaaggtgcctacgtgacataaaaaggaaaaggcttccaaaacttcactagaagtgatgaggtgtaaggaaaaaatattgatcagtttaggtttctgtattggtgaagtatttaaagattgagggaatcatatgaagaattactaccttggttgtttattctcatttcttattgatattttcaccttggcttttaagccctttgtttgacttttaaaaccaaatcctgtggccagggcatggcggctcacacctgtaatcccagcactttgggaggccaaggcgggcagatcacctaaggtcaggagttcgagaccagcctggccaacatggtgaaaccccgtctctactaaaagtacaaaaattagcccagcgtgatggtgggcacctgtaatcccagctacttgggaagctgaggcaggagaatcacttgaacttgggagggggaggttgcagtgagccaagatcatgccactgcactccagcctgggcaacaaagcgagactccatctcaaaataacaaaaacagatcctttagttgcccctgtgaagtagagaaccagaaatattaaaaattgtgacaagactgcagtttaggctgaagctttgccccaatataaaaacgtcatcttggagtacaaaataaagaggcatgttaaagcaaaatgtcagcttaagaaagctagaaaacttttaaatcctactgattcgtgtcttaacagggtggctgcattatattttgaagtattgtgaatattccaaacatcagacacatctacactaaatgtaagtgtggtagaggcttgagggtttagggcatatcataaagaaacctttagtttttcttttggactatgcctttaccgctagttgatattaccaggggactcagtgcttgagggctgtgggggaagatggaaggcagagtcacaggaatttcagcatgaacagctagatacggagaacagaggaactcgagttcatgcccttttatattatattgcacgcaggtttgtagaagaaataaaagttgcaacagaacagacaataattcagttttaaacatatgtaaacataaaaaacagaaaccaaaaccagaaataactgtccttaaaaatacaaaaatacatgtccttaaagataaataaggagaaagatttctagttatgttgtatagatggccaggataaaaagtaaccctttggcctgagatctatccctgcatagcctttctgtgttcatcgcttgctgcagcttagttgtgctttcgtgtagaagaacggtaaaggagtcttgtcggaatatggcaaaagtgttattcggcctgcagcggagcagctgttcagttcacatagctcagtggttaagcagtgggccttagcatagctagcctgggttcaaagctttggctttctgctgacttagctgtgtgactgtggttctttaacttttctaagccaaaaggaatctacaaaatggatagaactaaattaatgaggtttacaggataagataaaataattatccctgtgcctggcacactaaaaatgctcaaaatattgtacctattattgttgtcgtttcctgtcaatttattaaagacattcaagcactttttcatctttagattggggatttggactaggtagcattctatttcaggcctcaatgagagaaacccagctttaatcagtttctgtgtattaagggtctacctaaggttttttgggttttttttttggttttgggtttttgtttgttttgttttttgatacggatggagtcttgctctgtcgcccaggctggagtgcggtggcgcaatctcggctcacggcaacctctgcctcctgggttcaagcagttctcctgcctgagcccccagagtagctgggattacaggcacatgccaccaacgcctggctaattttttgtatttttagtagagacaggcttcactgtgttagccaggatggtctcgctctatctcctgaccttgtgatccacccaccttggcctcccaaaaggccaggcgtgagccactgcacccagcctgccaaaggttttttgtgtttttttttttgttttttttttttttgaggaaaaaaagtcagggggtttaaagctgtagtgtagtaaaacagtgaaaagccagtgcactgacattttacgttgtctgagagtcgagttacctaaaaagccagcagtagattatagagacagtatcatatagcacagtagcgaggctggcctgcatctgtattttggttctgtcacttactaggcatttcagtttgggtgagcttttaaacctcttcatgtctcagttttcccatctgtaaaagagggatgttaatattacctactttgttgtgaggattgtgtgaggcaatgtaactagtgacctttcttggaaccgtgcctggcacatagtaagtgccgtgtaagcctgctggggtggcgggtgttgtgctcatcagccactcactgtgctaagtggagtgcatattcagttgagtggaaaagtttttcatttaaatgattattttctctgtagacaaaaataaatatctgtgactatattcttgaatcatcctcccaagaaataaaactccctaaagatctaatttgcagaattgtatttctaagtacagtaagttctttgacatttgtttaaaaaatacctattttcttctctatccttgagtaatgggatggttaactaaataaataagcagtactagagatggaatttaaaaacaacaacaacaacgatttgggccacacacggtggctcacacctataatcctaacagtgggaagctaaggtgggagggttgcttgagcccaggagtttgagaccagccttggacaatatagtgagacctcatctctacaaaaaatttaaaaattagccaggcatggtggcacatgcctgtggtcccagctacttgggaggctaaggtgggaggatagcttgagcctgtgaggtcgaagctgcagtgagctgtgatcacactgctgcactccagtatgggcaacagagcaagaccctgtctcaaataaataaataaataaattttttaaaaaaatgatttggactagttcattttacacaaaagtacttaattcccctcaatataatttggttgcagactttgatacagaatagttacacttttcgtaagacattttgggaaagagaaaaaatattttggtgttaagtgccttaattccattcagcagttgcagggctgggcatgtggcattaatgtaacagaacaacattcagcttttccctggatgaatggaagctaagccttccctcagagttgtatcttcaccccaatcaagtcttgctggagccagacgtattacctgacatgagggaggcagcacccaggcctgctgtcagtcgtctctgagtaataccagttgttgaaatggtaccatttctactaaaagtcagacccttgaaaagagacctccagatctgaccctgtcttgattggtttgcattgttaatttaatgcaattcagtaagtatttactgagttatttttgttacatctatagtccagatgaaggagtatgctatgtgctgagagaaataatagtgaataaagatcatgatctgtcctcctaagaaaattacagtcctgggccgggcacggtggctcaacgcctgtaatcccagcactttgggaggccgaggcaggcagatcacctgaggtctggagtttgagaccagcctgaccaacatggagaaaccctgtctctactaaaaatacaaaattggctgggcatggtggcgtatgcctgtaatcccagctacccgggaggctgaggcaggagaatcacttgaacccgggaggcggaggttgcagtgagctgagatcacaccattgcactccagcctgggcaacaagagtgaaactccgtctcaaaaaaaaaaaaaaaagaaaaaaaaaattatagtcctttaatacaaggagaaaaaaacactatggagtcaaaacatcaactctgtgattttaagcaaatcatttaatctttgtaatttaattttctcatctataaaataagggcagaaatcacttaaagttgttatatggattaaaattagattgtgtatatgaaagtcctttgaaaaccaagaaaatgttatacaggttgaatatctctaatctgaaaatcccaaatccaaaacactcctggtcccaaacatttcagataagagctactcagagtgtgtaaatgtaaaagattagtgtcattatgatttcttatcagaaaaactaagtagacataggactatagaatgtcaggaaaagccagtatgtgattgtcagaaagtgctgctacagcatttcaaagtagggagaatttgaagtgtgttagaaagccacaaaccagttaccaggtagtagttaccaggtgagtaacttgctaaggattctgaactttggaaataacccttgaggactggttatggtttgggtagatagaacggagatagagtaacttgagcaaagttgtggacgttaaaaataagtttatcttgctcttgaagcagtaaagagactgatggaaaataaagttatattttgaatacttgatggaggtgtataagttgtaccctttttaaagtgtataatttggtgatttcagtatcttcacaaagtgggcatcagtcaccactacctaacttcagaacatttccatcaccccaaaaagaaaccccatatccattaacagtcactcccattcctccttaccccagcccctggcaaccaccaatctattttctgtttctgtggatttgcctattctggacatttcatataaatggaatcacccaatatgtggccttttatgtctgccttctttcacttcacatgttttcaaagttcattcatattgtagcatgtactagaacttcattattttagggctagataatattctattatatgattatattttgtttatccatttatcatctcatggacatttttggacatgattaataatactgctgtgagcatttgtgtacacattcttgtgtggacgtagtttccatttctcttcggtatgtacctggaagtgaaattcctgggtcatatggtaatctatatttaactttttgaggaactgcaaaactctttccaaagttcttacaccattttacatttgtgccaccagaaatgaatgagggttccaatttctctgcatccttgccaacacttgttcttgtctgtcttttttattgtagccatcctggtgagtttaaaatgacttggaactagtggctaatgatgttgagcatcttttcatgtgcatatttgccactcatatatcctctttggagaagcatcagatcctttgcctatttttaaatcaagtcattagtcttttttttttgagatggagtcttgccctgttgcccaggctggagtgctagtggcacgatctcagcttactgcaacctctgcctcccaggttcaagcgattctcctgccttagcctcccaagtagctgggattacaggctcccaccaccacacttagctggatttttgtatttttagtagaaacggggtttcaccatgttggccaggctggtcttgaactcctgacctcaggtgatccacccaccttggcctcccaaagtgctgggattacaggcttgagcctccgcgcctggccgtcattagtctttttattgatgagtggaagagttctttattctggatacaagctgtccttatcagataaatgatttgcaaatattttctcccattgtgtgggttgtcttttcactttacctgatcttcgtggtttattgaattaaatccattcttttggtcattatttttaaaaccctatctgtgcactcctttttaaaattccctgtgtgtgcagtcttattttcattcacaacagtaatttagttttttgctaggctagtctcttttctgttagctttcattccaggtccaatccgtgtttatttctgttctcctgcccataatctacctcgctctctctctgcctttgcaaatttctagccattccctctcttaagaccatcccctgttgtttcacttcatactgatattcctctctactttactcatttcatacgtacatggtggttgtcccactaacatgatttatggcatttaattatgtgatgactttcattgttgcttgataacataaacgtgtgaatcgtgtgaattcatgtatggagatacatgaatctcctgatctcctgcttagaggtcaggaactttgtccttcttttttgtttctctcagtgcctacatgataacttccagtgcacacatgagctgtaatataaacccacacttgaaaatgggtatatccattttctcattttagctgaaacgtatttgaaagaaccatttttctcattttaatcgaaattcagaaaaagcagacgacctggattttgtcctgtaggaccacatgaagcaaattgtctttaattctcaaagccgcattctctgctaggagtcggggccataattacaatggattagctacttttggttccctgtctaaatggcttttactatttgctttaaaataccctgtaaagaaatcattaaatccagaatattgagagagcaaaatcagtgggctccagatattgcaagcagaggggaggatatcttcaaaagtgttttgtccagtacttttatgaagaagttcagactgatatttttgttgttttttacagccaaaacaaatttcaagaaaacattgagttgtttgggttagtttttatagtatcacttctcagtaaggaaatatgattcatctgttgagtcctaaaactatcccaaattttagattattgagtcaaaagactctagatggaagattgatatttatatctcatagcaaaaagaaaaaatagcaatctgcgaagtcagatttcccatctctgattataaaactatatattttaataacccttaactgtttatggtaatacctgcagtttcttgacttcatattgcagttgctattcatctgaattgtgtttgttcatccgttaaatacttactaagctcctgctctctatgccaggaacacacaaataaataaatgtaagactatctctgccctaacagaactcctagcttcatggaggagacaaatgagtcaggagagaaatcctagctgcattcttttttatatatcataacataaaattgtattttatattatactattggttacaaatatattttataaattaggatatacttcagacagcattttgatattgtcttgaaatgcaaattttaagtgcagactgttggtaatttatttatttatttatttattttgagacagagttttgctctgtcgcccagggtggagtacagtggcatgatctcagcttacagcaatctccacctccaaggttcaagtgattctcctgcctcagtctcccaagtagctgggattacaggtgcccaccaccacgcccagccaatttttgtatttttaggagagatggggtttcaccacgttggccaggctggtttcgaacccctgacctcaagtgatctgcctgcctcggcctcccaaagtgctgggattataggtgtgagccgtcatgcctggcctgttgccaataattttaaatgcaaaataacattgtctatatttataattgggtatttcttacatatgctcacatcaacctgaagaaaattaaagtcaaggtttttctacaaaaagttatgcagtctgtatgttcagagtgcatttagaattgacatctatctctctcttatttttcctcttttcagggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaaggtaagttttctaatctttattaaagaattgttggagttaaatatcgaccatgacaaactagagaaacctgtgaaatgctaaaagccatttgcgtttgtgaattttagtttatacattgaaactggaagaacaaaactagaggaaaatacatttactccatgtatatctaattattttaactcttcatatttgctatagaacacaaatgaagaactaaagggcatgggcatttactcacactacaggggattcaactctccagaatgcctttagatgactttaataatcactatagttattccctcaggaattaacaaaaccaacacccatggagttgggatctctgctcactagtcagtcctggtcttccagacatggaatgagtagccgaagcagatgtttggaggtttggatcccatttgtctgccattgcctttctaaggagtagaaccaatgactgttcctctagatttactatttttttgcttgctcagcatttaccaatcaaaatccaatgccagagttcaaatgcaactctagttttaaagctaacaaggagttagtgggttattttgggtagatatgtagctacctagatgaaaaattttgaatctataattttaaattatgtattctaaaaaactgttgtattttctcattatttatacccttttaagaatgctctttaacttttcatatttctatctgccctcctccgcctcccttaaatagaaatgactacgatgataccattccaatcttggatgcactaaaagtcaccgccaatattgtgtttggatatgccacgtaagaacatttgatgtttacgttgaagtttcctttattgtttgatgtctttttgtttttgctttttaggagcaggggtcttaactctgtcacccaggctggagtgcagaggcgccatcatagctcactgctcctgggctcaagcgatcctcctgcctcagccttctgagtcgctgggattacaggcatgtgccactgtgcctggcccctgagggttttttgattatagattagaggcctagaaaatacctatagacatgtaggcataaatttacctccttgatattctgcgtagaaaattttaaatgatcgactttagcattccatatcatggtatcttaattattaagcccaaattgggcatgtaattcctgcttaaagattaactctttaattatcaatgtcatgtgagaggcagaagagaaaatgaagcttattggtgtatacagaagtcccatgtggcaagtgtttgcttttctaacattttctttttaaaaaattatttttattggatattgacaagttataattgtatgtatttatgggatacaaagatatgctatgatgtacgtattcaatgtggaatgattgaatcaagataattcacatatcacctcaaatacttatcttttttcctaactgaaacattgtaccctgtgactaacagtccccacgctgtccccacccccccccagcctctggtaaccaccattctgctgggtgcttctctgagttcatttttattagcatccacatataagtgagaacatacagtatttgcctttctgtgcctggcttaacttctttttctatttttaaggtgtcaaggagcagaagcttttgaaatccagcattctggattggcaaatggaatctttatgaaatttttaaaagacagattattagaagataagaaaatcactgtgttactggatgaagttgcagaaggtaaaataaaaaataaagagaaaagtactcagaaaaaggagagcaggggagacacacctattcagggttccctctctggtgattgttttattcttattatgtgggtttggaattagtacctactttataaaacaatttttatattaatataacgttcagcaacacttctgctatttaatgtcatctttccttcccttttgacctagctctccaccatctgtgcagcattactcagactacaaggctaagcctcggcacagtcattaataaagttgaattctcagagctctactttgcttctatgcccagtgccttggtactggcaaatctccctatttgagggtgggtgggtggcatggaggggtggtggggaattgtccagtgagcagtctctcccaggatgggagagagaaaactttacagaaatttttagacactgctgggaaaagctgagttcatttttttccctgatgaacttagtagtttttaaatcctgatttaaggatgtgatcctagggggtctaatgccacatcttccatttctatctgttctccctgcctgctggtataatgctgtgcatatgtcagatgctgaacaagtacctattatttcagtagattgcactgtgttttttgaaaaaacattttataagccatagcaaaaagaaggtaacttggccaggtatggtggctcaagcctgtaatcccagcactttgggaagctgaggcaggaggatcacttaaggccaagagttcaagaccagcctaggcaacatagcgagaccctgtcttcaaaataaaaaataaaaataaaaaagaagaaattattttacaaactagcaccactagaaaatggagtttcatggatgttccagtgatggcagtttgggtataaggtgtttgaccaactgtcagccatatttattttcatgtttttatctgtgtagctattttagatcacttgacttagccacttttccatttaacataaccagccagggctttggacttcctgccaccctcccgcttcatccagagaagttccacttttatttgttttctacattaggcttcttctgaagcttacatttgaaggaaaggctctgctgctttaaaaaaaaaaaaagaaagaaagaaaacctttggattatgtcagttatattcaaactgagatccagtaaggtgctccagaaactctacagtgttttatttcaatttcgtttttaagtccattttaactattttaaaacttaataaaaagcaccatgctcactcacatatgatatttaccaaattgtcatagcaatgaatggcatcccgatatgtgctgtgaggatatttgaacttcttataaacatcttagacagttttgcttttcgctgatctttttcagtcctaccatgtctgcttaaccagaattgcccaggcaggaagaccctgtagtgtacatggagcacactcagctcagtgccgtgcacattgtgcccttcgtgggtaacggcccactcattgtacaaaataagtaaaggcctaatagtatcatgataaataatacagttaaatctagcccttattttgagttttggatgctttgtgtctgacccctgtcttagtagtaaagagcaaaagtagttgtatgaaatttttcacaagtcatccaattttgaaacaaaactttgctgtttctccctttggatcttccagattacttaattgaaactcattccatggctgggcatggtggctcacacctgtaatcccagcactttgggaggctgaggtaggaggattgcttgagcccaggaattcaagaccagtctgggcaacacagcaagaccccatctcaatttaaaaaaaaaattatttggggccaggtacagtggctcatgcctgtaatcccagcatttggggaggctgaggcaggagaatcacttgaacacagaagtttgagaccaacctaggcaacattgtcagaccccccatctctataaaaatttaaaaaattagccaggcattatggtgtgcacctgcagtgccagctactcgcgagacttaggtgggaggattgctcgagcctggcagtttgagactgtagtaagtatgaccacaccactgctctccagcatgtgtgacagagcaagccccatctcaaaaaaaaaaaaaaagaaaattccagagggagaaaagtattcacagattataagccaagcagttgaaggggaaaataaacatgttaccaatttctttttttaattttttggtttctttgtgtgagactacagagtctctgtcgcgcaggctagagtgcagtggcatgatcttggcttactgcaacgtccacctcccaggttcaagtgatcctcttgccgcagcctcccaagtagctgggactaaaggcacacaccaccacgtccggctaatttttgtatttttggtagagatagggtttcgccatgttggccaggcctgtctcgaactcctggcctcaagtgatccaccggcctcagcctcccaaagttctgggattacagacgtgagccaccacgcccggcccaccttaccaatttcaactgtgtgcaaggaaaacaaaatatgaggtaaattggttgttataatgctacagccatcaatctgtaacgtgacttttatttttgtactattcaggacagcattattattagaagtgttgaacatactactgaaggttttcattgtgagtagatgttcgatatgaatataggaccttgaagtaacctacatctaattataggacccctcttctcccttcccccactccatgataactaccattctaaacttattcctttttcgttttacatagttttattgagtttatatatacccaaaaaagtatgcgtagttttgtttttaacttcataaaaaggtattatgctctatgtagtcttttgggactagatttttttggttaatattatgttgctaagattgatccctattgttgcatgactgtagtttttaactgctacgtaatattctgttatgcaaacatactacagtttttttcaactactctcctgtgttggtgagcatttgagttagttgtaggtttttgctatgttaacagtgctatcattaacagtcttgtgtatgtctcctggaatatgtatgcatgaatttctttgcagtataattctacaacttggaattgctgggtcatagggtgtgacagtattccattttgagagagaatgccagacagttttgtaaagtggttgccgagtctacacttaaccctactccccacggccagcaagggataatgtgaatctgtactctctccatcacttgatagtcagacttttttatttttgccaaatgttaaatagtatctcatgtgatattgaacattgttcatatttttaatagctatatgtatatcttatgtgaaacatctttttatgtcatttgtgcattcttctgtgtgtgtgtgtgtgtgtgtgttttggcttattgatttagaggaatgttgtatgtgttcttgatataatactagcgaggaccgctaagacacaattgaataggtagttgtgggcatccttgtcttgtttctgactttaaaggaaatactgctaatgtcttcacatttagaataatattgtaagtttttttattaacactttatcaggttaaggaagttctcttaatttttttgaaaatttttattatgaataaatgaacaagattaaatggtttttctgcagctatgaagaagaaaataggatgtttcttttctttcaatttcttaatatggtgagttaaatttatagatagtctaacattaatccaacttgagataaatcactttcattgggatgtatatttttaatacactactagatttaatttgccatcattctgtttagaattttcatatctatattcatatgggaaatgggcctgtaattttactttcttatagtatttggtttaattttatgagaaaataaaattagtatttagtggtatcagtgttatcagtatcagtggcatacagagtatcagtgttatctgatagaatgtagcgtaggccttgtggaatgagatggaggacaaccaagatggttgattttatgtcaacttttgccaggcctcagtgccaagatatttagtccagcattattcaagatgtttctaggtgatggatccaacattattctggataagattaaagtttaaattgatggactttcagtaaagtagattgctctccataatgtgaatgggcctcattcagttagctgaaggccttaatggagcaaagactgacctcccacaagcatggagtttgctagcagcccgcctctggggctcaaactacaactctcctctgcatccccagcctgcctgcctgcaggtttcagacttgcaccgccacaattcataaaccaataccttaagtcagtcccttcttctcactgtccctctatgtacacacatacacacacacacacacacacacgtgtacgtgtacacatgcgcccatcttgttggtactgcttctctggagaactctaatacagaagaagtacaccctgttgtttactgggaacttttgtataaattatgatctgttccctaatgtttatggtagaacttgcctataaaccaacctgggattggtatttttttggtagaagatttttaaccactggttcagtatcttgaatatttcttgtaccatataggcttttcatttcttgagtcaattttgataagttatattttcctaggaatttgggcagttttcaaattcgttgtcatttagttgctcatatttctaatagtattctttaatctctgccttatccatagttatatatccgttttcatcagtattacttgtacttactttccttttttatttattgccagcttttgccaattgtgctatttcattttgaagaaccaatctttgactctgttgatttcttctactttttcattgttttctacatcattaacttctgctgtttatttatgtcttgccttgcatttattatttctttttctaacatcatcgtagttattcacttttagcctattttttccaatttaagtttctaaggctttacatttctcttaaaacatcactttcatcacacatcctataagtttagggattttttttagttgactttttttttctttgacctttaagttatataatattatctttaattttcaaatatggcaggaattttcatttcactttttgctttttatttctaccttaattgctttgtgatcgaataatagtctgtctaattgctatgctttgaaatttgtggaggttttcattatggccaagtaaaagatgaaattttgtaaattttgcatgtgtacttgagaaaaatggatatttttgtagtaactggttgcagaactctatgtatgcccattaggtttggcgtattaatttttattgttttgttcagttctatatttctgctgattgtctctttgatcaataattgagatgttgaaatctctcaatttaccaaattttcttgtagttctagcactttttacttcatatatagtgactattttcgtgttttaaatgtttatattttcttattgaacctttatcattatgtagtgatgcctccatttcaaatgcttcttctctttttgtatcatactaacagagccacaccaacttcctttttgttgacctaatatgctattttttacacttttactttcctactcttaacccctaggctagcctgcttctctacacttttactttcaaacatttcatgtcattctgctttgctgtagcttttggaggcaccatataacagattgtttaaaatccaatctgataatcttggtcttttaatgagaaaatttagttaatttacatttgttattttttgtacctgttttaaccatctaattttttgatttggctcattttcttatcttttttaaaaaaattgtatttatatcttttcttctctaacaaataataattttaatgtactcctacaatacttggtatctccttttaactcccaacatgttgatttaacttagacttagttctggatcactatataattttgtctctttttttaaaaaaaagaaccttactattgttaatttataacatagtagacagaagtaggataaactataacttaaataatatacttctaaatttaaattgatgtgtatccatatacattagtctatctaaaacatgttgaatgaaaatggtacattacaaagacatacatagaacatttttgttgaattcaaaaacctaaaacattggcatatactatttatgaacacttacacacatgagtaaaaattaaaacatgcctgatatgtctggcacataataggtgctcaggaaatatttgttgagtgaataaatgatactgagaatataacctgataatgtaggatagttcttagcctaaatatttaaaacataagaattggtggtcttaaaaataatatttattttcatatcttttagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatggtacggtaaagcccattttttgttagatctacaatatacttaacgttaaatcataaagtttcttctgaataaataactttcctcccagttttacagtgaaaatattttggcctactaggcaaatctcaaaccaaacaaatatttcaattatggatattacactggcttatttgatttagaaatatcaaattatttagcccattattgtcactattggtaaaatttaaatgaccatttaaaaatttttctatttttaaaataggttaagtttccatttgtctaatacacaatcctttagattctcctatattgtgacctgtcgaaaatcatggattgggttctgatccagtctctaccactctatgaacatgttatctataacatgtaaataagaaatggtacctgcttcaggctgggtgtggtcgctcacgcctgtaatcctagcactttgggaggccaaggcaggtggatcacctgaggtcaggagttagacaccagcctggacaacatggcaaaacctcgtctctactaaaaatacaaaaagttagcggggtgtggtggcacgtgcctgtaatcccaactactagggtggctgaggcaagagaatctcttgaacctgagaggtggaggttgcagtgcagtgagcagagattgtcccactgcactccagtctgggcgacagagcgagactctgtctcgaaaagaaaaagaaatagtacctgcctcataggttattgggattgaatgagtgcataggtagaaatgagcatggcactcgacaagtcctctgtacttttgattattcgtataactgagcatcctctcttggacacttgatcagtaagttgagtgatcagcagagaagatgacgtgaaaatcaatctgtagcttaattaccttttggtaattgtgtatggtttaatgaaaaaataagtttaaattaccaattgaaataattttggattttctgagtccaagtatctagtctgtgagtctcttatagataattgaaaaataattgtatttaatgaacttctataaaatatctttattttcataaataataatttttgttcttggccaggtgtggtggctcacacctgtaatcccagcactttgggaggccaaggtgggtagatcacctgaggtcaggggttcaagaccagcctggccaacatggtgaaactccatctctactaaaaatacaaaaaattagctggtcatggtggcaggtgcctgtaatcccagctactctggaggctgagccaggagaatcacttgaacctgggagtcggagtttgcagtaagctgaggtcacgccattgcactccagcctgggcaacaagagcaaaactcagtctcaaaaaaagaatttattctctaatacatatttttagtaaattaacatattaaagcacattaaaatgtaaaatgctataaatatctcaccattccagataactggataagtaattgaatgtcttttctctaaaaaagatctaaacaacaaatagcaaaattacggtggtaaagatcaacaataaacgaaacttcataaaacaaaatgaaaaggtcatatagaaaatatttgtaacaaataagagaaaaaaaattaagaccctcctcagtaaacaagcaaatgatacaaattcaacaatccacactgctggaagtatagagaaaaattttttaaatggctaatgtaagtaattaaggaataattaaaactgatggtatctttctgctttttaataccatcaagtagacaaatgttttaaaaattaatactctgttttggacatgttatgctgaaactttatattccatgcaaattgaaaataatttgtcccatatgtaaaggaacaatcacatagctttatctatcttaaagcattacgtatatataaatattaactatgatagaaaaacaataaaacccagaggtattataaatattcaagagttaacagaatggttaaaggtaacaaactataatgtggctgttcagtgacattgtgctttattaaaaattctggtcatataaattgaggcaacagtgaaaatttatctacaattgtatgcatatttttgattgccacaataaaaattatatatacagttggataagaactataaacaaatggtaaatgaaagactttgtttggccagcagaatagtgagcattattttttaaattgtatgtgtttaaacaatgtaaatcatgtttttaagcaaaagaaatgctaactatattctcctccataaatatttgcctcttatcatcagaaaacctaccaaagttgttcttattgttctttttcagaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgtgagtctcttcttttatttaaaatacagtgatatattctcacttattaaagactaaattttttaaaacttaaagttgatggtaaatataaaggaaatatatatatttatatatgtgtatatatttatagtttagtaacactgatcataatatttactaattgccaaaataccttaagtttatgagatttagaaatgtctaaagttcactcaggaaggatgcctctaatttcttatatcctaaacacgagagccaatgtgaaggaataaaatgtgctataaatatgtcaagaataatttccttttaaacagttataacttatattggaaacagtagtttttaagtcttgttaaggtatggtcatatgctggaataatagaaatctagttctgctcttttcaaacatttaggtttgatagttattttacgttggtctaaagaagccagtaaatagtacccctctttcctacatgagtgtgacaaactgagaagcaagcaaggagtaagacaagcagaaacccaaaatatcactttgattactgatagaggctttgtggaggatattgcttcatgtcagagtaaatggtctagcaccaaaccccagaattgagtggccaccccacacctccagtctcagcagtacggagcccagataggcttcctgaggtactgagcaagctgggggcctgtgggcttctcactggagcagcagaacccttactcttggccattgggttggctctaaaagaagaaaaaggaaaaggctgtttatttatccttcttaaatattctaatcatataaatttccctgcaccttcccaaaagtgatgattaagaggagagaatccaggagtcaaacactaatggggctctctctgcttaagaggaaacttgagtagctcaagaagcatttctaggaatcatttgaaaggaagctctttcagagctcactttactttttagatggcttagtacagaattgagaattcctattataaccatagattgttgttttcattgtttagtcctggataattttgggattaccaaaattcacgagaggccagaattcacgagaggatagtatcagttaagatgtcttatgtactagattatattgtggctttcattgatttcattattaacagtccctaatttttttttttacaggatctagatattgatccaaaagatgcaaataaaggcacacctgaagaaactggcagctacttggtatcaaaggatcttcccaagcattgcctctataccagactcagttcactgcaaaaattaaaggttactaccttttctgtttatagctactaatggaaaactttatgaaactggaaacttattttggcatagaccatagatatgctgccttattattaaagtagagataaccagtctacagaaggtcctatcagtgaccctttttatattctgtttccgatggtgaccagaggactttatgtgtgcttaccctccagaatgctaaaaaattagtaacattagagtatattcttttttctttttttagagacagagtcttaactctgtcacccaggctggagtgcagtggcatgaacatgacctactataacctcaaactcctcagtgcatatgatcctgccacctcagcttcccaagtatctgagtctacaggcacatgccactacacccagctaattttttaaaactttttgtggagaagggatctcactatattgcccaggccaatctcaaactcctggcctcaagaatcctcccttcttggtctcccaaagcactcggagtacaggtgtgagcttccactcccagctccatattctacttttaaatatgttcagattttcaagtaatcatttcctagttctatgactagacatatagcaaattagaattttttttccatttttttatttctagttgacttacaaatgagaagctagttctgcacattgagtgttctaatgaaagcttttaatttgttcacaactacatgaccatagaatgtatcagctaaaactcagggaatggaatgggcatgattgagaattacacacataaacctgttgtcatcctgttcggagctcatctacttaaaatcctttcttctcttaaaaagttagcccattatctgattcagttatattttccacctacgattatggattactataatattttaaaaacagcttaagctttttttataaaactggtataaaaccaggtttttttttttgttttgagatggtgtctctctctgtcgcctaggttggaatgcagtggcgcgatctcagctcactgcaacctccacctcccagactcaagtgattcttgtgcctcagcctcccgagtagccaggactacaggcgcacaccaccatgcccagttaattttttgtatttttagtagagacaggtttcaccacgttggccagactggtcttgaactcctaacttcaagtgatccatctgcgtcatcctcccaaagtgctgggattataggcgtgagccaccacgccgggcccagatcattttttaattaaaagttaataccccatctctaataatagggaagggtaagtttcctaagctgcactgcttggaaaatgttttccctgttcatctagagtgtaagaaagatctctttgactttgactactaacagtagtaagaactagaaattctaaatgggttgtaagtattgcatgaaggaaaaggaagataatgatagctggcgtttctcagtttcagggagatataaaggatgccttgaggatttggaacctgggaaaggagagtgagtggatttttgggggtgggggtgtgtatgtgtgaatattttcagattgatatatattcactgttgatgccaataataaaccagatttttttccttttcaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgttatagaacaggctgaaatttcttgttcataagattatgaaaccacatgagaagtgataaaatgtttgttaaagctagatagaggttaagaatcaagatataatggataattttcatagctgcctatcagaatttcccaaatatttagcatcttccttgataatatgtattttcttcttgaatttcactggcctaatgagataatactcttatctttggctctacctaaaagttggttaaaaatgcaattggcattaacaaggaaaaatactgaattagtaattttaaaagtctcacaaagaaaatcccaggcctagatggctgcattgttgaattctgccaaacattaaaattagcactaattttttgcacactgtttctaaaagtaggagaggaaagaacacttcccaacttactctaggtcagtattaccctgatactagactagacatcacaagaaaactataagccaatattccttattaatacaaacacaaaaatcattaacaaaaatattagcaaactgaatccagcaacctataaaaaggattctatatcatgaccaagtggaatttatcccaggaattcaaggttggttcaacatctaaaaatcaaataagctaatatacagtcagttctcattattcacagtaattatgttctacagaatattctcccataaacactgaattaaatatggaacaactgcttttaggagaaagtgtatttgtgtatatgtgtgtatacatatgtttatctcacacacattatgagcttgaattcttaattcatcctagcaaattctaccttattttacagaagtgaaagtgaggtatcagaagtgttaagtgacatgcctgaggcacccccctaacaggtgtcagagctgaaattcaaaccccatccagctggccccggagccagagcttcttgtactacacagaattgcccctgccatttccaccctccagtcatttctctatgagactgaagcaggaaggcagagcatcatcttgttcagcctcagctgggaacatgtgtactgggtgactcaaatttttcacccatttacacatatccacaaatgactgcaaaagtgccacggatatcaatttgagggttataaattttagcaagttggtaaattcacaaatacataaccttgaataatgaggatcaactgtaccatatttaataaagcacaaaacccacacagattgtcttattacagcatttgataaaatccaaaactctttcataaaaacactcaacaaacttaggaataaaaggaatcttcctagatatgataaatataacatctatgaaaagcccacacctaacattatacttcatggtgatagactgaaggctgaatgttttccccttaagattgggaagaaggacaaggatgttcactcggcactacttctattcagcattgtacttgaagttctagccacagcagttaggttaggaattcaaggtttgttcaacatctaaaaatcaaataagctaataaagaaaagaggtttatactgcaaaagaagtgaaactatatgtattcacagttgatacatagttgtatatagaaaatgctaaagaatccataaaaagtaataaatgagttcaacaggt

SEQ ID NO: 1856 - DNA, 78753 bp, Homo sapiens; identical to SEQ ID NO: 1855

SEQ ID NO: 1857 - DNA, 44561 bp, Homo sapiens
cacagtggaaataaatattagctttattaacactcaaagtgccattcatttatattcattccatagtccagaaggttacttattagagtaagcctttgcaccacaatctttcaaaaaaatgaacatgtaagaaaaagcagttttcattgtgctaattattgcaggccttcatgcacgtaaacctcaacaaaatgtgtgccaacaatatacaaatttccatataaacaaagtcattgatcactaacaaaatataaacatggtttcttttatattagatttttttttaaaaaaaagctatttaccagcaagaaaaaacaagtacctagaaattataaaactcagaaattgtatacatttttacaagcacaattttgaatgacaaacaaaatcaaaatgtgcatgaaatgttgcacgtaccacactgtatctggcttctggtaggttttcctaatcacactggttccttttaacataataagcttagtgacattcaacttcaacagtggactttattcctaacacgagtaattttacatggtaccgcatatttaaaacaaagttttctttaatactacattgtctgattggaaatttcatttccaattctttttctgccagttacttaaaacacacagtacaatataaagacacacaacgtatgtttggacatttcaaaaccaatttatagtcaattacaaagaatcacaatatgccaatatattgttttataaacccagtctgaccttgcccagtgatagaaaaactaaaagttgaaatcttttggggtggaatacaggaaatattcaaagacaacagtaggacaggccaatagcaactggagatagaaaaatcttgacatctcgagacaatttagtttctcacatttttccatagctctgagaattcaaaggccatttttagcggtgtgtttttgctactgcttaaaacctatttttcccttaatttgcatttcacggaattctcaaagagaatttaatgctttttcttgcaagagtattttaattgagctctaagtatgacttgcattcaattctgaaaatacaaatacattttgaatggctaaaaacaaaattttaaaaatacttttgatcagccagctgaaaatatattcatatagtaaataatctctcagaaagcttttatatatatttaattatcacaactaaacagtacccttataaaacaagttcataaaaatgtagaaatgaaatgaaaataagaacttactgggatatatacatgtgcctacagacagaaaaaaacatctccacacaaacatacatcccctgatacacagttaaaagcatactttcaacttagtaatggattttataatacattataaaattttctaatttctattaatgtcgaactcctgagttcttcaacaaagaaccatagataagtatagtttgtaaaagcaaaaaggtccatttaagtcagtaatagcagtgcagtaactgatggctacatcttgaaagaagttaaaacataaagacacagacagtagttcaatgcacgcattcatgatgctcatacactcatcaacaattattggtcagagtagtaaatcagtgtacaaattaaacatttccaaaaatgtgcaaaaatgtcaatcttaataggaaaaaaaccctttgtacataattataaactgcccagcattcaactgagattaaaaacatttagagagaaaccaataggttaaatatagagaatttaatggctacatttaaaaatgtacattattatgtcaaagggtaaatttacaaattgataatcatagtttgcaacaattcaaagtttattctcaaatttatccaagtttacttttatttacaatgaataaaaagaaccatgtgaaatgtaagagatgtcagacattaaaagtatttttggtattaactcttataatatttcagaattcagggtagcaaattttaaaaccaataacaatagaaaaaatgtaaaccatttactaattaagattgcattaaaacaattgttggtctttaaagaagtattcttatccttagacactgtactttcaattgaatagggtgtattgcaagaatttggcccacttcatattgcccataagcctctccagctcaaatgtttcaactagtcctctcttcttattccaggtggaaaaaattctttggaaaagtaagaatacatcaaatccattttgtagtctatctaatagagtttaaggtgtaattttgtttcttctcccctccaagtaaagctaatgctaaaatcatcactagttacatatgcttttaaaaaataaattctaaaaaaatatttaaaaagaagtgaacttaaaagtgcttttcggtatggtcatgaactttactgttctcaactgcattaagggattctcaactgcattaagggattcagaaattatttggggacaagtcctgtacatatagtagaagcagatacttccttatgttccaaaatgtctatggcacaaagcagacatcagtccagaacctacttttcctcacagctttgctgaaatgcccctcaagtcaaacataagttcataaatgttaagacactaggaagaaagttcgccatcaacctgaggcatcagacgttaatgtctgtctatgtgaatcagtggtcaagtgacattaacaagattggcacatgtacaagcttaaattcatgtctacatagttcctcaatagtggaagtaacttctggatgtctaaatgcactgatcacctgtccttttccttgaaggatataccagaatacaaattctactagtatctgctttataatttttatactattagcttacaagtggacagaagtaacagtgctaattattttggctatgtgtacagggaatataaaagctttggtttaaagtgattctgataatacagattgtgttacaaacaagaagtcatcaggcagaaggaacaatggtactgatttaatgcctttgctgttattaacaaaaataccatatgactatcaattaaaatgcacaattatgaaaaataagaattctatgagactgtatacaggcaacagataaaatctattcttttctttactgtagctatgactcctccctcatctttctgaagctcaaccttgaatgcttacaggaccactgaaaaaagaatctctaggctcccccaagagctcatttccatcaacagctctggaaggtgagtatgggaagatgggaggccctgatacttcccacacctaccatggcatcctgtccaaaccatggcagaagtcaaagccaagccaaagacaactataagtaggaatagctgcttcacagcatgcttcccctagccaaccaaaaagaggtacaagagaatttccttgtgaatacttggtaagctaaggaagcttattttgataatgtttggcagaatttcagttccaaaaagttcaggaagaactatgtaaaatcaattactttctatttaagaattatatataagattattttacatatacacaaattgaattttaatctacctttagcaaccaagagtatggcaatttacaatcaatattattatacaatcatttgtactagctacttctggaaaatgtactggtgttcctacccaaggatgactacactcactgtatgtcatcagtaggtcatacatttgagttgttcttccaaaaccagaaactgacctaattgaacactcatacctttccccttcttccttcccatccctgcctccaactctaaccacacacacacacacacacacatgcatgcaaacgcacacatacatgcacacatgcacacacttcacagaaaagtaacttttctgtgagtattacccaaaatgttagctgagaattaaggactagaatctgctatccctggatttcctactcactgtcctatctcattgccttaacatttgtaaaccatgtgaatgacttctttagggcaaaaacaagtattgtaactctaccatgaaaatcataactgaactataatatgccaagaacttggacagtgccaatgtgattgaaaatcaaatattcaacccagaaaacatttacatgtctctttagaacgagaatacctctttctatgcttgtgttgggaattcatgtctagtggaagctgcagcatgtctatcacagacaaatcctaatgtttctctcctaacatttatttatttatttatttatttttttaaaaaggaggtagaaaagggtaggaggaggcaggcattaagaaacatttaaggaccaatacacagtctaaggccaaatgaacttgtgaagcctactgattttggaaaaaatcttcattttggtgggtaacttgaattattaatataaaataaaattaaggcatacagagaaaaggcactactaaaaattaacaattggattgcttttcattaacatttaaccaatcttaaaattcaaataaatatgaacattacatttgtaaaacaaaggccaaacttagtaataaaacagtatgatctcaaggaactgtcctgatcttagtataaataacactgttgacagagttcaatttctatcaaatgttttgggtattttcacaatttagaccaaaataaagtatgttttctttaaaagagacactggggaaaaaaaaaaaaaagaacaaaaaaacactgttatggaataaatgctccccatcaccagaactgttgagtagaggctgggttttgcagtaagagggggtcctgagagagatgctatgtgacctggttggggaggggatccctctagtttggagatacttttactctaatccctgttgtcagtgacatttccgtttataacagccaatgattacctaaaattgcttttcccttaataaaaaataacattttaaaacatcattgctgaactttcagagttagcgtatgccataaaataagtaactgtttgcccatgttcctcctagattgtgacctccttaaggatgttaatttagtacctgacataataagttacaattattgaacaaacaaagaagattcattctattaaaaaagatagatttgtatatttaattgacaccaggtgattttatatcaagctatcagttcccagactccaaataaaatcactggcacagaactttgccataggccaaggagtctgcatctggcttggtcatcctgctaaactattcacatctgattttattttctaagtgatttcacatatcttataacaactccatgtcagaaatactacagagcagatctgacatatatatgagctggagtagcagagacttagtctaaagaaatagtttcatctttttaatgcagtttctttgggaataaggtaaagactctctcaagtgaaagccaatccaattcactctgaaatcaaggtttaaaattttcttttacagttcagcaaatgcattaatattttaattccttatatatgttatgtaagggtaactgtgccttttaaaactttctaaggcaatagtcatttttttaagttagaaagatgttttgtaaacaaggaaaagtgctgaaaattttcaagatattcatactgaaattttcagtctgtatactttcaaatacattttaaataattaacaacccatcaaaatttccactagtcattatgatttttttaacccttttattcaatacaacattttgtttgcaatgtaaaagatcttatatttggtccaagcctaagtcatgccactttgaatctctcaaggccttaagtagaaagatatttcctgaaaagcacatataagactgctagtgaatcttctccagcaccaaaaagtctgccactgtcaaagcagaatgcattttaaaggcacaaagtcagcagtctgaccattttccagcgtcagcaaagaagcattacagtatagaagaatcaattgtgcatttaagaaacaaaacacatttagagttatcttaaaaagttcaaattgcatttgttgatccatatcattattagaaagaagaaaaaaacggagtgttatatttaacttcccctgataaagctgtttcctttcaaaaatttcttttttaaatttacttttggtcttccataccctccacccccacaccttcaagcttttttgttctagtagtttttatatatattaacttttattgtggtttttggtaccttcacaacttgtttgaaataaattcacatcgtattttatataataactctgtaaactattagtctatttttaagtctttacataaagaacattactttcccatagctaataatatttttcttataaagcaaaggccttccacagcagtgttaaagtagtagtttcttttcaggtgcctttattttctatagcatttagaaaagaaaacagagactgaaaaaaaaacagttttgctctgggttctacagtctcaccagatttctctctaaagagcatttgtctcatattgtgcactgctggttaccctgacagaccaaaaacgagccaaaggaaaagcacaactacacaagacagatatgaaggaaaagcccactggtcaaggaccatgatcttgctcaagtagaaaagatgccctcattcataaaagataaagaaattataatagatccacacacttggggattctttctagaacaaaatttggcagttgctttaccaaggcagggacacctcattcttgttcttccctgcaaactgcttcaattttaagaatatgagagaagcgttgacaattaattttgtgctttgacttcttagactagctagtggaatttcaaatattcctacagggaatgctaggtaggaccttggcacagtaaaccaagatctacctaacttcagaaacaaagtatcgtaaaagagtccctaaataagcacaccttttggcagaaaataagaatacctgagtcccttatgaatcccatgaaagggattctggggcctccaggaagactgttgttttctagacctttaaaataaagtactaaataaagtactaataaagtacttagcacttgctttaacatgctgaaaaaaactgcaagtggccaaattgctgatatcttcatgttttatagtagcacaattctattagagatagtggggcctttcccagctgtcttgttccatttaacaatgtccttgctcttattggatacattgtactagaaatacgtggcagctttttaaccttcccattagtagttaaaattttgttttgatatgcttttttttttttttttgcccaaaatcatgaattttaaggaaagaatatatagagatggctgagttcaaaaggctcagtgttcaaattcagtttgttcctaaaatgaagagttacctatgtgggtgcaatatgcagctggtaaagtgattgctatttgctgtttgttgagattattcacccttgacttaaagcagcagtatctgatcttgtaaaatcctcaatttgcattacatcactttctctttgcgacttccttttctttcttgcatttactgctttgtaaatagctgttttcagtttataactgggactgatctttacatcagggtttctcagcctcagcacttctgacattttgggaggggtaattctttgaggctgctttccttgtgtattataatctatttagcaacatccctggcctctacccaattcatgttactagtatccctccaattgtgacaaccggaaatgtctctaagaattgccaaatgcctagtgaaatcatcctcgctccacttttggcaaccactgtttcacatgatacctgtttttttgaggtgctttagtattctgtgatcctaagaacaagggtttcatctcctgacataacacataaacattactaattgaactcttcgctcctaagggatgttacctatggggaatcaggagctggaaatagaagatggtatacatgattttgattatttctccattcctttaattttgggacgtccccctcaagtaaaacaaaacaaaactgtttaaaatacactaaacacctaattttttttcattatttctattgactgtaaatgtggtctcttctactgctcacacatttgataagagtgatgtccttttgtcttttatttctatttgctcacaacttgactttaaaataaaggttttccgtgtgtgtgtgtgtgtgtgtgtgtgtgtttttaagcagaaagctatccctcaaggtttacagattccagtaacgtggatctattatagtgtatttgcttattatactggttaggattaacaaataaacatacctctcagagattcatatcttctatcaagactcctactgagcaaaaaggttggtagacagaggttaggatctaaagaatacagatataagaagaaacctatattctttaagttgagtacctaccctaaactaaagtttagggctcaaccccacaaatgaggatatattttaaatactatcactaaaaactacaaattatacatcattttcttctccttgttttccatgtcttcccatcgtcactgatgtgtcagtgatagagggaatgactctacaatctttaggtattccaaatgatttgtttgtactaaaaagagtgactatgtactaaagtgctttatctctctgaaccacatcagtacattataaaaattaaaaaaaaaaacttcaagttcttgtaagggaaaaaaagattaaatataaaaaatttaggatattattattattaaacaaatttaaccaagaatcaagagaaatactttccctcttgtcttttttctcccccatctctctttttttataaaaaagaaaagtgcagtcagagagaaggtgaatgaatagatgggagctaggtagaggcacaggagaggttactggctgctagtgataatgcacaaacatgtgccttaagagttcatcagctgaaggtctcagtttggcctctacaaaaatccgtttgaggaaatctcgagtatagtctgagacatgaggtggcagctttgggtttgttggctgagtggcgattttaaagatggcagccattgcttcaaattcagcccaaggcggcttttcagttagcatttctaccacagtacatgcaacactcctgaaaagaaacaaaaagaaatacattacacaaacaacaacatgaaagaaagctagttagctagaaaatgagaaacaggcattaagtccatatatatttaaatatgacttaatttcaagttcaaagtttcattaaaaagttctaatttcgtaaaactaatttaaacataaaaatcaattaaaataaatttaatgactatcacttaattcaaacggttgggcaaagaacattattcatcttattatttttgttttatataatttctaacctgattttaaaaataatttttgtctttatcttacaaagaatataagcattagaaatcaattgccttcaggtgcctaaaatgaatgtctattaaagtcttttctgggtgggaagtagaaaatggccatttcatgttctaacttaaaattataaaagaattaaagattaaatgaattataagacactgacaacaaagatgaagtacttttaaaggtctttagacaaacaaagtaactatttatttacttctgtaatagcaaaaagctttttaatgctgaggtttgctcacgacaaaatccttcctaaagaatggaggacaggttcaaggattctaactatttagtcaattataagcctcaataaggcacaattaatatagtgttaatcttcgcaattcttacgtcctattttggaagtacaaaagattatttacatctgcctcagtaattcaatcccaggtggaaatacataggcggcaggtggttttcaagcaaacttcgtatcaaaacctaccagatgtctgcttttcttccatagccttctccactgatgacttcagggctcatccagtatggtgtgcccgtgacagacttcattcctgtccctgagagacagatggtctgaagccgtttgctggccccaaaatctcctagtttgacgttgcctgttgaatctcgcaggatatttgcgcctaaaaataagacattgcctcatttcattaattttattggcagtctcgaatatagcataaaagaacaatggcagagaattacttcatagactctttgatttgtccccaaagttaggctgcttttcatcctctggcagtagctggcataatgctagtcacacaggtggtgctcattaaggatttgctgcaagaacactacatttttaggtcagctgtgtgtttaggacctaggacgtttctattgaaaaggactggtgcaggttggaggtgggggtgaagaggaggagaaaggggaaaagggctaagaatgaagctcagtgaaggaccaagaaagcccccagtttctctatcataaagcaagaagcccatggatgaagcttatttccctgagaagtcagccttttctcagaaacttccttagggaccttcagaacaaaagcattttccccctctattacttaaatttagttaccttacattttagagttttcttaatattgaatcttgctttatattaattttacttcccaatttctaatattttaaatgtctcataggcaggctttgagcttttcatttaaaatttcattagcttttataataaactttttagatagcttcagatttacagaattattgcaaagacagtatagagagttcccatatacccccacacccagcttctctattactaatatcttagtatggtacatttgccacaattaataaaccaatactgaaatattattaaccaagttcatactttgcttagatttcctcagtttttccctaatatcatttttctggatccaggatcctaaccaggatcccacaccatatttagtcatcgtgtcccctgaggctcctcttaggtgggatactttctcaaattttccttgtttttgatgaccatgacatttctgaggagtactggggtcaggtttttgtagaatgcccctcaattaggatttgtctcatgttctcataacgggggttgtaagttttttggaggaagaccgcagctaaactgccattctcatcatacgatattaaaggcacatagtgtcaacatcattgttgatgctgaccttgatcacctggcttaagatagtgtttgtcaggttctccactgtaaagtcattctcccccaccctttccgtactttggaagaaattcgccacgcacagcccacaattaaggagtaaagagttatgctccaggctgagtagctacataaattatttggagttatgctgcagaagagatttgtctcccctctcccacatatttattaaatcattcatttgcatcactatgaacatggatatttgttttatacactgggttataatccagtactactttatttgcctgctatttatcagtttcagccactggagttctttccactgactctgtgtccctttgccatacccccatcattgtatccttggcttttgttttggagcactttcttgctttctggcatttgaagatgctccaggctcatcttgtatatttcctgcaccagtgctagaatcagccatttctcaaggaggcctggttccttttagtggagaatggtattaaaaaaacaagatattggccaggtgcagtggcacacacctgtactcctagcactttgggaggcaaaggtgggtggatcgcttgagctcaggaattcaaggccagcctaggcaacgtggtgagacaccatctctacaaaaaaatacaaaaaaattagctgggcatggtagcatgtgcctgcagtcccagctacttgggggctgaggctgaaggatcgcttaagcccagagggccaaggctgcggtgaactgagatcatgccactgcactcccgcctgggtgataaagtgagaccctgtctcaaaaaaacaaaaacaaaaaaccaagcttgggcactaggctcacttgttttttattctctattttcactcttatcattttaaaaactctattttttctgggattataaatctagtttccgtcttttataaatcatttctcttctcatttttttccacatagccctcattactttggaccttctcatttttaactttttctttacctattcttaaataagccatttattttattatctaattttaaaattttacttcaattcttatttttaactcttccataaccttaaccatattttatattacaaagattcattttcttggttctcttacccttttcttaaaaaacggtctctaagaaggagactgaatagtggagaaaagctaccttacagactggagaggataaagagaccccacccctatcacggggcttctgtacctgtctttctgttctaccagcaaattccccagtctagtcaatgatggttccctaaagcctctctccagaggagagtccagggtccattctctgcacaccttaagtgtaaacatgccatgacattagtgatcttctgaaagagcactgtctaacatttcctaccatccagtactttaagaaggaatgtcaaaaaagccaccgtctctagaatacttaaccagtggaaggacaacaaagcccattttttactggctacaagcagggctctgataggggaaggaacagtccaaggcaggtcacagacaggggaagctgtctctggggcggaatcaccaatattgaaccaatgcttatccacaagaagggcggaggagaaaacgggtagccaggctccaacagaagtttctaaaaacttattttggacatgttaaaaataagttattaaggagacttttcagacatacacaaaggtagagcagcatgcgcagccatcacccagcctcaacatccatctggacaatcctgccccagccatactgccaaccactccccctcccctctctaggatttgaagcaaattcaagatgtcatgatcaacaaatggttcagtacatatctttcaaagataaggactcttatcacacccaagaggatgaacaataaattgttaatattatcaaatatatagtcggtgttcaatttgttacattaaaaaaaactagaatccaaatgaagtccatacattgggagtcactgataaatcttctaagtctttcctaaagttccctccaatctccttttcttttttctttgcaacttatgaagaaactaagttgtttgcctatagctttctcatggtctagattttgctgactgcgtcccaaagaatcattttaacatgctcatctgtcctatatgtatattacataattctgtaaccgaatttggaggcgtgatcagattcaggttcaatttctgggggactgaggaacaaaactagatagatgatgctgtattctagacagtctctatttaagtgatatcagcagctattaatgtttaatgcaatatctgttcattattctttctccgcttgttagccaaaatacttctatgaagataagtttcctttcatccattaatttcatcttcagtggtctagtttgtaaaacaaacggaacaaaaacaaaggcagaagagcaactagttcttgaaataatgagttggttccctagcaatataatcaattaattttcatcctaggtttcattatgacttcacgggtctaaattgaaaaccaatcaactatcttccttttctcttacgatttaaaagttgctcatggaaatttgagaaatacagaaaaagtatataggagcttggcaacatagcaataccctatctctacaaaaaaaaatttaattaactgggcatggtggtgtgtgcctgtagtctcagctactcaggaggctgaggtgaaaggactgcttgagctcaagaggttgaggcttcagtgagccatgacagcaccactgtactctagcctgggtgacagagggtgaccctgactcaaaataaaaaaacaaacaaaggccgggcacggtagctcacgcctgtaatcccagcgctttgagaggccgaggcaggtggatcacctgaggttgcgagttcgagaccagcctgaccaacatggagaaaccccgtctctactaaaaatacaaaattagccgggtgtgatggcacatgctggtagtcccagctcctagggaagatgaggcaggagaatcacttgaacccagggtgggggcggaggttgtggtgagccgagatctccccattgcactccagccctgggcaacaagagtgaatctctcttaaaaaaaaaaaaaataaaaacgaccatcactcatcctgccacttgatgataaccaccatcaatcatatggaaattttccttctaggtcatacttgaattttacaaacttaagatcatattgcacatccaattttatattttacatttattctcttatcaatatatttgccctatgctttaaaatcagcttacttccagccttctcttttgaccaggatggctcatcacttctggcaaagtttgaagaagatccactcggcgggtagctccctcagttcctttgccttgcctcattatgagggctaacgagaagctggcttgaatggacattattcctaactgaataacttctctatgaggttcttcaagctatcaggtttcgtacttaacaagggaggtctgcctaagatgcgtagatcatgagcaatgtccccatcttttcagacttactctaagtcccactctagtacaggtgatctggcttaggcattctgcattctactctatcaccaggaactggttaggaatgttcttgttggtctgaatatggccataattaggacgtgccacacctcaaaggggaagtgaaagcctgggagctcgtaagagtccccagcaagaccaatgagtaatatctttatacatgcaaatacaaacgtgtacacatacacatttacagtaatacattgcttaatgatggagatgcattctgaaaaatgcatttttaggcaattttgtcattatgcaaacatcatagagtgtatttacacaaacctaaatggtatagcctactacacacctagtctatatagtatagccactgttgtaaatgtggtccataatgacgtggaatcatcattatgtggcacatgactgtttatttattaacagatggggtctcgctacattacccaggctggacttgaactcctgggttcaagcgatcctcctgcctcagcctcccaggtagctgggactacagtcatgcaccatcatgctgctattcattatttttattgattgatttataaagtgatgtctaaatttggggccacaacctacctttacaggactaaacctccaggtatgttttgtagtatagattttgaagcattcttaaattgcacctatccccaccacttgcttttgtgtgactttatgcatttacctacatcctttatccctgcaaacagctgagtttttgagttttaaagtcagtttgacatagttggggttcatcaaagctcagtttggggctcttttcttcgcttctcttcattctttccctcggtagtgacacccattcctccgagtttaaattaaagcatattgcatgcattaactcatttactccttacaagaatcctatgagctggatactattatctccatcatttaagaatgaggaactgagagactgagtaacttgtccaaggccacacggtgtggataaaagcccaaatttgaatcaggccatctggcagcagggatcctactcttagccaatctatcctaatacctatgcaatatgtatgaaaacatgatctcacttgtatggtctcttaaactttactggttctgtgagcccccacagtagagctacccatttgtggagacaggactggtgtgatagaacactgacagagtccataagaaagcaagagaactgtttccctgtagtatttcagagacagatgaattaatgttaaatgtcttacccacatcacttgtttcattcacattcactaagaactgtgtacttaaaatagaaaatacctcattacttacctttgatatctctatggacaatcatattactgtgcaaataatggacaccctccagaatctgacgggtgtatttcctagtcacattctcagtaagagcgccatatgcttttaattggtccttaattgaaccctaggagaaaagaaaacaaaaataaaaactactgtatatggtttgaaatgaaaactgctattaaatctttatcagtaaagagggcaggaattctcatctcactcgtctaagcatgtcctacttgaattttacttattttgttcttattctgtttttaaagtattttattgacatctgctgattttctcagaaaaaggaatgggtgtaactagaaagaacacagagattttaaagtttttttctttatatactcaacactcaagttcgaaacatgagaacatacacaaaaggagaatagattttcttaagtgttttttagggcaggataaggtgccatctctgagaaagctgaatcagtctgaagtgaggaataggtatttgaattttgaaaacttccctagtgattccaatgtataagtttgattaataatccctttaaaagacagaaataaaatgcttcctgagggacaaatctcttttttgacaggaaaatacatccaaatgtttctgcttttccttgaattttggtaaacggtgtactctgtcatatgaaagtaaatccttggattttacagatttaaccatttgtcctttccactgtttatgagccatccttggagggagagcattttgcaattctgtggacccaaatttgcaaacacacatatggaaagcggcaagtgtggccagtcaactactcacacctacagttcagcacggcttgtttgttcagtctactgtgtctctacttgtagtattatacagaataggccaggcacagtggctcacacctgtaatcccagcactttgggaggctgagtgaggaaggcagatcacctgaggtcaggagttcaagaccagcctggccaacagggtgaaaccccatctctactaaaaatacaagaattagccaggcatcggctgggcgtggtggctcacgcttgtaataccatcactttgggaggctgaggcgggcagatcacctgaggtcaggagttcgagaccagcctagccaaccccgtctctactaaaaatataaaaaattagctgggcatggtggcaggtgcctgtaacctagctactcaggaggctgaggcaggagaattgatttaattcaggaggtggaagttgcagtgagccgagatcgcaccactgcactccagtctaggcaacaaaacaagactccttctcaaaaaataaaaattgtagccaggagcaatggctcatgcctgcaatcccacgacattgggaggtcgaggcaggcgggatcacctgaggtcaggagtttgagaccagcctggccaacatggtgaaacctcgtctctactaaaaatacaagaattagctgggtgtggtggcatgcacctgtaatcccagctacacgggaggctgaggcaggagaattgcttgaacccaggagacggaggttgcagtgagctgagatcgtgccattgctcagcctgggcaacaagagcgaaactccatctcaaaattaaacaaataaaaattatggaaatgcatgtatttttaaataagtaaacatattaatcaccaccttgaaaatcattaatactagatgtactctatataatgacagatgtcacaaatcacattttataactcctaatgaaattatagactctagtgatgactatcaatcagtgctaaaaacattaggtggatggctgaaaaggaacaggctattcctatgtgccactgctatacctcatattactttctggtgtgcaggaaaaaacaaaactttacaatgcaggactcaatatgtcaatcatcctcatctaatggtagctctttgcattgctacagtggaataaccagaaattggctcctgataggatgcaacataaagtacacagcttcatctatgacgtatcagataaaaaaggctgaatgtgaatctaatttagacctcagatctaacttggagtttatagtaaaaaagggataaagaaacaaattaaaatccgcatgctcatttcggcagcacatatactaaaattagaacgatacagagaagattagcacggcccctgtgcaaggatgacacgcaaatttgtaaagcattccatataactaaaattataaaaaatttaaaacaaaaaaacaaaatccacaagaatgctactagagaaatccatgagaatttttttttttttttttcaaattcttccagatcctgagagtgaagactcttaacaggctatcctcttctctttgtcaaatctatatcatgtacaaattgactgctctagatagtaatcctagcactttgggaggctaaggcagaagaatcacttgggctcaggagtttgaaaccagcctaggtaacagagtgagaccttgtctctacttctttttaagaattataaaaaattgtttaagaagagagagataattaaggggcataacaattaaatgtatgtatagactggaacttggtgtgaatatatcagctataaagggcattttagggcatttaaggaaatctgaagatgggctgctaagatgtctgtaacctacttgagaatacttttatcattaatgagttaaaaaatacaaagacagaggaagaggatagaaaatactactcagctctaatttaaaactcttccaaaatgtccttaactagggttaacattttataatctacgtttttgttgtttttcttttattaactaaaattttaaatagaatgtgtattttcaaaaagatgtactaacttacccctggcatatattccataaatatggaaagtgttttttcctggggatccctcaaacagccataatactgaacaattcgctcatgtagcaagtttttcagcaactgaatttcacactcaagtgcatttacttcctgaaagagagaattcattgttaagtcttcaacaatgtcagtaaaagcaaaaaattctaacttcatggaccatcaaggtgatttcattctgaaaattttagttcccaagtaataaacatctgaaagtctctaaccaataactttttaaacagtccttgatgatatgctaaagcaacactgactcagattaggattataactgaagtactaaaaaagaaaaatccatattaaaaaatagacaaacatatctaatctgttttacaaataatttatactaaagaaaactgcttttttttttttttgaaaaaaaatgcttcttatttagaatggaaggggcttaatgttaaaaaataataatgaataaagtttcttataatgtgacaaagtaatttgtgcagtgatttttaccttgctggtctcaggactatcggggtcaaattgaacttgcttaacagccaattctcttcctgtatcaacatcataacagaggtagacccttccaaaggctccttggccaagcagtttgcccaatctccagttggtcggagctcgaggtgctgaaaaagaacactttcttaaagtgaaatatcaaacagcacacaaataaatggttaataactaaatgagcatactgcattagtgacatccttcattgaatgtacttggatataaggaaaaattatgattatccaaattcacagttaccgtctttcaaatttttctctttcgtcaattttctacaaatcctaaatcaaaaagagattcatatcccaagactcatttttttctgaaattgttttcctaattacacatgtgacagcatctttctttcactcaatctaacattccaaagactgtaagatgcaccatttctattcttcactgcagtaatatttgtacttagtttttcagcctccacctacaatgtagaaagctggaaagagtatcattcccatccaaacaacaagagaaatctgggtaatctacaaaatttaacttttgttgaacacatatcaaaaaactaagattgcagggcaaccaactaacctgaaatctaaggaaaaagtggtacctccaaggagagacagaacagaagcactggctcacttgtggcaaagcacagacaaagacccacacaagcaaggaagaattcacctccattttaaacaaatgtgggctggcatgagagtattgaacccttgggagatctagacacaggtgagctcacacctgctctaagtcttttctgtggacctctaccatgcactcataggagcaggagacaccagggaaagcctcccttggtggtcaaggcctggaaaaggggaatggcccactgttgtgggaaacgcagaaagtccttccaaacccttttcccctaagaaacgagagccttcagccgctggagaaagcagcaaaccctgtcacccctgcattacagttaaagacccactgaggctaggggaatgcaaaagaaaaaaaaaaaaaaaaaaaccctacccctgagagagaggctgaggctggaaaccttctgtgaccctgatcattagagcactcctactcccggaaggtgggcaagcccatctctgagaactgaggagataaagcctgcctaagactgaagctggataggacaacacagaaccctctagtctgcctcccctctcctaggctggcaagtaacagcaatccacttactgagagcatgacaaggccatggagagatcctccctctctgagaagtaggcacaaaagaaaggccaaggctgggcgcagtggctcacctgtaatcccagcactttgggaggccgaggcggacagatcacctgaggtcaggagttcaagaccagcctggccaatgtggtgaaaccccatctctactaaaaatacaaaaaaaaaaaaaaaaaaaaaaaaaaaagaaaaagaaaaatagccaggtgtggtggcagatgcccgcaatcccagctactcgggaggctgatgcgggagaatcgcttgaacccgggaaggggaggttgcggtgagctgagatcgcgccactgcactccaacctgggcaacaagagtgaaactccatctcaaattaaaaaaaaaaaaaaaagctgatggagcaggaccattgagaaaatccctttaggaaaccagcacaaggtaattagaagaatttaaagtcagtggtgcacagagaccatgacaacaacaaaatccaaacccagctcaactcctaactagactgattgacttagctcctcacagtaacggcctagcagaagaagagctgtgcctatttccaggcatacattctatttacctcctcccttatcctatacatgatatctggcattcaatgtaaaatgataagacacaaaaaagcaacccttccaaaaaaaatcaaaagagaaagcaattaatacaaccagactcaggaggttcagaagggaaatttaaaataactatgactaacatgttaaaggttctaatggaaaaggtagacaacatgcatgaacagatggtgaacagagcgatggaaactacaggaatgagtcacatgaaaatgcatgaaatgaaaaacaatgacagaagttaagaattccttcaacaggatcataaatagatgcaacaaggctgaggaaagaatcagtgaacctgaaaatagatcaatggtgggggagagagggagacagggagaaagggagagggagggagagagagagacaacagaggtatgagacagtatcaaatagtctagtgtataggtaataggaatcccaaaagaaaaaggaagaatgagacagaaaaaatacttggagaggtaacaactgagaacttttcacagacaaactataaatataataaactgaaagaacaccagctgggaaccctacacaaatatacctagacacgtcatattcacactgtagaaaatcaaagacaaaatcttgaaagcagctggggcagctgtgggggaagaaagcatattacatatggaggaacaaagataagaattatagcagatttctcttcaggaagtatataagccagaagacaatgggacaatagctttaaagtgctagaaaggccaggtgcagtggctcacacctgtaatcccagcactttgggaggttgaggcaggtgaatcagcttaagcccaagagttcaagaccagcctgggcaacacagcaaaacccactctctacaaaaaatacaaaaattatctgggcatggtggtgcatgcctgtagtgccagatacttgggagtttgaagtgggaggattgcttgagcccagaaggcagaggttgcaatgagttgagattgcaccacagcctgagtgacagagtgagatcctgtttcaaaaatgaaggagaaatagacttttttcaaacaaacaaaagcagaatgaactcagtaccagcatgcctatattacaagaaaggttaaaatgcagtttttcaggcagaaggaatttgatacccaatagatcttggatctgtctttgtttatacagattttggatatatacaaagatctataaaaatgaatagactgaagatatatataaaagacatttttctcttatttttaatcacttcaaaagatagctgtctaaagcaaaaataacagcaatatagcatggggtcaatatggatataaaagtaaactatgacacactagcacacaaaaaggaattcagagtatgcaaatagtgctgcaataaacatctttgaacatgaatctttgtatgcactgcttacacagtaaggtctgaatgctttgcaatccagcctgagttaccactgtaggcctattcccactatttcaagtaagatactcccacatcagccaaaaattgaactattccccatttttagatgatgttatggcctcttgcacattatctcctcagctggtgatttctactcacatttaaatgctatacaataattatttctccatgtatcatctatcccattagattatgtcttggagattatgtttgaaatctcagtggtaggcattcaacaaggatatgtggaatgcatggataaagaatgactagttggtaataattttcctaatacaagtgaagaacagaattatctaaagtaattagcagtgataccatgcttatacctgacattccaaccacctttagaaacaccattattaccttttttgagtagttcatctgaccccaaaaactcacttagtatttattccttttaataatataaaattctgcaaagattctgctctacatttcactataccaagttctattacttacaacggctgggtgggctgatgtccattacggtcaaagtaggattgtctatgtcacttccccttcttcttattcgactatcatcatactctggggtaaagatactgcttccactactagtgcttaaggaatgatcagtaggactgaaactcacaggagaccgtaagctggtcccctgggtccttctagctcttggaaaagttttacgacctaaaaaatgaaaagagaatgaccttataccttttattaatatgttatacttttaaagtatttaaaatttgtaatgtagagaatagaaatttgtcctgtgactaggctaagaaactcaaataggaatgattgggtgggaaaaaataaacaggatctgaatacaaattcaaataatctcttatgataaaacatgtatgagtgtgcacacagaaacatacacacacacatcttaaaaaggaacctcctcacttctggataaaaaggaggaaaaaaatttactctcatttccaataatgattttaaaatctaaaacaaagatgcagaagttcacaggtagtaatttttttcttttctttttgagatggagtttcactcttgttgcccaggctggagtgcagtggtacaatctcggctcactgcaacctccgcctccagggttcaagcgattctcctgtctcagcctcccaagtagctgggattacaggcgcccaccaccatgcccagctaattttttgtatttttagtagagacggggtttcatcacgttggccaggctggtctcatactcctgacctcaggtgatccacccgcctcggcctcccaaagtgctgggattacaggcatgagccaccgcacctggccagtaattttttttcttaaagggatgatgtaagtatcaatctcatcatcaaagagtaattttctaatatcatttaaaagttactccttttggatgggtgcagtggctcatgcctgtaatcccagcactttgggaggccaaggcaggcagatcacttgagcccaggagttcgagaccagcctgggcaacatggcaaaaccccatctctactaaaaatacaaaaattaggccgggcacggtggctcacgcctgtaatcctagcactttgggaggccaaggcaagtggatcactggagatcaggagttttgagaccagcctggccaacatggcaaaaccccatctctactaaaaatacaaaaattagccaggtgagaatcgcttgaacccaggaggtggagggtgcagtgagcagagatcatgccactgcactccagcctgggtgacagaacagagtgagactctgtctcaggggaaaaaaaaaaaagaaagaaagaaaattactccttcttggccaagtgcagtggctcacacctgtaatcccagcactttgggaggctgaggcaggaggaccgcttgagcccaagacttcaagaccagcctgggcaacatggtgggacactgtctctacaaaaaaaattttttaattagctgggtgtgatggcaaatgcctgtaatggcacacacctgaactcaggaagccaaggcaggaagatcacttgagcccaggaatttaaagttacagtgagctaagatcatgccacagcactcccgcctgggcaacaaaaccttgtctcttaaaacaaaaaattattcattttcttttaagggataaccaagtcttataagttgtcataaagccaaaatgcccattatacttttgttataacacaattcctcatatttttctaatggtattaacacaaatatgaggttttaaaaaatttttgtatttatttttgttgttgagattttttaactattcttgtggtctaattgctagaaacttaccatcattatactcttgatgatgatatgaaacatgataccttcttggatatgttcctccttttccaaatttctcaaagatagggttatcatagtctgttaagacatataagatggttatcttttatttaaaaaaaaaagttaaatatttctaatgatgaaaagcacatttataaatctttatttgacttttcaaaaatcccccctctccctcccagccaaaacattatccaatgacataaacatttaaacatttagaatttataaagtctaacctgaaaattcctgatgattatctgggtagctctgagccctaggcattcgtgattttggatagctctctctataaagaaaaaacatcacattaagtttacagaaagaacgtaagacattaaaaagaaaatctttgagcaatatctatatctatctgtgcctctctgtatgtgtttgtgtaaaggagctcactttgaaaggttagcatacctaaaaaagaaaaactacacttacttggtacatgtaggcaaagagcatgacttaaaattaaccttacagtacagtggaagaatgacgtattttggaatcattaggtgtttctaagcactgtgtttcaatccaagctctgccacttaactatgtaaccttggcaaatcacccttctgcatcaacaaaaaagataatttccaactattcaagtgtacataagtaaggtatccaggatagtgttttgcaaatggtaagtactcaaatatatagctttctcgttactacttccctgaatttcttaaatgtctaccttaagatagacattgacacagacagaaatttcatatacatggataaaagaaacttaaatgtgcattcccacgcaatattagttatttttttcagaatttgctttcataaagcaattccagagaggattaccaagaatactgtcctattgagaccaggagggggagcacgtgtaacaaaaaattcacattttgcaactttatcctgctcatattcctgaacagctttttcacaaaagtacttaaatttttgcctacatgtaccaatgtgacacagtgggctacaatttccaagaatttaaattatttctaatctggtgccagaatgaacataatcctgaacaggtgaaataactcaggaaatttccaaaaccaaacatattaatgtaaaagttgatagcacttttcataaacacagttttaaaagtaaatgtacataaattctaaatttgatttgccttcaaacacacaattttgacaagcaggaatactcaaactattataatcagatttccttttaactaacaaagatactgagtcccatgaggtaaagggatttatccacactgtgcaaaaattcatctgccgtcatcatacacaagtaccaattctattcctctgaatgtagcacaaaaaagttactgataattcaacattctatctgtatgaatatttactcatatctattaaaaaagaaaactacagtaagctgagcatggtggctcatgtgtgtaatcccagcgctttaggagaccaaggcaggaggttcgcttgagcccaggagttcaagatcagcctgggtaacaaagtgagacccccatctctacaaataatacaaacaaaatagccagatgtggtattaatagcaaatgcctttggtcctagttcctcgggggtcagaggtgggaggactgatggagccaaggaggtcaaggctgcagtaagccgcattcacgccactgcgctccagcctgggtgacagcaaaactctgtctcaaataaacaaataaaccctccaaaaactacgataaacattacccatccaaaggactatcaagtgatggacaacttcctgagccagaattttcagggctgcttaaagataatggatccagcatctaggaaaaaaaggagttccaccatgattcaatttgatataaccaaaagttgcttattaaaaaaacctgccttaattagacatacttcatgtaacataaaattcacccatttaaagtatacaagtcaaggcttttagaatactgagagttgtgcaaccctcactcacaattttagaacaattccatactcaatagtggtcactctccagagttactcattttcaaatgtcccttgtaagcaagccacgacttcaaaatttcctaagagaaaaatattctttctctatagactattgactaaataattaaaagctacaatatttcacactattttgcttactgaaaactgaacaatggccccacccaaactgagactaatgacactatgactattacattattagaaaatgtaaactactataatagtgtgaacatataatgcgatgcaatgcaatgttaagggaataacagcaactccatgaaaacattttaatactataaaattgaagtattttttaaatgtttcagaaagttcacaaacctcagtttcacaaaggtaaatatttgtagtttcattctatctttcaaatgtttaaaaaaaaaatctggctgttaaattacaaagcaaatgcattatcattcactcactctcattcattcacttattgagcaatataaaaccagctgtattccagctttctttatacaggcacatgtaaattaatgggcattttcctatattttttctattttgttcagttaagaagatatgtaattagagaagagataatacacacacacacccagttacgtgccaaatcacactgaccctgacaacatctctttaaattaaatttaaaaaatcaaacttttgcttacttggtccatgctctctggaatgaactctccttcactgttgatactagtgaatgacccattccgggcaacctggtgtaattcatctggaatgtaacctgggggaggagaacttctatctctactagtaggacctcaaggaagaaaaataatgtaatttataattataggcaagggaatcaagttttgttttaaataggctatatttctgaattatatcattaataatttcagcaaaagaaaattcaatttttattaaaacttatcagaacattcatttgtaaatcttcaaatggctttataacctttgtaaattcccaccctatcataattattaacctcaccataatattcatttatactcactaggtaggatggtattctgactgctgataggatgataatacaatatagatttctggcattaagacagtttatttaagtaatcacatttcttatgagacaataacccactctattttacttggttctgtggaaatgatgctatatttattagtacagtgtctcacctttcctcatagttttttgaaattaaactatgtgagcatttaagttctggtccaatttaaagcaaaaaacattttagccttatgtaaaggagtcattgtgagtatatgcaagcatttgttagtgagacagggaggaaaaagaaagcaaaattattaccaagacatgtgcataaaagagagtactgtctacacttgtctgtaaaatgattaggagctcaatttgagtcaggattgatttaggcttcataacaactgtagccacaataatactggtccctaatatttttattccttccatatacccgtgcttacaaaagatcaatatagtcaattactaaaaggagataggaccaaaaaaaaaaaaaagctatgaaaattttgtctccttatttgacaaccctttttcacagtaatgcgtatgccaacgcactcttggttgagacctgtttatcagcatacactcctaacctaaaggagtttttcctccatctcccttttataaaaacaattaaaaagaataactgccaacatataagaaaaatagataatggtcatatctagcaaagccattccaagtttaaagcagtgccaataaaagaccactaattctatactttatgatttccaatttcttcttatgctggcactgacgtcaaacaagaatatttattagaataagactgaggtattcagtgtaattttaattcaaaatatatttaaaatgtcaatttaactagtacatttagcttgttttgtctaatgcaactaaagtgaattagagctgggcactgtggctcacgcctgtaatcccagcactctgggaggccaaggtgggtggatcacatgaggtcaggagttcgagaccaatctggctaacaggctgaaaccccatctctactaaaaatataaaaattagccaggcatggtggcgggcgcctgtaatctcagttattcaggaggctgaggcaggagaatcacttgaacccaggaggcagcggttacagttagctgagaccgcgccactgtactccagcctgggtgacggagtgagactctgtctcaaaaaataaataaaataaagtgaattagcaattttttaaaaaatgacaagtaccgtaatgtgataagaaatggggataaagaaagaaatgtacaatgaacatctgagctttgtacaatgtacaaaatgtataaatgtacaataagctttctagtttgaaaagtaaaatgtacaagtgttctctcaatttaatgctacaacaatcccatgatttaaagatgaagacacatttactggtctcaggttcatcagagagctggaatttgaatttgggtgtttcaaatgttctttcaccaaattttaaaactatatcgaaatatatctgaatgcaaaagacaagccatttgtattttgcttgtgtatcacctctgctgctcgcatttctgcattcctgaaacccaaagtaggacttatttaagacagacacttcgaagagaatggtcataaaatagcttcttctggggaccaaaagagaacatgaataatgtctatttttttgatggtccacatgccaattcaattttttctttgattatcaacaatcctcttctgttaccaatcttttttagattcccaaccacatttgtttttcctcctctttaacttttctcttttaaatccgcccctcatacatgttttcatgccatctttaatggccatactcactgccctctctcaaagaacatttataccagcggttttttgaaacaatgttaatgcttttatcaaataaaaatgtagattatcaatgttttatacaaattgaagaacagacagaatggggagttgagagtacctgtgtcaaactcatgttgcacgaataaagcctccttaaactacagcatgcaagatctttatttctttatatcataatcttaattataacaataaattaatggcaaatgaaaatgaatactaataaagtaataataaagcataatataaaaattcttagtatctttattttgagagcattcttggcaatcactaaaaccctagagaaaggcttgtgaatttacactctattaattttaatacattataattacttcttttaatttttttcctccattctatttgtacaattaaaacctttttttttgagatggagtcttgctttgtcgccaggctggagtgcagtggcacaatctcggctcactgcaacctccgcctcccgggttcaagcaatcctcttgcctcagcctcctgagtagctgggactacaggcatgcaccaccacgcccagctaatttttgtaattttagtagagatggggtttcaccatgttggctaggatggtctcgatctcttgaccttgtgatctgcccgccttggcctcccaaagtgctgggattacaggcatgagctaccgcgcccagcctaaaacctctttaaagttttatttgaatttgttaacattaaaataccctgagtatataaataaagaatttaaattggagattactaatcctgtaaacttgaatttccaagggacgtcaaatattagagtgtatttaaattaaattataggaagtagagaaataaaatattatttatcaggaatatgtttaggtgccacactacattaaaggatggagaagaaattgagaaatcattcatttcataattcagacactagtttcttacctattatagatagccgttttttcctctctgctccaaatactgtattatccaaatcttctagtgatggcaatggttctaaattagtagcctacaaaggagaaaagacagttaatgctattcttcctccttggggctttaaacagaatcctctcccctaccaagtacaaaacattttatattgtttgtgagccttaatcaaatcctctactctttgaaattttaattctaacataattctaagttgtcagtttctattagcttcgtatgtacaacatattatacttatttataactatgactgtggtttttgaggagtaaggatattaaagtatagtaattaaaggatgtaagtttacatttaatcataatgaaaatattgcaatgattatagaatataattatgtttcatatgttaacttttacaagcctaagtcctataattcttactgaaaaaaatatcccaaatcatacctgtgtacttccatttattacaagtaatatcttgaggctcttcatatgaatactacgatccagcagttccacagctttgtccaagtcatcttgagtagttaatggaattaccaactaaaaacaaacataaggaaccatgcagctatctcaccaggtcaagttcttccatgagcatctccactactaaggaattacaaatgtcaaaataccttgctctttgatttgttactatgatgaaagtctgaatgtgtatgtgtatattgttttgccctcctcattctaccgccactaaaatcttagaatgaacatgtatgtttttaaatttttctttattaatcattacattcttctagaaaataacatttaaagattaattttctaggatatttccataatattgctaaatttaagttatagtatgttcgcccctaaaaagaatgaagaagtacagacaaagaccatatgaaataaaggtactacttttcttctgtatagatgaaactcagttcttttttcaatagtaaccacaaatttgcactctcagctggtgtgctcttcaacataccaacatcctgagcacctgccatggaggacagctgccatggaggggtaccactagtaacatatctgcaatctacagcccacctagagttcttctctctgagcctagtgacctgaccactataccctaaaacaaataagctaatgagttaactattccatagtaaaccctgcatgtggaatctgctttcactagtcttctcatgcagcagatgttatagaggacaaaagcacctaagaggtctatgagaaaaagtgtaattcatacaatttaagaaataaaaatatgtcctttttttaaaaaaaaagtcaatttagtaacttaagaagactctgtcaataacttcaaagtatattccatttcattgaaggaggaacagaataaaaacaagtgaacatattctgcactagttaacctgctctactcagcacaatatatgagccattaaaatgcaaggctgaattaatttggggtctctacagtataaattctttgaagacaaggaccccctacaccagcaatgagcaaagagcagacaacctggtaaatgctgtctaataaatctcacagtgttaaaagctcaatctgaacccaaacccactagctggcatggtgtatgttcattctgcagacttctttgtgaaaaaagtccttggggtttttgattttttgttttgaaatggagtctcactgtcattcaggctggagtacagtggcaatctcagctcactgcaatctgcctcctggtttcaagtgattctcctgcctcagcctccccagtagctgggtttacaggcatgcaccaccacgcgtggctaatttttgtatttttagcagagacagggtttcaacatgttgaccaggctggtctcaaactcctgacctcaaattatctgcccgcctgggccttccaaagtgctgggattacaggcgtgagccaccatgcccagccaaaaaagtccttgttataagaaaggctgccaaacacgaatataaagaaggatttatgtgaattccatcagacaatctgcttgcatttacttactctgttgttaaaatatattcccaatttctgtttgtagctaattttgtattactgtaagggaccgactaactgggctcttttcgctctatgagaatttttttctaataaaatacaattattaactgtttggtatcatagaacaagcctgatctactgatctacttaaacacatttctatttcccaccaattatgaaacatattggtatatcttgcttctatcttcaatagtctattacttttcaagcactggaaaacattttaaagcaatggtaatgactgttccgccgatttttcatttgaggggaaaatctgaatacttacttttattattcatttataactggattgtttacttctccaagatactgctacttttgggggaaaacaacactaagtcaaatgacagaaaaaaatatgaacataaatgattctgctgctcttcagtttgctgctgtaaaatgtgaacatcctggaggggtgcctggtgcagcagcttaggcacttgcctacagacctaatgtgatcctgcctgtgttctaaggttacctattacaaaccgtaaaatgaggactaagagtcatgaacaagtcccaggttatctacattacactaaataaatcagataatgttttctggcttggtgaattcatttcagtctcattcatgaaatctatcaccctctggcttatttttgataaatcagttgtttgttgatataaatgctttctagaaaggaaacttaaaattgagttcgagaaccattaaacagaactgaaatctgaaagaactgaattatcttcctgaatttacatagtgaagtatgaagacagccattaaaaggttctccaggctggacgcagtggctcacacctgtaatctcagcactttgggaggctgaggtatgcgggtcgcttgagccctggagtttgagaccagcctgggcaacatggtgaaaccacatctctagaaaaaatacaaaaattaacaaggtatggtagtgcatgcctgtagtcccagctacttagaaggctgagtggggagaggattgattgagccagggaggtcaaggctccagtaagccatgactgtgcctctgtactacagcctgggtgacagcgggagatgctgtctcaaaaaaaaaaaaaaaaaattcctgctctactcatctaaaatggaagtgatcttagaaaatccttacttggcttgaacacctccacatccaacccccatgacacacacacacatgcaccctgaacacctccacaaccaaccctcataacacacacacacacacacacacacacaccccttattaaagagaagccaaactaacaaatccaaacaacctcagcttatatttccagcttaaatttccttaacgtttcaattctagccaactagaagtttatagagtaacagttcattttgaacagaggaattaatattacactagaaaaatatttatagaagtggaataacatgcagtataaatgaattttttgcctgaccacatgtccacaaaactagtaagactttctttagtacccccagtgtccaagatcatgcatttggtttgggacaatatgtcaagatatgaaacaggatacggttcactcacagaatctcagggttgcaagaaatcttaaatgtaatcttatcctaatgccacccctaccacattcctgccaagaggccaccaaaatataatggtagaaccactcacagaaatccttcagaaagcatgagaaaaataaactaaaatggagcagttttccaatttttagaaaatgggaaaaggttcttaaaaatacagatcaggccaggcgcggtggctcatacctgtaatcccagcactttgggaggccaaggcaggtggatcatctgagctcaggagtttgagaccagtctgggcaacatggtgaaaccccgcctctaccaaaaatacaaaaattatccgggagcagtggtgcctgcctgtggtcccagctactcaggaggctgacgtgggaagatcgcttgagtcctgggaggcaaaggttgcagtgaggtgagatcgggccactgcattccaacctgggtgacagagtgaaacctcgtctcacacaaaaaacaaaaacaaaaaccagttagcttgatgtcaatcctcaagaaaaccccagaaaaaaattacatagcaaactgggagaagtcactaaaaaaaaaaccagcaattcttaggaggtgacataggtataatatggacaaatcatgtcatgctaacctcatttttcttgatagacctactaggctgtagataaagacaatattgtagtcttaatgtatcttggcatttgaaagttttccataatacaattttagaaaaaagaaaaaaagatatgtctaggctcccctataatcatcctatgagataataattcaagttcaagacattttttaaaaatttattcttttttgttcagacagctctgtcacacaggctggagtgcagtggttcaactgtagctcactgtaccctcaaattcctgggctcaagctatcctcccaccttaaatccccctgcctcagcctcccgaatagctgggactacaggtgtatgccatcacactcagataattttacttttttgtagagatggagtctggctatgttgcctaggctagtcttgaactcccggcctcaggtgatcctcctgccttggcctcccccgatgtgctgggattataggcatgagccactgtgctctgcccgttattcttcaacacaatactttatgcatttttttttttttttgagacggagtctcgctctgtcaccaggctggagtgtagtgacgcggtatcagctcattgcaacctctgcctcccgggttcaagcgattctcctacctcagcctcccaggtagctggaactacaggtgcacgtcaccacgctcagctaatttttgtatttttagtagagatggggttttaccacttggccagaatggtcttgttctcttgaccttgtgatctgcccacctctgcctcccaaagtactgggattacaagcgtgagcaaccatgtctggcctactttatgcatttctttcaaagaacttcgtatattcaaacaactcatttattaatggtttgcttgtaccacaagtctataaggtctatactccatgaggtgctgcaacttataacttatagcattatgcctgaaaaattaataaatactttctgaatataaaaaacaaattcacctaattactaacccaattattaactaaattgtcctataaattttaagatcacaagatcctgatatctcatagaatctcaagaactaaaagaaacttcagagatcactgaatccaatcctaagtttacagaacattaaaaaggggtttctccacaacgcagagctcctcactgctagagcaagcccttcagatcatacatactgattcccaaacataataagctaattgagccctaaccaacactaaaataatcctttaactcaattgtttaactaccaaagctctgtcatctgtagccaagtgtagagtatgagaggaaaagacagttcaccaataaagtacacagaataaaaacaaaaccataaataagcagcaaaattccaagtaatacatatattttcccctataatacaccctcattcaattatttgcatagtagcaccctctattattttccacaatgaaataaatccattttagtcagttaaaatttacttgttttatccttctgacataccatatatttatcaatccctaaataaaaacacgagtcttaaaagcagtctcttaaacgaacacattacttttgaaggtaagatctactaaagttaaactgtacatgtttacctcgttattggtataatgtagatccatagactgtccaaaggcaattttagctttagatctcagatcttccagtttaactggtctggggaactgaaggattctatataaacacaattttaagattttattttcttaggcaaagttaaataataaacttgcaaaagttacctccttttagagtgatacaagattaactaaaaattacgtaaatattcactttacttaacactacaacagcacattttttaacacaggcacacattttcaacacaaagttcaaaaactctgaagtctgttttatcctaatacaaattttaaaaaggaaattctcaaaattttctgcagtttttaatttgcactgaaactaccatatgaatgttaaagagcaatgcaaaatgtttattcaggaaactgattaaacttaactatgtgacatctgtatgacagaatgaaatgaaactgttaaaaagaataaagttgttctccagggattcaaattttgatttctgtatccttatcaactcaacatttttgggtacatatatcatgtaggcatacttccaaaataaatatttttacaagattaaaattctagtgttttctttctacttcccaaagactggcctgtgctgcccctagagagcatgcacctaaagcttgaagaccaccaataccacactataagccccataaggaaaaagactgtgtctgctttgctccctttattccttcagggcctagcatatactaagtactcaacaaataatgctgaatgaatgaaaaaattgggaaaatatccaaaaaagaatcttaaataggaaaatagattggatagttccatggtttatctgatatattccagttttaaatatttctatgtagaatatgcttatatgatttgtgagccactttaaaatccttaaaactgttaggcttttcactacattaatttcatgagacactaatagcagaaatgaaattctatcatcaggctgggagcgtgggtcacgcctgtaatcccagcactttgggaggccggggcgggtggatcatctgaggtcaggagttcgagaccagcctggccaacatggtgaaaccctatctcgactaaaaaatacgaaaattagccaggcatggtggctgttgcctgcaatcccagctactcaggaggctgaggcaggagaattgcttgaacccgggaggtggaggttgcagtgagccaaaatcacgccattgcactccagcctgggcgacagagtaagactccatctcaaaaaaaaaaaattctatcggccttaattcctattaggtcttgttagcaattttgttgtcaactaccaccctatcatttgtgcactgagatacagataccaagtagaagactaggtttacatctctgctaaataatttgcagccactagtccaattcactttcctcaacattactaatgacgtaaatgtcataaaactgaggtctcttgagaataatcagaattgtaaatgttaagctcacatatataaatgctatatagtatctggagggatgaaacaattataaggaaaaatatatttaatttcccccaagtaaaaatgaaaggaagtgaaaatatgtaaaggctgtattaaacagtgatcttatttatctctgaaaattgcaaagacattaatcatttctaatatttaacctgaattttgacatattttatctatcttaagtctaagcacattacacattcccaaggactactctattctcaatttgtaaaccatgaaacttcattcaaatctgaaaagaacctttcaaaagcttaattagaatacacatttgattaaatcaattaattaacatgtaatgtttccttccttaccttttttctcctctatgttcaaatttgactcggacatcattctgtaatgaaatgacaaatcagtctttcagagattagacagatcattcagagattagataaaatttctacaatttctaaatgattttgttttttagccattcatttaaaatagaccagacgaggagggaattttgaagttctgtaccagctccaaacaattgatagtgtctgctaaaaagttgagaattatgttgctgaatctgggctcaacaggaaagaacaccaagatctattagtgaaggtaccaggagtatgagacatttgctgatcctgttatgggaaatacagaatattatatttttatgtgtcatgctgagtatccaaaactaatttcatttatcagaatcaaaaacatcctcatttctaaaaatccagagtagactatttgaagaacaaaacaaaacacaatttgcttaagtgcttgaaaaatggatgaaatgtcagctttggagaacagttaccacattaaatgaaatgctaccttattttttctgggaaggggtcaacgttggctgcagaatgctacaattctttatgaacacaaacttaaaaaaaatttttttaacttttaagttcaggggtacatgagcagttttcttatacaggtaaactcacgtcacggggagttgcttgtagattatttagtcactcaggtatcaggcctagtacccattagttatttttcctgatcctctccctcctcctgccctccaccctctcgcaggccccagtgtctattgctcccctctatgtctccatgtgttctcattatttaccctccacttataactgagaacatgtggtatttggttttctgttcctgcattagtttgctaaggataatggtctccagttccatccatgttcctgaaaggacatgattttgttatttattatggctgcacagaattccatggtgtatatgtaccacattttctttatccagtctaccactgatggacactgaagttgattccacgtctttgctactgttaatagatgaacacacactcttacacgaaaatgtgtaacaaacactaacaaaattcttgattcgaaagtgtaaaagctgaacacattaaacaagtcctccataagattaggatattaaaggaaagtaattcataaaaaaatacttattaaaataaatacctgtttttttggtgatgaagattttgcttttctggtttcctgcaaggataatgctggtcgactggccttatgaaggacagccaaatcttgcatgattgagttcaaagcttgctgatcatctaggtagttttgaaacaacacatacatagaattgtaattgtgacatatatatcaacatgtatagacatcaaacacaaaatttaaaataaaatttgatgtagagaatgtattaatgcaaaaatgcatctagaacatttttaatgcctacacttttggtaaaataaaattgcactagacttaatctctagcatcagtccacacatgagacactaatggacaagatgaagtcattctgattcttccaatgatttaatatcctagaataaggtcaaaactgccctgttataacaaattcttttctatgactcctaaacaaaacatcaaggtatctaaaatgttttaaaaagtagggaaaaaaaaataaacaactttgtataaatctcattacttagcatttatattcaaagtacagacttaattttggaaggtttttttattctttcatcaatacttaagagtcagaaacaaagaaaagcttcacctgtggatactggcctactgtatttggaaatgctctttcaaacttcttcaccataaggtttgacaagactaaaaacagactatttaaagatcttggccagcaacaatgtaagaaaattcctttccttagaaaaagtaccaagtccataaaactgagagaaagcatcatgaacatgaacttttagactcttataaatataccaaagatttccttctgagactaaaaccatgtgcctgccagtaatgccaattataagctctccagaagacatcagggacaacttaatttattttcactagtaaatcaattctactaatgataatcacaaatgataaataaaggaatcaagagactttacactttacattttaaaatgtaaccattttggtgagcagtaacttatgttcttggagtagtaaaaattaaaacatgccatatcctgtatgggaaatcactaaaaatattccaacaattcagtagccctaatagtctctcaaacacacaaacagctgacttctctaatttactaatttttaataacacttaatatagtctattttgtagtgaaattatttgcatattaaaatttaaaagtaatggttgccatggttttattggtttattaatttattaatatttccaggttaagaaaaaattttataatccttcaccaaggattttttataaaataaagttttatcataatgttagtttagccaaataggtaaccaagccacagtcaggtacaatataatcacaatagatgtacccatcaataagctcacaatgatctcaactggaataaaagcatttgatgtgaccttctttaagaaggtaaatccttggccaggcacaatggctcaagcctgtaatcccaacactttgggaggccgaggggggcagatcataaggtcaggaattcaagacaagtctggccgatatggtgaaaccccgtctccactaaaaatacaaaaattagccaggcatggtggcaggtgcctgtagtcccagctacttgggaggctaaggcaggagaatctcttgaacccaggaggcagaggttgcagcgagctgagattgcaccactgcactccagcctgagcaacagagcatgaatctgtttcccaaaaggaaaaaaaaaaaaaaggtaaatccttaattctatactagggatagatgaactctaattctttttttatttttttgtagagatgggggtctcaccatgttgcccaggctggtcttgaactcctgggctcaagcgatcctcccaccttggcctcccaaagtgggaacttaaatctatctatgttgttctaatttttattagaagaaacctaaacatttgaatttaaacaattttatatgcttaatattacaatgtcaaaataaatgccttgggggagggcctttggctaaaattatcacatttataaatacttctttctttttgggggggacgggggaagcaaggggagatggattctcgctctattgcccaggatggagtgcagtggcgccatctcggctcactgcaagctccacttcccgggttcacaccattctcctgcctcagcctcccgagtagctgggactacaggcaccccccaccacgcctggctaattttttgtatttttagtagagatggggtttcaccgagttagccaggttggtctcgatctcccggcctcgtgatccgcctgcctcgacctcccaaagtgctgggattacaggtgtgagccactgcacccggcctacttatttattaagaaaaatgagaacggaaaaaaaaataagtaccgttttctgttatatatgtaaaaaatggtggggccagttgaacaaaacttcccatattaggaaggtgacataaaaaacaaagggcaatttaattgagttccttacttggcgggcttgaagaattactactgggcacttatttacccataagtacacttacgtacttatgggtaagtacaatgggtttttttttgttgttttttttttttttttttttgagacagagtcttgctctgtcgcccaggctggagtgcagtggcgtgatctcggctcactacaagatccgcctcctgggttcacgccattctcctggctcagcctcctgagtagctgggactacaggcgcacgccaccatgcctggctaattttttgtatttttagtagagatggggtttcactgtgttagccaggatggtctcaatctcctgacctcgtgatccacccgactcggcctcccaaagtgctgggattacaggcatgagccaccacgcccggcccaatgggtttctgacacatgttggaaggacactgaattgagcacaaaaccaaaaaatacttggaaaataattttttcaaaaatcttttatcagaaatgttgaattaaataccttatatgcttattcatgatatttgaaaaataattacagaagaacatcctcaatcaaaaattcaaacatctgtcatggtgttctgtgactaactttgtatgtttttaagcaatgaatgttgccctactatagagcagtattatttgaggctgacaaaaataaatttgatcgatacatagagtacaagtgacagcacccaaaataaaaagttgaaagaagttcagtaaaagtacatccaatttggagctgaaagtaaggctgactagagtggagaatttgggctacaagggggcactgctactcatgactacagaagaggaagtggaagaacaatttttaaagtagggaggtgaagtctaagcttacatacttgctacaatgacacacagtgaaagtgtcctagcccccactttcatcacatgggcaaatataagttcttcatgagggtgtgtgtgtgtgtgtgtgtgtgtgtgtgtgtgtatttgttttgttaagcaagaagtagaaaatgtgtgataaaggcaaactctggcaagcaaatgtcagaattaaatcccaggatcagtctaagtttcaaaatttagcatccaactactcagtaccatttttcttgatttaggatagggtgggccattcgtgactccatttccttctagtgtcttcctgtctaactaattccctgcctcatgctggaacccttaacacaaaggagaaaaggaaaaaacaaaaaggaggtaaacaggaaaacaaaatatgtaaactgaacatacacaatccattcccatactttagtgtctttaaactaacattataccacaatatacgaccaagagttgtataacatattctccctgagcaccaatgatttgctgctctatgaatgataaaattaaattttatgatttctctcttgccatcagactttaagcaaatcacaacacatcttaacagcttattttgaatgtccctgctgttacgcataaaatgatcattctaaaactacagcaacacaaaaagtactttaattcaaagtctattaagtaaatataaaacatttcataaatctgctatatcataaaatttatttataaaaaggtttataataacacataatagagaaagttttttcacttccattctatcctttaattattgctgaaaaatgcttttagtttgaactcacccattatggcaaacagctcaacaatttgaaaattaggaaaatggttctcccatcagcattctttatggcctgagaagataaaacagatcagcatattaataaaa

SEQ ID NO: 1858 - DNA, 108024 bp, Homo sapiens
ttaaaaagacttgctatttactgagtacttgctttgaagtactatgctgaacagttgaaatgtatttttataatctttaccatatacaaggcaagtaatattgcttccactttacagctgacagtctgaagcagaggaagaaagcagagacgcagaatgactggcccacagccagccgcagttataagcagggggtagttctgaacccagctggatgggtccaaggcctgtgctctttccataacaccacatccaaaacattttccagtatctttgttttgtaaataagtcattacataatgcccaatattgataagaaccaaatgtccaagaaatcctatctttatgacttcttgctctgaaaaaaggggttgcccaggatgtctgcccagcagtggggttgcagaagttcaggaggatgaggagatgggcgtgggcaccgcctacccccccccccacaggtgaaggtctgaagaaccacctggagaaccctaggagcactgacatccccattcaactcgaggaacagctcacagccctaacacaagttaccacatgcagagcaaatctggaagacatctggggaacataacgaaggactagacaatttcacgttttcacagatgaaactgcaattaaactatacatgcacggtgctgtgttattttggtaatacagggacacaatttaatgattctaaggatttttttgtagttttttttttttacaagtcaggtgccataaacattcaaataatccatcttttaaaaagtacgtttacaacatcaaaagaattaagatgaaatataaacctttctacttacaatttttatacagattaaccaaatcacaaataccacaaataaatgttaatgttaaattgtaacaatataatgaataaacattcagattcttaataaaatcttcctttaacattttttaacttaccattatactaaataatctatgcagaattttggggtacaataccaagaaggcaccaacagtacaaagcagatacaaagcagtttcagaactttcttgagtgctctacacgcataaacagcacaagaaaaggcaacaagctttaggtaaacctggtgcaaccctggaggacttgctctggatttccatttgtttctgacccatcatgtcaaggtggatgacgtaagagaaaccacatattcactgttatagcttctcatctgcaccacaggagtatcatgtttcaaacaccagcataacaattttaaagcacaaatgctttaaaaatgtataagcaaaaggattgctcagattttcaaaaccattacatttacaaaaatatttcccttaaacttgggattgctccaaaacattgatttacaaatataaaagtattatggaaggacccaaagcatgtgtgcgtatgtatgtgtgtattaacatactgttaccatactatataaaagttaccaatttaaaaaccatattaacatataagcaaataaagagaaaacagtttcctctgaatggctgaaatattacgtggcatgtggttgggtagtttacttttgtgattccttagagaaaaccactggtgagctacatgtagcttctcaaagctactggttacctctacacccactgcctgtgcccaagagcagaaggaatgagtgtgcacacaccacacactgtgcactgcacacacaatacagtattcttctacccagatgccacaatgtctgcgtatctctgctagctttgaggacctgtgtcaggacagagtcctcatgattagttctttcaattccatcccactggcttgttcagtatttcttttatactaaatgaaaggactggaatgtttcagcaggaattttttgcttacattttagacaccaaaaaagctattagtctgaaagcttatttgaacatacaaatagtggaggtgctgttccgtgtcactaatatgaattaagatgacctaatctgtacatttttacaaatgtaagaagagccaaaatgatgcatctactacacatgatagctagcgcttttcataggtaccttggttaggaccattctctgcccagttacattatgtttggcatgattaataaaaagcacacaacttatggctacaatgattctagaatgaagttagtggtttcatgccaatctgactccacagtaccaggaaggggaatgggaaggagctcacagtctccagatgttagtagccaaggatatggttttctatttagaagaggactccaaattaaccttataatagtaactttccatttaaaaagaaacaagagtaataaaactgtcaatgcttttttataaatgaaaactgactaatcagtgttatccggtaacagtcacatttctgtgtcccgtcaatgctgtgtggaccttcagacggcagctctgagcacgcaagtgaaaagcgcgtatttcagggcaagaatagagatgtgggtctgttttccgaggatgagccagctatccttcctcagccacaggagtggtgagcgtgagcaccctgggctgggtggtgaggactgcgtactgtggggcggcccttcccaactcttggctgtgcccagcagcacctctggggcacaagggcaggccctctttagagagaaccagggaatccaacctgagatgtcggggcttctttgttagggtttgacagaatatttgagacctaagattgtgaataaaggaacatgacagcatcgattctctgccgagcagaggtaaaaaggaccctacagaagtacctttctaactcatcttatgtaaatccaagtgctgggccagtgcctgggcggcaaagtgaggcctgtgagcatttctgtgttcagcacaacctgaacctgactgtccattcagacacgctgatccagaggaaagcaacactgaatcttaacatgaatgtgaagatagaagatgtacatttattttcatgaattacaaatgcatttctgttcatattagcaggcagtctttatataacccattctccattgctgtcaaaaatcaaacaagaaaaaaggacagctgagaaatgaaaagctaaaaatagaattatttttcctaaatgatctgctggatagcattttccgtggaacacaactcagaggtaacaatagagttttcatttcaatcgtaggcatgtggcacttggacagtcatctctgcacagaaagctgtaacagtcatgcgagggtacagtaattattgaacaaggcaaatttctcaccacagagagcagtggggaagtcaagaggaggcaccgcactgggacagaacaccgagtcaactccacagtacacagtggcaggaacaaatacttaaagagatcagtaaaatatggatagagctccaaacacgagttagtgctagctttttctgacagtctgactcagcagtatcagaaatatttgagtacttgaggacagaacagtgcttcacgtcatgagctcctggaggctttattacaaattgttatactgtaggttgaaaaatgaacttgagatgctgacatgctgtagaaggaaaaagaattgtatactttctcatttaaagacgcagtgttcctctctgctaaatcctcaggcatggaacgtggttactgaaacacccacatttgaagtagctcaagggcgtatatgcaccagcatgtggagttccaccctgggacatccccagaaaccgcccacagctcagcactgcaacctttgtacttctctcaccaaatgtcgagtgaagctgccactttaaatctttttttgtaagtcttacaaacattaagtactgcacataacgcttcttgacaagtgttacacctctatatggtacaagtgaccacagtaactacagagtgacactgctgggtgcagtacttcctttttatttagaaaaatgactgcattttctaaaagctgggccaatagcacataccttatatatgttagtgactaccatgatatgagaaaagacgtggacaagtgctccccaaggattccggagacggaagcacttgctgcaggctgcaacatcagccaaggtatttccacaagctcctgctctggggaaacagttatggtcaaaaggtgaagtgcaaataaggggctgtcactgacttaaagtgccctaggtagtagccttccctatcataaagtgagatgccagtgactagagccaattggggaagaatctctctctggtgcggctgcatggtcagcagggcatcatgtagaaaaggattcaggagagggaggaaccactgcatctttcaaaccagaaagcaattagtgactaaagcaacagtaagcagtaggtgcactgaagtacatactgccgcaggtcaccaatgggtgacacacacagggctgccaggaggaattctctggactgaagaaattctttgaaagcataaaagccacaactaccagaaaccgcccctccaaacggctcaaaggagtcaaagtggataagccaagacgggctggagacaggaccaggggtcaagaactgggaagaagaacaccgatgtctgagcacgtccagtcctctgagcccttgtcctatagaaacacaaacagaccactgagttaagagtgagccatgtgaaaacagcatcatcatcagcatcacaaaacacaaaagtgacaacagtgaaccacattaaaacagcagcagcagcaatagcattatgaaaacagaaaagggaaaaaagactcctgcaaaatggccatttctttggacacatttgggcaaggataacacatggcagttctgaaggggccagggtcagccctcactccacaggcacctcctctcagacagttctgaggtggtttccacaacactcataggaaagacgccactcccccagcctacgctgactgcagtgttcctaagatgtcctttatttaccgtaagatatccaacactagtgcatgaaaatctagcagagtatcacttactatttcacagagcactttcagagctgtggtttccatctgccactcaggaggtggggcaagaagaatgggctaactatagccaaactgtggacttggagatgggctaagagggagaagtggtctcttttatgtagaggtgaactgcagccaaacctacgggttggcaggaaattaaagctgccctaaaatgctttcatcttcaataaaccaaagggaaatgcggttcatgcccctagtgatcaatccacctgagaaaattcacaatcaggcagatgaagaaggaagttgagcactgacctctaccttcacccgcctcacagggtaggagactgaggacatgggctgggtaggaatgaggcttgtcacaggtagtaggcatgatcagcttttaaacttgcccatggaaacatttctaaaactgacccccttaagcaaaatacaatgaatataatttgacccttttttaagacctttcggccaccactacaaatatcacttcattgcttcctctaccaaaggggccccacagctgtgctctgtggtcctggggtgtatgtttctaagcctttcttgctgcagccaaacggtcaaccgtgccctcccagtgttcccatgttttattacacctttacctcctgagctctccaattcagagctcctgatctccagtgtgtgggctgggaactcagagacaatgctccttagtattgtgaatgagtcctgagaactttcccaaggagcaaggctaatcacaggcagtgtgcagcctgccactgtttcatgctggcaaacatttcaagaaaatgacattctgggtccaaaatacctggattctctgcctagttttgccacttgatgtacaattttgagcgaagtgctcaaaggctcctgtcttcagtttcctcaattataaacatggatgcatgctgacttcccaaaattctgttgtgatcaccaaaatgaaatgtttatgaaagaacctatcccatagtttaatcagccaacccagccccagcttcccctggattcatgtgatattctagatgactaaattgtaagtcagtctagacgttggcaacgtcctttgcaatgaatggataaaatgcgatgggttgatgggtggatagaggaacagatggacagatctatgagaaaacaagtaagatgttaatgttaactgtataatctaggtggtgggaatatgggtgtctactttaaattccttcaacttttcagaatagttgaaaactgtcactaaaagaatgttgggaaaaaaaatcatgctataagcacatagggagcatctgtgtgtcttctgtgtctggagcaaatgaacaacgcacagaggtgactgtccttgccacgccgggactctcagagtggtggtggacctgagagggatactggtcccccgccttgcaaagctggcttcaggaggcgttctgccagcaactgcgccctgtggcctcaggagcaaccctgcctctgtcttgccatccttgtgcctgcggtgctgcctgtctcttcagtggcctgaccagttttcccccaagtccctgctctcagaggtcctcctgcatccttactgccaccagagtcacctgagccactgcttcaggtcaggcagctacctgtgagggagagctggcctcctggggaagcaagggccacagcctgggctggcctctttctctgcagcccccctcttgcccagctgtctggcatgcccgccttccagggtccacacagctgtgcccctccccaaccagcaaagaacccaactgtcaggtttcagctgcagcacaactgccgcgagtcggccacactctgtgaggctttaatgtctgccttactctctgggacccaccatgcctgtgtccatctctgggactctgtatactccttgttgtttacatttcctgctatgaggctgctggaaagcaaaacctgggttttattcatctttgttcctttcctaactggcgaaaggaagtgctcaatgctgattaaatgatgaaaaacaaattatcacgtcaaccccagaagctcttttatactaaaaatgtgcacagttgtgtgtgtgtgtgtctttctcccctactacatgggcccctctgaggctgtgtttaggtcctgcttgccgcgtttgctgttagtgtctaatgcagactaagcaggcagcactgccgcctgacctgaagcgacagagatgagatgctcacaagccaccacctggctgagggaaaatgactgtgaaaggaactgtgaaggaagaaaagcaacagaagttgctcagctcaatattctaggttctgtaaacggcaagagagtgctcttcacagaagggcaggcctcacaggccatccaggtctgttatgactaccccacgccgctgctgtagaggaaaggcagcgggctgaccaaggtctagttaacctgaccttgtacagacactgggagtgtgtcctggagcctcacggagggagagggacggactcttgagaaacagagacaattgctccactgtgagcacctcacagaggagccaggaaggaagttctgtggggactgcaggtgtgaaaatggttggatcctggggcccagctttctgtcagtgagtgattgtgcaaatcactgtggctaacacctcctccactagagagccacatgtgtatggggcaacagaagacatgaaccagctcagcccctgctgataacaggcttctttctcagtcactccgcaaggcttatggctagcagtccactgcacgtcctgttcgcgtgactccacaacacttcccttgggtttgagagatcgtcttttggggtgcgtctggtgttaacagcaggctaagtgagggcttaacagtgccagcagccctgcctcccccaagttggtaggtttagaaaacttggagtctttaagactttgcctttcctcctcctcttgaatttgccgcttctcaccacttcatttctagtccaaggctacggcccctttggtatggaagaccaggcatttgttcttagctgatctcctacccagtattccctcatttcaacccctcctgctttgatgtcagacttttgaaaacaccattttccggcccccaaactactagtgtctattccctaccaattcctcgttctgttgccctgcctggctttcagggctatctgcttggaggctgagttggtcatgtcagtcctcagctcatgtctacttggttctttgttcttactgacggggaatggacgcctctaactgcaacacggttctgtccaaagcatctccccagcaactgcttctaccttggctcacaattctttttttttttttttttttttgagacggagtcttgctctgtcgcccaggctggagtgcagtggcgcaatctcggcttgctgcaagctccgcctcccgggttcacgccattctcctgcctcagcctcccgagtagctgggactacaggcgcctgccactgtgcccagctaattttttgtatttttagtagagacggggtttcaccgtggtctcgatctcctgacctcgtgatccacctgcctcggcctcccaaagtgctgggattacaggtgtgagccaccgcacctggcccacaattctttattcactgcttctttctatagagttctaaacacaagtccagttctctctcctcttgtcacatactctctaaaatcaagatttgcattcttttcctgtatacttttcttttctgacacagggttcacccaggatggagtgcagtgatacaatcatagctcattgcagccttggactctgagattcaagcgatcctctcccctcagcctctcaaagtgctgggattataggcatgagccattgtgttgggcctgctcaatttttaaaatctaccaatattgtcacattgttcaccttcccttatgatctaagcacatgtagcttctgtgcaggcccatgtaaatccccctgactggccagcccagcctccatctcctggatgaagtttctccagctctccagcctacactgctagtctgaactggtaacagggtctgggccccttgcatgtgacatcaactgtagaaccaggtcccagctaggagtttctgaaggggcaggcacagaggactctaatactaaatttatttaactggtggctctgctttccatgggagggagtcctgaggcgaaccctttccagagagatgctcatgtaactgtgaaactgctctggacaggcagcaaggaaaggatgagaacccaaagatgaacaatctggaatatgaaaaagttgtttccaaataatcacattcactacccttgagagtaaaggaggtacttggagtttctaataaacgagagagagattcctaggagaatatatgtaactttctaaataatttttaattctaaatttaaaaaaataccttccaataaggagcttggaaaagaatacaaaataatggaccttgaggaacataatattctagaaacaaaaggcagcgcctcccttgctagagctcactgtattaaactccaggtacctgacaaatttaagatctgtatcctggctggaatctagcagtctcttcaaaaattagttctttgagcttttccttaggcaagtcatccaattccatgtcgaacttgaatggtgcttcggcgatgggctttaaaagaaaacaaaacatttaacagtcaaagttgttatgggtaaggcagtaatttactgattcataaaatgaccactgctcagattctgaatttacaacaggactgatgtctcataaaaacttaagagttgatggccgggcgcggtggctcacacctgtaatcccagcattttgggaggctgaggcaggcggatcacttgaggtcaggagttcgagaccagcctggcccaacatggtgaaaccccatctctaccaaaaatacaaaaaattagccgagtgtggtggtgcacgcctataatctcagctactcaggaggctgaggcaggagaatcgcttgaacccaggaggcagaggttgcagtgagctgagatcgtgccactgcactccagtctgggtgacagagagagactgagagttgtgcccacactcctcaagttctcataaacacttagcctgggagcaactgaatctgtttcaagtgtttttctgaacttaccacaaatcccagaataatttttaaatgttttaaggcagtgaatgtcgaaataagagaaatgtgctgctgttggggtggtggtacgtttatccaatcaacacccataatactaaaatacatgcatttcattaaataaatcatggtatctttgtatgaaaaaacatcttagagctgttaaaaattaagctgcaaggccaggcgcagtggctcacatctgtaatcccagcacgttgggaggccaaggtgggaggatcatgagaccagcctgaccaacatagtgaaactccatctctactaaaaatacacaaaaattagctaggcatggtggcaggcccccgtcgtcccagctactcgggaggctgaggaaggagaattgcttgaatccaggaggcggaggttgcagtgagccgagattgcgccacggcactctggccgaggcaacagagcaagattccatctcaaagaaaaataaaaaaaactggccaggcacggtggctcacacctgtaatcccagcactttgggagaccgaggcaggtggatcatgaggtcaagatattgagaccatcctggccaacacagtgaaactccgtctctactaaaaatacaaaaattagctgggtgtggtggtgcgtgcctgtagtcccagctactcgggaggctgaggcaggagaattgcttgaacctgggaggtggaggttgaagtgagccgagatcacaccacggtactccagcctggcctggtgacagagcaagactccatctcaaaaaagaaaacaaaattaagctgcaaggaagattaataggaaaatgcctatgttgtgtcaagagaatgaaaactattttatttttaaaatttagatacagaaatacaagactgagaaggaaatactccaaaatgttagtaactgtaacaagattataaagctacatatttgtagtatgaaaaaaatctctcctgtattttcttacaagtttgcttttctctttttttttctatacaaaacctcgctttgttgcccaggctggagtgcagtggtacgatcccggcttactgcaacctctgcctcctgggttcaagcgattctcctgcctcagcctccggagtacctgggattataggcgcctggcaccacacttggctaatttttgtatttttagtagagacagggtttcactatgttggccaggctggtctcgaactcctaacctcaggtgatccaccaaccttggcctcccaaagtgctgtgattacaagtgtgagccaccatacctggccccatttttttttttgagactgagtctcattctattgcctaggctggtgtgtactggcatgatcttggctcgctgcaacctctgcttcccggggtcaagcaattcttatgcctcagcctccagagtagctgggattacaaacatgtactaccacgcccagctatttttgtatttttagtagagacggggtttccccatgttggccaggctgggcttgaactcctgacctcaagtgatcctcctgcctcggcctcccaaagtgctgggattacaggcgtgagccactgcgcccagcccccattttaatttttaaccatactccagaaagctatttaagtaaaatataaactgtctatttagatcaaagaaccccatacacactcagtgacaaactgattattattttttagagaaagagttttgctctgtcaccgaagctggagtgcagtggtgtgatcacagctcactgaaacctcgatctcctgggctcaagagatctttccacctcagccttctgaatagctgggactacaggtgtgagccaccatgcctggccacattttgatttttaaatgcccgtgaactaatgcaatgttacagaactaagctgatgataataccagctgtcaatcagtgaatgcctagaatctcacctctcacccatgtaatcctcacatggggcctttagggggaggaagcacagaccccaaactctgcactaagctttggccatctgaaaggggagaaggactcatgtccagaagaataaatagctcagcccgaaggagggctatgcatctgggatcacaggaggtgtcctacacgcatcacccaccaccccagccagctgatttggactcggaagcttgggaaatctccagcccactaagcttgtaagagccccaaacctgtattctctcctattctgtgttactggctatgttgtaggtatttcacaagctgcctaacttgttgctggaggcagagagatggatgtggaagggaaagctgattctttcaaaaataggagggtaaagactattctctgtgcatatgagcctcaactacaacaatccaaacttttggttcatattgcatttttctttgttatcctccagagaataaagttaaaattgaaccccagagacaccagagagccaaggcactaggactgtcttggggagaacatgacatgcagcatcttctacctgaatgccctgcctgctctgaagagctgccatatccactctggcctcatcacttcttacaacaggctctcgtgtccttgtctctagggaatagcacacccgacatggagtcgccaagccacagtggaaactgtccaagttgacttccctccccactctgtgtgctgtccctgtcagcaggctgcccacctcctctccaccccggccatcctcagggccagcacttcacttcaggtgtctcttcctgtcacaccatgacaatggcctccagtctcagacccatgccctctgtgctccatactggtgcagctgtcccctttatacatgcgtttaccccgcccctacctgttgcaggtggcctggaggaagtcttctgagatagacagagttacggggggagggatttcaagctgtgccccacagcactcgtcctcaaggcaaaggtgggcttgttggaagaaccgggtatggcagcaggtatatctcaggaaaatctaagcaagatatggttggtccactgctggctgatctatgtccctgaagcagcagccaggaacatgagctcttacctcgtcactcgggtcgtaatactgctccagatatgggtgggccagagcctgttctacttcaatcctcttgtgtgggttgaatgtcaacattttgtccaataagtccagagctataaagagaaaggttttgcagtagtgagagcagaagtagtcacagaaatacttcaatttcctgtttaagtaacttacccacaaaacaactgagctaagcatgactacagagagagcagccagcacaaagggtgctgactatatctccaagcctcccgagactgtgaacatagggaccgaccatctgacaattgcagaccgcaaacaaaaacactggcactacttaatgaagcgtcttttctgacaatgatcatttcttttttttttttttttttttttttttgagacggagtctcgctctgtcgcccaggctggagtgcagtggtgcaatctcggctcactgcaagctccgcctcccgggttcatgccattctcctgcctcagcctcctgagtagctgggactacaggcgcccgccaccacacccggctaattttttgtatttttagtagagatggggtttcaccgtgttagccaggatggtctcgatttcctgacctcgtgatccgcctgcctcagcctcccaaagtgctgggattacaggcgtgagccatcgcgcccggccagcaatgatcatttcttattaggttatttgtaggtaaaggtcaacttcatccatctgcaaattagcacatactattaagccctcaaagtagaatgataaaatatcattatttcttcttaaaacattttaaaatttaattgtatgtcccttctcaccattcctaaaatgataaacaatcacgtaaaatttggtacaatttaatactcatgatcagtttaaggaatcacttctagccactactttcaaaaagtaagttttcactatttactaagaaaatgtttcctaacccttaagaacaatcagtagaccttccgaagggattgcttgggtgctggggggaggtgggaggcatcttgctgcctgaggtcactgaagggctgtgggtgtgtatttgtgctcagccccggccaattttgacctcccttgttgcaacccctgaccttaagacaacaggagatgataaacatggtaaaccacatgctggacataatgagaaattccgcatagaaaacatttaaaagttatgtatgtttctatctataatcttttcaatacatacaagtgcactttaggaaattacggaataatgatattttgttttatagcctagataacttttcagagtagagaatccagacaggttttgctgtgactgaaggagtgtctgcgcagtagaagaggtggtcatgcctgcagctgtgaccctgggtctgtgggcacacaaactggctaggtttaggaagtggccctctcaagggtcaggacaaagacgcatgatggtcaagaacccaggaatctctggttcaaatcctacttccaaggaacacttgtagatatgtgtgcaagacacacaacccttgccgaatcttaagattcctgtggttggctgggcacgggggctcacgcctgtaatcccagcactttgggaggccaaggcgggcggatcacaaggtcaggagatcgagaccatcctggctaaaacggtgaaaccccgtctctactaaaaatgcaaaaaaaattagccgggcatggtggtgggcgcctgtagtcccagctacttcggaggctgaggcaggagaatggcgtgaacccgagaggcggagcttgcagtgagccgagattgcgccactgcactccagcctgggcgacagagcgagactccgtctcaaaaaaaaaaaaaaaaaaaaaaaaagattcctgtggtctataatataggtaataaatcccactttgcttcctgctcccaaccagccctccccacatagaactcacagacattttctcaaggactttcttgaaactagattaagtcatttggcttttcacccaattagatactgtctgtgctaagaaaagtccagaaggcctggaccacaataagattctaacagtattacttctaaaccactgggggcagaagggtcctactcaaacttgttcgtattaagtagacaggcactccaagccaactggatgttttgcagcttaagcatttctaaaacagatccattagttccttaaagttaaataaattctaggcccttaaacctccaggcataaatttcaaagaagacagctttttaaaaaaagatttgctacttgaaaagtagctagatctccagccttctgttactgcaagtgctatttctacattattcatagctacagaaggagaaaaggagagaaccgggaagcagctggcaggtgcggatcccacagtcaagaatgtccggactccctcctcccacgccacatgggcattcattggtaacactcagatggtgtgaatcatggctgcctgtgtggatgcttacttggatacaggttttatttcccctaaaagactggaagtccctttgaggctagtattactcctgaccacaaatcctgactttccctagtgccttccagaatactacattttctctttctgtgttttttaaaacagagtttggattttgttctatggcccaggctggagtgcagtggcatgatcatagcttactgcagccttgaactcctgggctcaagcaatcctcctgcctcagcctctcgagtagctggtactacaggcacatgttaccacacccagctaatttttttaaattaatttttctgtagagatggggagtcactatgttgcccaggctggtcttgaactcctgggctcaagtgatcctcctgcctaagcctcccaaagtgctgagattacaggtgtgagccactgtgcctggcccttgtctttttttttttgaaacgggagtctcactctgttgcccaggctggagtgcagtggcgctgtctcggctcactgcaacctccacctcctgggttcaagcgattctcctgcctcagcctcccgagtagctgggattacaggtgcctgccaccacgccaggctaattttttgtatttttagtagagacgggggtttcaccatgttggccagcgtgttctcaaactcctggcctcgtgatccacccgccttggcctcccaaagtgctgggattacaggtgtgacccaccgcgcctggccagcctggcccttctctttaacttcaaatagtatgtaacaacctgattccaaccctttcttctaatccatcatccttttttccttcttgccctgtcctggacctggggaaagccattgactggctctccacagtgcctcttcatgtctatcttgcctgcctcgtgaaactctgaccctgaatcaatgctgcaacctgtcacttccatcctcaactcatgtttctgtgcggggccagagaaaagactgaactgtgcaaagtgtgccagtgcgacagtgcttctcaaactttctgatctcagaactctttatactcatcaaaactgagggacgatttaaaaaccagttaattctgctcatagctcaaatagttacataagtgcttttccctgagaaaaccactgcattcagtatgcagcagaaatgctatacgtgtttgtcacacagacatcgtgaagacatgtattaaggatggatttaatatggtgagtactttttactggcactggttttgagcagtgggggtgtggcagtgcagagctcagtaacctctctagttccactgccttgacctgcctgtggtgctggggactctgctcatcattgctcctgtgccacaagtgctgatggcaacatagagagcagtgtgagtaactctttaagaagattattaaaacagctttaaccttgtggacaccctgaaaggatcctggggatctcaggtgtttaaggagcacactatcagtaactaccgttctacaaaaactcaagattttcagcctcatcaaggccctcaacagcttctggaaagctttggtcagtcccctcctctactctcagatttcacccaacttgcacggcttgaatcatgaccttcttgctaactgaccctcattactctcagcatatcttcttgagggtgctacagagaaaactgaggcacccaagagtgatcttcgcggaattccctcctagccagattcacacacacccttactgacactgccaagaaagatatcctctctctactcaaagtcaattctccccaacttgtggcctggtccacaaccccttcccctcatgtggaccagtcgtttctgtctccactttccatttcaaatttctcacttccattcactgtttcaactcctcttgcatggtcaccaacaagcccctcattggaaaatcaacccacattttccaatctatatcttgctagacctctctgctgcatggacactgttgtgcatgcctactttctcaaaatgccatcttctgcttctgtgatatcacatggcactagtttcttttctttgtccctattccatcactggctgaaggtttgtgttctccaacttctcacaatctcactcttcttcttcttcttcttcttttttttttttttgagacagggtctcactttgttgcccaggatggaatccagtggcctgatctcagatcactgcaatctctacctcctgggttcaagcgatcctcctacttcagcctcccgagtagctgggattacaggtgtgtgtcaccacatcaggcttatttttgtatttttggcagagacggggttttgccatgatgctcaggctggtgtcgaactcctgggctcaagtgatccacctgcctcggcctcccaaagtgctgggattacaggcatgagtgaccgcacccggccacaatctcattcttctatcttttcaatctcttgcaagatttaaaagaccacaggttaaatacctcccaaagctatattgagctgagggtgaccaagctgtagatcaataaatccaagtttgtgtaggtaataaaatatatagcctatgattccatttacaatcaatgtatgtatctatatgtgtaataaagtctgcaaggttttcaaacattaggttatctgagaaatggagacagacttcttatagaaattgcgttttttaatttaaaaaaaaaaagtgggggccaggagtggtggctcacgcctgtaatcccagcactttgggaggctgaggcaggcagatcacgaggtcaggagatcaagaccatcctggctaacacggtgaaaccccgtctctactaaaaaatacaaaaaattagctgggcatagcggtgggtgcctgtagtcccagctactccagaagctgaggcaggagaatggcgtgaacctgggaggtagagcttgcagtgagccgagatctcgccactgcactccagcctgggcgacagagtgagattccatctcaaaaaaaaaaacaaaaaacaaaaaaaaaaaaaacggggggcggggggggtccgggtgtggtagtggcaggaggatcccttgagtccaggagttcaagacaggactgggaaacatagcgagaccccatctctacaaaatttatttaaattagccaggcacggtgcttgcccgagcccaggagttcgaggctgcagtgagctgtgattgtgccactgcactccagccttccagcctgggcaacagagggagaaccctgtctcttcaggaaaaaaaaaagggggggggtgggggggagaaaatagaattccttatcttccctcactctcgggatcacctgctggttgtgcccaccagcatccactgcccctctaatccatccaacagtgtttgctataggggagcgctcaggcttgcccacgctcctgggctgtgctgtgggaatggtgacactcactgggccatattcacctgagtccccttggccacagtgactgctcagggataggcatggcatccaagctgagcacaaagaggtgatgagagtcagcctaagtcctggctgcagtgatcaggtcaagtgtcttactctcatcatgaaaagagaggctgactgacagacagcccagagcaaggcaaaactggatgataaagaagtccagattctagacacagtgtctgtgcccatcaatccacatgtgactgaacttttcagttatcagagccaataaagctctttcttgggccagtaagttcttgttatgtggaactgtggaactgaaaagacctcagacggttgacccaccaaacccggccttctggtctgtgtgaatgactcacccacattcccttgctccccaagcaccatcattcaatggtaaccactgcttatcttttcacatatgttgttgaattcttttctatgcattttcttgtagaaggctgaaatcatattatgtatgacaaatgctgttttattttcccttagtaaatactgttcattagcattttcccccactatcaaaactttgtaaaaaaaatcacttttagcggccttaaaatattcctttaagtagatgtctcataatttactcagccatttgattaacatttggcacttaggttgtttctaatgcctaacaggtgccttaaattaaacacagactaaaccaaattctcaactgctgtcacccaaactgctcctcctatagttttcctcatctcagtatttcctgtagactgtgtgttcttgtcctttgctcatttatttatacactgtggtcttagatttgtctctgctctttagatactaataatattaataatgaatctaaagttaacaataattccttaactcttttaattatcctatgaggtgggaactacaattgtctcaatttagggttgaggaaatcatgaaacagcttaaataacttgtccaaagtcaaaaatccaagtagcagaaccctagtttgaactcaggaggcggactccagagcaccgggtataaccactgtactttgctgccttctacagaacagttaggagaaggtccagtgttactcaatttagaacattttagacctattgtccacacctaatctaattttatttagcttttaaacttttatatgtctctctttccttgatgtttgttttaaaacataggaagtctttctccatgcagagatcagaaaaatactgaatactctattgttagtttctcatgatataaattttaaataagtatcaattcttttagaattcattttgatgtgtaatgatttaaattgattttcctccaaatagctattcaactagcccagtaccatctgctgaataataatttcttctccctcactgaagtcatttgagagaatcgtaagctaagactcctttaaagaaaaatctacaatagtgtcggtttaagggatacagcaatcaaaaatttccaacaaacatgaaaaaatttcaatctcactcttaattacagaaaaacaaattaaatgccactcccccatttggttggcagacctaaaagttcaatacccagaattgctggaacaaaagacatgtgacagaattgccagactgtcctctacagagactcaaccagtttacactccaccagctctctccgaaaacacccttttccccacagccttgaccacacagtagggtgtcaaactttgatgtctgctactctgttgaggagggcgttaaaaaaaaaaaagaattactgacttttcaatgtttgtatcttgtataatgagtaaacatgagtaccttttatatatttaagagctgtttcatcttccttttctgtgaactctcattaaaaattctagcttgtaagttttttaatctcttgagttccctgaggtcttccattcatttcctgacaaatctagactatcagttctgtaagaaagctctctctctcttttttttttaatgagtcctcagacttcccatctccaaacaggttcttaatccctcttattgctggtactatgtatgtccagggccttagaagccttgatggcaccaaacagacactcaaatctatccactgaatgaatgaatttatgtatgttttcttaaaaatataaaaacaactggctagatgtggtggctcatgcctgtaatcccagcacttttggaggccaaggcgggtggatcccgaggtcacgggatcaagaccatcctggccaacatggccaatatcttggctaaaaatacaaaaaattagccaggtgtggcggtgcgcgcctgtagccccagctactagggaggctgaggcaggagaattgcttgaacctgggaggcagaggctgcagtgagccgagattgcaccactgcattccagcctgggtgacagagtgagactccctctcaaaaaaaaaaaaagaaaaaaaagaaaagaaaaataacagtgctgggtgcggtgctcacgcctgtaatcccagcaccttgggaggccaaggtgggcagatcacgaggtcaagagttcgagaccagcctggccaacatggtgaaaccccgtctctattaagaatacaaaaattagctgggcatggtgacatgtgcctataatcccagctactcgggaggctgaagcaggagaattgcttgaacctgggaagcagaggttgcagtgagccgagatcgcgccactgcactccagcctgtgtgacagagtaagactctgtctcgaaaataaataaataaataaatacatacatacataaaaagcaaaaattagccaggtgtggtggcacgcacctgtaatcccagctattcaggaggctgaggtgggagaatcgcttgaacctgggaggcagaggttgcagtgagccaacatcgtgccactgcactccagcctgggagacagagcaagacgctgtctcaaaaaaaaaaaaaaaaattagccacgcatggcggcacatacttgtggtctcagctattcaagagactgaggcggaggattgcttgagcccaggtggcggaggttgcagtgagccaagactgtgccaccgcactccagcctgagtggcagagtaagaccttgtctcaaaacaacaacaaaaaaacatggtagaactgttgaagtgatgttctgagatttggttccaagagaccttgcagcataggctcttgctcttttggaatatttctgccatcatgagaagccactgagtctagtctactttaggataaagaggcaactgtaggaaggaccaactgttaagacgttaaaccaccacaattgagggatggtgaagggagccagcagatgactgcagtgcatggctgaacccaggtgggctcagcagaactacccagctgtgccagcccaatggactcatgaacaaatgcatggctgttatttcaagcctgagttttggagtgtttttttaatgcagcaataggtaactgatgtaaactttaatgtccaatgtgagtctggctgaaggacacttatgggtcacatccctacaagggaacaccatgtagtcactctttaacaactagaggccgggtgcagtggctcacacctgtaatcccagcactttgggaggccaaggcaggtggatcaactgaggtcaggagttcgtgaccagcttgaccaacatgatgaaaccccgtctctactaaaaataaaaaaaaattaggccgggctcagtggcttacgcctgtaatcctagcactttgggaggccgaggcgggcagatcaggaggtcaggagatcgagaccatcctggctaacatggtgaaaccccgtctctacttttagattgtgtttttgtttggttttgttttgagatggagtcttgctctgtcacccaggctggagtgcagtggcatgatcatagctcactgcaacctcaaactcccgggctcaagcagtcctcccacttcagcctcctaagtagctgggactataggcatgcaccaccacatctggctaatttttgtattttttgtagagatgggttctcactatggtgcccaggctggtcttgaactcctaggctcaagcagtcctcccgcctcagcctcccaaagtgctcggattataggcatgcgccactgcacccagtcagttttcttttatagacgattgtcgatagtacctgcgtcacaggattgtgtgaatgttcataccactggcatttgtaggtctaacatctttccatatcttgctctgttgcccaggctggagtgcaatggtgcaatctcgcctcacggcaacctccacctcccgggttcaagcgattctcccacttcagcctcctgcgtagctgggattacaggcacctgccaccacacccagctaattttttaaaatttttatttatttatttatttagagacggagtctcgctctgtcggccaggctggagtgcagtgacaccatctcggcttactgcaagctctccctcccgggttcatgccattctcctgcctcagcctcctgagtagctgggactacaggctcccaccaccacgcccgtctaattattttgtatttttagtagagacggggtttcaccatggtctcgatctcctgacctcatgatctgcccgcctcggcctctgaaagtgctgggattataggcgtgagccaccatgcccagcctgtaattccaacattttgggaggccaaggagggtagattgcttgagcccaggaattcaagaccagtctggcaatgtgatgcaatactgtctctaagaaaaatacaaaaaattagctgggcgtggtgacatgcgcctgtggtcccagctactcaggaggctgaggtgggcagatcgcttgagcccagggaggtcgaggctgaagtgagtcgtgatcacgccattgtactccagcctgggcaacagagtaagaccccatctcaaaagaaacaaagtaaggccaggtgcggtggctcatgcctgttaatcccagcactttgggaggccgaggaggcagatcacctgaggtcaggagattgagaacggcctggccactgtgacgaaaccccatccctactaaaaatacaaaaaattagccaggcatggtggcatatgcctataatcccagctacttgggaggttgaggcaggagaatcgcttgaacctgggaggtggaggttgcagtgagacaagatcgcaccactgcactccagcttgggcaacaagagtgaaattctgtctcaaaaaaaagtaaaataaaaacaaaaaacaaaatgaaggccgggcactgtggctcacgcctgtaatccgagcacttcgagaggctgaggcaggtgcatcacctgagatcaggagtttgagaccagcctgaccaacatggtaaaaccccatctctattaaaaatacaaaattagctgggcgtggtggcgcatgcctgtaatcccagctacttgggaggctgaggcaggagaatcacttgaactcgggaggcagaggttgcagtgagcccagatcacgccattgcactccagcctgctgggcgatagaagtgaaacttgaaagaaagaaaggaagaaagaaaggaggagaagggaggggagaaaaaagaaaatgaaaataagcagccaggcacagtggctcaggctgagacgggtggatcatgaggtcaggagttcaagaccagcctggccaagatggtgaaaccctgcctctactaaaaatacaaaaattagccaggcgtggtggcgggcgcctgtaatcccagctactcgggaggctgaggcagaaaattgcttgaacctgggaggcagaggttgcagtgagccaagttcacaccactgcactctagcctgggcgccagccagagtgagacgccgtctcagaaaaaaaagaaagaaaaaaaaatgaaaatgaaaataagcataaaaaaagaatcagaaatagtttgatgcaactcatgattacagacaagagtaaggaaacaaacaggagaggaacgtttgggagtaggcctatttattacagttttgttgtttttttttttttttaagagataagagtgtcaccgtcagcgtggagtgcaatgatgcaatcacagctaacagcagctttgacctccttgggctcatgcaatcctccctcctcagttccccaggtagttcagactacaggcaggtactactacactcggctgaattttaagtttttaatcttgtagagatggggtcttactatgttgtccaggcaggtctcaaattcctggcctcaagcgatcctcctgcgttgacctcccaatgggctaggatcacaggcatgagccacattaccaggcctaatgatgcagctttgttgcttatgcagctctttaaaaaagtgactcaggaaataacatttagtaacatttagataacatgcttaggtggtataatatacaagcaaatctaatcagtaacatgtattatgcatgtgacattctagctaaaaatatcctaccatcaaaatacattacaggccgggtgtggttgctcacacctgtaatcctaactcttcagaagcccagggtgagcagatagcttgagctcaagactttgggatcatcctgggcaacacggcgaaaccctgtctctacaaagaatacaaaaattagctgggcatggtggcacaggtagtcccagctactcagatggctgaggtgggactacctacctgtagtcccagctactcaggtggctgaggtgggaggatggcttgagcctgggaggtggaggccgcagtgagcccagattgtgccactgtgctccagcctgggtgatagagccaaacccgtctccaaaaaaaaaaaaaaaacccaacccccaaaaaccggtcaggcacggtggctcacgcctgtaatcccaacactttgggaggccaaggtgggcagatcacaaggtcaggagatcgagaccatcctggctatcatggtgaaaccccgtctctactaaaaatacaaaaaattagccaggggtggtggcgagcgcctgtagtcccagctacttgggaggctgaggcaggagaacagtgtgaacccgggaggcggagcttgcagtgagccgagatcacgccactgtactccagcctgggcgacagagcgagactctgtctcaaaaaaaaaaaccacaaaaaacaaaaaaaacaaaaaaaaaccacaaaacaccccaaaaccaaaatacattatataattacaaccacacagaagcttgcacacattagtgcaaaaaaagtgaaaggttactgtgggatcctggtgatcaatatcttactcccttaccattcctcccatacttcttaactgtctacaatgatgaaattcttctacctttatatgaaagattaaaagaaaatttctcccattttcaaaagaaattcatttctaaacaaccaagtatttctcaaccttcactcaggtcaatacataaaaccaattcaacatttaagtagacagttgttaaatatacatatacacatatattcatatgcatgtatagataaacacatacagataaaataggaagttagaaatagctaaatttctaacagaacactggataaaaatgctataaaatcattaacgataacctagatctatgcactgatgtggaaaagatattcaagacacaattctattaaccatgacatttagggaataattataaaagaattttaccttcttaaatatttctataatttctgaatttttaaaaaagttaacctttataataattatttttaaaaaataaattatagagaaaatatgcacatgtatgtagataaagatatggaaggacaagcaccctattcagattccctcctcaacttttaaggaaccctgtttttataaatgggcccacctagataatccacctacctagacaagacaatccaggataaccttcctatctttaaagtcagctgatgggcctattcggggcataccacactgcccgtggattagccctgctctgtaaggagcagttaaaaaaaaaataaggtcagctgataaacaatcttgattgtatctgcaaccataattcctgtttgccaggtaacctaacatagttataggctctagaaattagaatacagccatgggggtgggtggggggtcattagtcggcctatcatggttttataacagcatgaagttttaaaaactagctgcctaatatatttaacaggtacacgttaaatgggaataaagaataatacaattattaaacgaagctaacctaaaaaaaaaaaaggataaaaaaatcaaatgtatcacttttttttttcatgggtactctaaaaaatctttgcttaacataaggtcatgaagattctctcctgttttcttcttgaaggttaataactttaggccttatatttaggtttatgctccattttgagttttgtaaattttgcatatgggtgtctaattgttccagcaccatttgctgaagagactgacacaaacaatgacatggatttttataaatctcaaatgcattatgctgaatgggagaatctagacataaaaaggctacatactacatgattccattaacatgacatgccggaaaaggcaaaactatagggatataaatcagatcaatgattgccagagcttggggttgcagagggatgactgactacaaacggcacaaggcaacttttggggatgatgggaatattccacatctcaattgcggtggttgttacatgacagtttatgtttgttaaaactcagaggcccacacaactaaaaagtgtgaattttattctgtgtaaattattcttcaataaacctgattttaaaaattatcaagtgacaagatgaaaaggtgtaatttgtttgcagggtcctagacttcctgagacctaaaaatgtgaccttaggctgaacgctgtggctcacgcctgtaatcccagttttgggaggccaaggtgggcagatcaaaaggtcaggagttcgagaccagcctggccagcatggtgaaaccctgtctctactaaaaatacaaaaatgagccaggcgtggtggtacgcgtctgtagtcccagttacttgggaggctgaggcagaagaatcgcttgaacccgggaggaggaggttgcagtgagccgagatcgggccactacactccagcctgggcgacagagtgagacactgtctcaaacaaaaacaaaaaaaaagtgaccttaatgcaaattaaaattagcaaagaaaccaaaaggtggagaactagaccgtcattaccaggttcccttactgcactgccactgtttccaaaaaaaaaaagggggaagacaacaattcagagtgagcactaaagaaagcattatccaatagccataggctcatttttcaggctagtgacctaacaatttaacaaataaacgcgaagctaagcctaagaaaaaactaatcaacgaaataacatttacctttggagtcagcatttgggaacagcctgttccatggcaccttatttttgtgtggaagagaaagcaaatagttcctagcttttaaatttattatacaattcaggtcttcttgtgatggggatccaagaatacctatcagataaaaaaattagctattagttatcaggaccaaggtaaatgactacacaccatcaactctgagtcggaatgaaccctgataattgatatgagccgttgcttatcaccactcctgatgtttacctttcttatgtttttacacaaaagtccttaacattttaaatcagagaaggttaaaaattcacacctaccacaggttaaagagtatattagaactcttcttaatttaatgaagtgactttgatgtaagctgtacaaacttgagtaaatctagctcctgaagggctcgggaaccttacccaaaatgtggttcagctggtcaagataatgcttccctggaaagatgggcctgttagaaagcatttctgccagaatgcagcctacagaccaaatatcaatggacttggtgtagccctgcaggagaaagagagaaaagactgaaaatggtatctggtgttacaggacatgatgagatcttcctgtatgacaggtgcattgctgatgggactctgaacttctcctttgactctacaattcagaaatacaagtaaacaacatggaaaagcaaaaaacaatttggctttcttatgagaggctgaacaaccaagattatgtgattttatttttctcttcatagttgattaacttgggctgggcacagtggctaatgcctgtaatcccagcactttgggaggccgaggcgggcggatcacttgaggccaggagtttgagactagcctggccaacatggtgaaaccccatctctactaaaaatacaaaaaaattagccgggcatggtagtgggtgcccgtaatcccagctacgtgggaggctgaggcaggagaattgcttgaacccaggaggcagaggttgcagtgagccaagatcgtgccactgcactccagcctgggtgacagagcgagactctgtctcaaaacaacaacaaacccacaaagttgattaacttattaaattagaatttccaaagtatacatccgtccttttttgaaacaatttgagagacagatttagaattgtcataaattggagctggaaaaagaaaaaaggtctaaaaaccttttctgggtttgggggagtgtgtgctagctccatcatattttaccaatctcttctaaaatattctcagctgggcatggtggctcacgtctgtaatcccagcactttgggatgccgagacgggcgaatcacctgatgtcagaagttcaagatcagcctggccaacatagtgaaaccctgtctctactaaaactacaaaaattagccgggcgtggtggtgggcacccatagttccagctacttgggaggcagaggcaggagaattgcttgaacctaggaggcagaggttgcagtgagccgagattgcaccactgcactccagcctgggcaacacagggagactccatctccaaaaataacataacataacatataacataacataacataacataacataacataacataacataacataaacataacataaaacataacataacatataacataacataacaaataaaataaaataaaagaattctcatcttcttttcctattcatttttcaggaatatgttttcttttaaaggaatcctgttagaagtcatgggaggatactttgggaggctgaggtgggagtactgcttgaggccaggagtttgaggctgcagtgaactatgactgcagttgcactgttacactcctaatagcagcatgtgaaagaaaatgcatttcctcatgtcctcaacaacactgggtattaactaattattattattattatcattattattattattttgccacacatggtggctcacacctgcagtcccagctactcgggaggctgaggtgggaggatcacttaagcccagggattggaggctgcagtgagctgtgaccgagccaatgcattccagcctgggtgacagagtgagaccctttctctaaaaattaaaaaaaaaaaaaaaaaatcatggaaggattctgtctgaatcataacaatggtgcaaaaaagatgtttctccaaggaatataagctgactcttttaaaattaagagatggtgtcatcactctgtcactcaggctgaagtgcaatggtgtaatcatgcctcactgcaaattcaacttccttgtctcaggtgatcctctcacctcagccaggtcctgagtagctggcactactgagtagctggcacacagtaggtgggccacaggcatacaccaccacacctggttgatttttaaattttttgtagagaaggggtcccactatttgcccaggctggtttcaaactcctgggctcaaatgatcctcctgcctcagcctcccaaagagctgggattacggcatgaggcaccatacctggctccagaagtgccttctaatacaatgaagtgcttttctggtattcatgttaaaaatgcatgacccaaaactgaggggcattctacaaaatagctcatctgcactcttaaaggagactaaagaaacacaacaacctgtctctatgaaaagcacaaaaataaataagtaaatcagccatgagcagtagcacgtgcctgtagtctcagatacttgggaggctaaggtgggaggatggccttgagcccaggaggcggaggttgcagtgagccgagatggtgccacggtaccccagcctgggtgacagaatgagaacccgtcctttttttttgagacggagtcttgctttgtcacccaggctggagtgcaatggcacgatctcagctcatgcaacctccacctcctgggttcaagcgattctcctgcctcagcctcctgagtagctgggatcacaggtgcctgccactatgtccagctaaattttttgtatttttagcagagacagggttttgccatgttggccaggctgatctcgaactcctgaccccatgtgattcacccaccttggcctcccagagtgctgggattacaggtgtgagccactgtggctggcctgcgaacctggtcttaaaacaagcaagcaaacaagcaaacaaacaaaactcatgacagtacaacatgtgaacctgtgcccaggtcggggggtggtttgggtggggtatagttcaaaggttattgggataatatctaaaatgtgaatataaactgtgcattagatactgaatcagtattaagtttcttgattttgaaaactgtactgtggtcatgttagagaatactcttaaggcagggtttttcaacctcggtatgactaacattttgggctgagaaagtttctgtttggagggctgttctgtatatcgtaggatttttagcagcatctctggcctcttgatgcagggagtacccctacccctcactgtgacaaccctgccacatgtccccagggaacaacaggaccatggtttgaagtaaagacatactgaaacaaggtgaaggggtgtatctacaatttactctcaaatgactcagagtgcgtgggagtgcccacacacatgcacacaaagaatgataaagcaaatggggcaaaagataaaaaatcggtgagcctgaatctggggtaaagggtatttaggagttctatctggcggttctacaagagtgttccagagactcctatgggttccctctagaggatctgagaggtcacagtacatttattatactactatgacattttcatccttttcagtcacgagtgaaaagaagatttttccagatgcaatatgatgagtgatgatgtgtacatgaaaatgtgacacttggaatatctgtgtaactcagtgaaccagtattttccaaatacgctaaaaaatcatgcatgagtatgagtgcaaggtagactaatggattttaacgaaatagtatcaagaattcactgatatgatttcagattccacactgcaattaacctttaagaaaccaccacttgtttaaactgggggtaggatcaaagaatagccacaagtggctgaaaagactactaaaatttccctcctttttccagctacatacctgtgtgaagagttttcctctggccataccaccctgaacacgcccgatcttgtctgatctcggaagctaagcagggttggcctggttagtgcttggatgggaggaatagatcttgaatttcataaatagcactcagacatctatttttaggcttatttgtaaatgtcttgataaaatgtctgattactgttacatactagggaaaaatctcacttttttgtgtgttatgcttttaagcatagattttgtttgctaaaatgttatttagaattttgcatgtatttttcactggcttgcgatttttctttttatataacatcttttttaaagggtctttattaatattgcactcaagttttcttctgttttctatgctctgaattcaagcagttaaaatccatgggaaagagttttccttgacatttttgaagaactatgcatgtaatattatattgattattaaattgattaaagcctgaaaaaaaaaaaaaaaagagttttcctcatgaacttaaaccaaaacaacatatttgacagactgaatgcagaaccagatgagaatccaactgtcttctattaagccagacattaaagagacttgcaaaaatgaaaacaatgccactcttctcactaaaaggttgtttttcgttttgctttttttaaagacagggtctcaccctgttgcccaggctggagtgcagtggcgtgatcacggtacaccgcagcctcaatttcctgggctcaagaaaatctcccatctcagcctcttgagtggctggaactataggtgcacaccaccatgcccagctgattttaaaattttttgtacagatggcagggcacagcagctcacacctgtaatcccagcactttggaaggccgaggcaggtggaccacaaggtcaggaggttgagcccatcctggctaacatggttaaaaccctgtctctactaaaaatacaaaaaaattagccaggcgtggtggcggacgcctgtagtcccagctactcgggaggctgaggcaggagaatggcgtgaacctgggaggcggaccttgcagtgagctgagatcacaccactgcactccagcctgggtgacagagcacgactccgtctcaaaaaataaataaataaataaataaatttcttttttgtacagagtctcactatgtcaccagggctggttccaaactcctggtgatcctcctgcattggccttccaaagtgttgggattataggtgagagccatcatgcctggcctcactaaaacgtttttattgtagaaaataaacttattcttaagaaaaacatgtaatttatcttaacatgtagtgggtttactatttaaaaattaattaatacattttaaagtttcatattgtaggccgggtgtggtggctcatgcctgtaaccccagcactttgggaagccgaggcgggtggatcacctgaagtcagaagttcaagagcagcctggccaacatggtgaaaccccatctgtactaaaaaatacaaaaattagccgggcatggtggtacacacttgtagtctcagctacacgggaggcgaggccggagaatcatttgaacccgggaggcagaggtcgcagtgagccaagattgagccattgcactcaagcctgggggacaagcgccagacttctctccaaaaattaaaaaaaaaaaagtttcatattgtaaataacaatagatataacctacgtaactaaaaaaaggtgtgtgggtccttgactttttttttttttttgagacagagtctcactctgtcacccaggctggagtactgtggcaagatctcggctcactgcaacctccacctcccaggttcaagcgattctcctgcctcagcctccaagtagctgggattacaggtgtgtgccaccatgcccagtgcattttttgtatttttagtagagacagggtttctccatgttggccaggctggtctcgaactcctgggctcaactgatccacccgcctcggcctcccaaagtgctaggattataagtgtgagccaccatgcccagctggtccttgataatttttaacaaatgtaaagggatcttggctgggcgcagtgggtcatgcctgcaatcctagcaatttgggaggctgaggtgggtggatcagttgagcccaggagtttgagaccagcctggccaacatggcaaaaccctgtccctacaaaaacatacaaaaattagccgggcatggtggtacacgcttgtagtcccagctacacaggaggcaaggctggaggatcgcttgaggagggggtggctaccagcctgggtgacagagagaaaccccgtctcaaaaaaaaaaaaaaaaaaaaaaagccaggcacggtggctcatgcctgtaatcccagcactttgggaggctgaggtgggtggatcatctgaggtcaggagtttgagaccagccaatgtggtgaaaccccatctctattaaaaatacaaaaattaggcaggcgtggtggcaggtgcctgtaatcccagctacttgggaggctaaggcagggagaactgcttgaacctaggaggccgaggttgcagtgagccgagatggtgccgttgcactccatctgggtgacagagcaagactgtctcaaaaaaaaaagaggctgggcgcagtggctcacacctgtaatcccagcactttgggaggctgaggggggtggatcacttgaggtcaggagtttgagaccagcctgaccaacatggtgaaaccccgtctctactaaaaatacaaaaattagctgggcttggtggcatgcatctgtaatcccagctacttgggagactgaggcatgagaatcgcttgaacctgggaagcagaggttgcagtgagccgagatcataccactgcactccagcctgggtgacagagtgagactcggtctcaaaaaaaaaaaaacagaaagaacaaaagaaagaatgaaccaatgaaagaaagaaatgtaaaggtatcctgagacaagaaggtttgagaatggctaccttatacttttcttgcaacttttatgtttttagacagagtctcactctgccacccaggctggagtatagtggtgtgaccttgcctcactgcaacctctgcctcccgggttcaaacgattctcatgcctcagcctcctgagtagctgagattacaggtgtccaccatcatgcctggctaattttttgtatttttagtagagatggggtttcacaaagttggctaggctggtatcgaactcctggcgagtaatccacccaccgcggcctcccaaagtgctgggattacaagtgtgagccaccacacccagcaacttttctttaaaaaattttttttctttcctaaacaagctaaaacagcgcaagttttctgaaagctgaaattctataaaacgttacaaatatgtacacagagtgctctagcttctcaaaactgggacaatatgagtttaaaaaaaaaaaagaaagaaaattaaaatggagaacacataaaaaaaaaatcctgggtctgcaatagtgttttaaaaacaaaggtaggatacagaggaagagaaagggtaaatgggaaaaatcttcataggagaattctagctaatacaagtaaaagaaagaacaaatttagaaaattaccattttataacctccagtatgataactgacagaagtgagtgctgaaccactgggggaaggctgctgggaaacaaggatggccatcctggctaacatggtaaaaccctgtctctactaaaaatacaaaaaaattagccgggcgtggtggcgggcacctgtagtcccagctacttctgcaccgtcttcaggaatctgtagtggtcgtgttagaaacgtgcaagctacatctcatcagaaagaactcactggaggaatccacaatgtgaaccactctgtgaaacaactgatctgtacattgcaaagtactgaatgtcttaaagaagagaggaagggcaagactgttctagactaagaataatgcatgaaacaattaaatcatgtgttgaaaacagagttacctagacttttttgggaggatgggatgtcatggaattaatgctgatcattttatgaaagggtaagggtactctagctgtgggaagaacaccttccttgtaaggagcattagtatgccccaaagggtctaggagtgaagtgttatatgttggtgaagtgtcacatggtctgacaaaagagaagagacagaagaagaaagagagagagaaaggaaagagtaagagagggaaggagggataagaaatatgacaaggtgttaatagctggagaaccaaggacaggggcatatgggtattcactctactctcaatttttctatgggtttgataattttctacattaataaaaataaacaaaatgaagacaactgctagaagtaacattctcaggctacaggtatcgcaaataagaaaaaaatgaacactcaattttcactttggtgaccctgcaagtagaaggaaaagctggtcatcttgaagaacaccctctctggctacttctccctggagggtaatagagaagtggagacagtggcggcgtctaagtcagaacggagactgcaagaccaagccacaccaggacaaaggcacaccaacagctccctttacaactggcactgaacactggcatgccaatgctccttgtttagaatggctgtcacgtggccagtcagagaaagaacctgttgtgtgggattatttgtgatatagaattacagagaatcaacatggcattttcttctctgaaacatctgttacaccaaatccttctttataatggaatttatgttaatgagattttacttttataactaaactgaacaaatgtaggatatcaagaaaaactaaatgctttaaacaaattccatttccttatgaaaaaatctaatagcttatctgtactagtaataaaggatggaggaagaaaaagaagactataagctaattagacctgttctttcatttccactaagcctctcaggactatttctggttcctgggccctagatacaagatccaatgtctatttttattgcttttcttcaagtatctttacatgacagcagagggaactgtgtttaagaatcttataatcctgagatactagatacaggtagtatgtcaggcctacttaactactcaattttcacaccttattcatatattatttgcaaataacagaaaaatactgaatctcaatctccatagcagccctcaatttttgcctcctggctcataaacccaacaaaaaatgtcagacttcacttttctgggcttttgtaaacttattcaaccatttcttatgaccaagacacagaccttgctagtagagtgtggatgagacctggatgcactctctatagccactcacagatgcagaggaaagcacttcatttggaagcaggaaatcacgtaatttcaaaagaatccacggcagttcctactctgtccacatttatgttttcttcaagtacaacaaattacaatataattctgccgaagagacattcttcattatcagataaatttgacctttatagaatagccctggcccatgttcacagaaatacacattactgaataacctctacaacaaacccagcctgcacctaacagtgacagcgataggtaggacttcaggacagctgtccaaggagtgaaacacagaccacttatggtaacagtgactggagaggcacaccccctcctactctacaaccgtcagcactatatcagctgaggtagagaggctgagccctagggcccagaagttcaatgccgaacaaaatttagacagcaccttggggccaggtgtggtggctcatccctgtaatcccagcactttgcggggggcgtggggggtgctgaggtgggtggatcccttaagctcaggagttcaagaccagcctgggcaacatgcgacataggaagacgccctacttttacaaaaaaaatttaaaaattagccagatgtggccaggcacagtggctcacgcctgtaatcccagcactttgggaggctgaggtgggcggatcataaggtcaggagatagagaccatcccggctaacacggtgaaaccccgtctctactaaaaaatacaaaaaattagccgggcatggtggcgggagcctgtagtcccatctacttgggaggccgaggcaggagaatggtgtgaacccaggaggcggagcttgcagtgagctgagattgtgctactgcactctgcctgggcaacagagtgagactccatctcaaaaaaaaaaaaaaattagccaggtgtagcggtgcactctgtagtcccagcaactccggagactgaggtgaggagggtcacttgagcccaggaggttgagactggtaagccgtgatggtgccactgcactccagcctgggtgacagagtaacaccctgtctcaaaaaagacagcaccttgtctctggccagacaggcaaactctcaacgcagagggagacttacggcttactgcaatgcattcagaaagttctcttacttactggatttctttttatgcaaacttcatccttaccttggaattcaacataatttctggagccctgtaccaacgtgtggccacatattctgtcaggaaccctgtgtgatcatggtctggatctgcaacacgggccaggccaaagtcacagatctaagagagaaaaaaaacaggataacttcttagaaattctaacctttcatatcaaaacatcacaaaaataaaaaaggcaataggaataataatgctactaagtggcagatactttctgggcattctagaaaatcattatttaattttcccaacaacctgaaaagcaatcaacatgttagagaccaggatgcaggctgaagaagtctttacagagcacactttaagaagcatccctacctttcattatctgcttagcacaaagcaatctcaataggtgaattgacaaaaactgttctgagtagtcaccaaaaccaaccagtacccttttctcagcctgtcctgctggagctctcaggactgctgtgaagatctgcactggccttctattctcagactctactttctgctagtcttctacttagtctataaatataagtatttccaaagattcttcccacttccttcttctaggtagtcaaacctactcccaaagctttttttttttaaagtttcatatacttaagaatattttatttttaaaaaatacatagtttctcattttctccggtctcaagcatctactggcctttcatcatctggccctccaatatcatggtgtggcttattttctatttttagtagagatggggtttcaccacgttggccaggctggtctcgaactcctcacctcaggtgattcaaccacctcagcctcccaaagtgttgggattacaggtgtgagccaccatgcctggccatgatttttttttaaggtctgtcaacactataaaatcaaagactaaccaaatttacatgacactaatcaatacaatgccaaggctacaaaataaaaaagcagtagtactcagtataattccatacaaaggaaaataaataaggatatggtacaagaaaatataccttttgggctgtgtaaattcagattttcaaaaacaaaggatgccccaaagacgtgtttcatttgtatctatcagagtctttctttcataggcatagccagaattttcacatgttgtgatcccagcatcttgtgactcctactgggatttctgtgggatcagtctagtaaacaagggcacagactagtatagctcacgttccctggtagttacactagaaatgtgctagcagagcctccaaatagggtctgtaaccctggtgagttcctgtggtcctgaagaataaagtctacaagagaggatcccggaagggtcctaagatgtcaatgtctgctgggtcttaagcttcataaaataagtgcaaagcatgtttatggaaaccaaaaagcaagcttatttctgtcggccttgactgataacagagccaaaagttaaaggtctaagacactgataatagctgatatcgataagggttcaagatattttggtaagggttcaagagtaaaaaacactgtaacatagaagtcattggatgaaggttgaagaaatcttcttgaaaatctgaaaggacctaaataacaggaggtcagtgacgctgcaagttacaaacttcctaggccaaggggcctgtgggaataggcatcatggtcacatggcactgaggatgtgataaatgtgcagtgatcccagagctccagcaaacacaagtcctctcctcatgtggtgttctcaactgtcatatgcacactgaactgccactgcctcttgccctgctttgacacgctcactgtaacaaatcagtgacataccatactcatctttgaatgagattctctcttctcgcatttatacccatgagaatgatgcacacacattgctgtatacttttttttttctgagatggagtctcaccctgttgcccaggctggagtgcagtggtgccatctcagctcactgcaacctctgcctcccactgattctcgtgcctcagcctcccaagtagctgggattacaggtgtgcgccaccacacccagctaatttgtttgtattttcagtagagacagggtttcaccaagttggtcagactggacttgaactcctgacctcaggcgatccgcctgcctcagccactcaatgtgttgggattacaggcgtgagccatggcacctgactgctgtatacttttaaaatatcagtaaaggccgggtgtggtggcaaatgcctgtagaatcccagcactttgggaggtcaaggcgggcggatcacgagatcagaagttcgagaccagcctggccaatatggtgaaaccccgtatctactgaaaatacaaaaattagccaggcatggtggtgggcacctgtaatctcagctactcaggaagcttcagcaggagaattgcttgaacccaggaggtgaaggttgcagtgagctgagatcatgccactgtactcctgggcaacagagcaagactctatctcgaaaaagtataaaataaaaataaaaataaataaaataaaaataaaataaaataaaataaaatgttagtcaatttgttatgcttctgattctttgtgttaacttgggttttcaagacgatgcctaaattatgccacggccaacaactcgtgtgtgtgagtgtgagtaggtgaacagaatggccttaaagacaagtccataaactgggaagagacaacagagagagtagtctggttctatttgttttattcttaaagatgaacactttcaagcaaaaataagagccaattcttcccagaaatgttatatgcttaaaatattgattgagaatgtctctccaaaaacaaaagcaatctgccataacagggctatgatgataaccaaaagaaaaaaaaaacacgaggagacataaaaatattcactgcaaattttcaagacaatcattaagtgccaaagaagtagtacagccatcctaaacatagctttattcgttttgtgcccacctgactcttggttgcactgatccaggtaaaggagctggttccatcccatgtggaaaagacataaacctgtatcagaaggatcctaagaggggacagagtccaatccacacaatatctgatgaaggaagctgtcctttacatctcactggacattggccaccgtgttcacccaccgtgacaaaacccaccgctttttacacacagttctagaaggttccccacgatctacttgcaaccaacctttttagcttagtgtcgatgactccctattactcatccaatgctgcagccacagggaggaagactcagtgctttcggtagtagtcccttccttcttattttatttctgtactctctgcctatgataccctatgtccaatagagccactggcctcccgcaagaaaagctacccaacctcgagggccggcacagataccaccttcttcctgctgcctcccagtcccagccagcgctagcccacctctctcctttgcatttgtacaccatctttttctccatctcagttacagaacatctcattataatcacctactgtctaccagatttctgatctatcagttttcagatttcaagggcagaccctcatctctcttgtctggcgtatctcaaagggcttctcataggagtgtctgttgaactgaaatccaataaatgattattgctatacatatatatgtacttaagcagctttattaacctataattcacacaccatacaatttgctcatttaaagtgtataactcaatggttttagtattataatggtggaaattaaccattaccaccatccaatttgaaaatatttttataacctcaaaaagaaattccagtgagttagtattccttccttctttattctcccaactcctctagccctaggcaatcagtaatccactaattctaatttttgtctctatggatttgcctattctagacatttcacgtaaacagaatcatacaatatgtgtcttctgtggctgccttccttcacagacatgtttccaagattcatccatgttgtagcattatcagtacttcactcctttctcttctactgtgtggatccaccacactgtatttattcatcatcagctggacatttggattgtttctacttactggctatagtgaacaataccactatgaagatttgtgttcaagtttttgtatagatgcatgttttcattttcactaaggagtggaatcctcaccaacacttattatctgactttttaactacagccatcctagttagcatgaagttgtttcaatgtaattttgatttgcatttttctactgactaatgatgtcaagcatctatcattccatgtgcttattgccatctgtatatcttctttagagaaatgtctattcagatcctttgtccattttttaaactaggctatttatcttttcattattgagttataagagttcttcatatattctagttttaagtcccttatcagatgtatgatttgcaaataccttctctcattctgtggcttgccttttcacttttttgatggtttgctttgtagcacaagtttctaatcttgatggaatccacttacttttttcttttgttgcttgtgcttttggtgtcatgtctaagaagctttgcctaacataagattgcaaagatttacttctatgttttctaagagtattaaagttttagcttttaattgagttcttcaatccattttgaatttttttttccttttgagacaaggtctcactctgtcaccccagatggagtgcagtggtgcaatctctgctcactgcaatttccacctcccaggctcaagcagtcctcccactcagcctcctgagtagctgggaccacaggcacatgccaccacgcccagattaatttttttgtattttcggtagagatggggttttgccatgttgcccaggctggtcttgctccggagctcaggcaatccacaggccttggcctcccaaagtgctgggattacaggcgcgaaccactgcacccagccattttgagttaattttttcatctttttgtatgtggctattcagttgtcccagattcatttgctgaaaagactattctttccccagtgaatggtcctggcatccttgccaaaaatcagttgaccatagatacacgggtttatttactgactctcacttctattccactgacctatatgtctattcttatgccagtagcacactgtcttgattactgtgttttgcagtaagttttgaaatcaggaagtgtatcagttctccatatgaatttccatatgaattttgggatcagcctgtcaatttctacagaaaaaaacaactgggggctttgatagggattgcactaaatctgcaaatcaatttggagaatactgccatcttaacagtattaagtcttatgatccacagacatgggatgccttcccatttatttaggtcttcttgaattcctgtgcatttttttagactgaatcgacatcgctccgtcacatctaagatatccataaatttccctcgtttacctgtaacacccattaaaacagaaatatgtaaatgctgcatattttcagaactctgaggactgtaaagaatttggggttttcttatttagttggaatgccttattaggtattaaagtcagtgacgttaagttttctgctgctatcttttgaataaaatttattgaagaaaaatgtcaccaacaaaacatgattttaaaactaacacataaggccaggcgcggtggctcacgcctgtaataccagcactttgggaggccaaggtgggcggatcacaaggtcaggagattgagaccatcctggctaacacggtgaaaccccatctctacaaaaatacaaaaacaaagaaaaattagccaggcgtggtggcaggtgcctgtagtcccagctactcgggaggctgaggcaggagaatggcgggaacctgggaagcagagcttgcagtgagctgagatcgcgccactgcactccagcctgggtgacagagcgagactccatctcaaaaaacaaacaaacgaacaaaaaaactaacacataatgtacgtgatcctgtttatctatataaagtataaaaatacacatgtatgcaagagcatagaaaatactttgggagaaaatacactttgttttttaggacagagttttgctttgtcacccaggctggcgtgcagtggtgtgatctcggctcactgcaacctccgcctcccaggttcaagcggttctcctacctcagctcccatgtagctgggattacaggcgcatgccaccacgcccggctgatttttgtatttttagtagagatggggtttcgccatgttggccaggctggtcttgaactcctgacctcaggtgataaggcccaccttggcctcccaaggtgctaggattacaggcgtgagccaccgcaactggccaccaatttgttatagtagttagttatcacggcctggtgctgtggcccacatacataatcccagcactttgggaggccaagaaaggaggactgcttgagcccaggagttccagaccggcctgggcaacatactaagactctgtctttaagaaaaaaaaaaaaaaggtatctctggggagaaaggagcaatgggataaggaagaagaagaggactaccacactttattagcatttttgccataaacatgtttttgggtatttctggtgtaatttaaaatatgaataatgacaaatataactatgcttcagtgaaagggtttttcaatatatatcaccttaatagtaaataacctggctgaccttgagatcacaggtggtgttgagcagcaggttggaaggcttgaggtcacggtgcagaacgttagctgaatggatatattttaaccctctgaggatctggtagagaaaatagcagatatggtcattgctgaggtgttgtgtcttcaagagcttgtaaagatctgtttccatgaggtcctgtactatatatctgtttgcacaggttaaggtaaaacaccaattagctggtcacatttagcaaagcattgaaaacaaaaatgcatcctctcttgactctcttcccaaacagtccatcattacaccatgaagcccttaaaggaaagaagaaactgaggaaaacttggtttccttcatggaaagaatctgaagtcgttaactccttttaggtcctgtgagatggcaggcattccagcattacatctgactgatgcggctatgggcctagactgagatctgaaacaggctgttagggaaattctggtcaatcttgaagtctcaacctctttgctctctaaattgtccaccatcaacgaaccccctccaaggtttgctggaaacactgttagcctgtaagtagcagatactccctcctctgtttggtccagtaacctgtaatgtcactattctttttacttcttgttgccgctcccctcctctcccaagctcctcaaaagccaaacataaaacttccagaaatacaggtctagaaacatactcttactagtaaatccaaccctaagtctattttcttgactcttccattactgttaagatcttaaataagtaagactatgggcaagtcgttctaagaaggggtttgtgctagttttcctcctcatgctttcttgcctggtcacgtacttaactacctaaaagtttagctatggctactttctttctcacagaaattaaattattaaagcatttagcctttaacttcatcatagtattatttcattagcagtatttctacatttcttttactcacttctgtgtaaacactagtctctgtttcttacagatttatgctataggaggcgcagcatgggattcaaaggaaacatgatttaaaaatctgtcatctgagagaggcttattttcatggcaaaaagtaaagcaggaccaacaggtggtagtggcaggaggcatttcacttcaaatatcactacaacttattaacagagctgtttaaaaatggaaagggctgcctagaaacagcgagctcccgcaccctggaggggcggaatacaaattgggtaaactggtaggagtgctgtataaccctttcccttctggcagatcctcttcagtatacttaacctctctatctttcaaatggagcctttacccaggcagcatcctctagatctgttcagtccagatttctaaatgttggtcagagttaatcacataatttcagacctcagttgaccttaaagatcatgacgaccagttccttcattttaaaggtggggaaactgagacctaaagtggtaacctgactcttaagatcaggacagtcctgatttcaccaggtagatagccagggcaccctctttcttagtctactactgatcttccctttaccttttcatcatcacaacaaaccatcccttggacagaagaaacatgactgcaaacagagttaaccaagattttccatgactagacttagggagtaaatagcaaacagattacgattttccctttagcatgtttaatgcacttttcctttaagttcaggaaatttcaagttctatttactcaacaaggttaccaagcagtggaattggccagttgcctaaaaaggatacacatctttcatttgctcgatggttggtgctcgaataatgtcattgattccaatgatgttctcatgtctgaagcgcagtaagatttttatctccctcagggttctctggcagtaggtctggtgctcaaaggggctgattttcttgatagctactcgaactttgttgacattatcataagcagagcttaaaaaagagagagagagatggcattaaaaacagccctcagaatatttgaagaaggcaagttggtaaagtattatatttttaacactgtgtaaacacctgtttcatacccgtgaaggcagcatgtatattatccacaaaaaggcctcaagctagggaggatggatgcaactgacatgagagagcacacagtgactctcaaaactaacagagaacctagccctgttaactgggtgaaagtcttgcctttataaacccagaaatacacaaacaagcattctcccattgtcttaaacagcaactgcattctggtgagagtaatcacttctgtctctgaaacaccttcttactgttgtatcaaattcctctgacacagaagaaacattcaaataacctacaactgtacatctttatccctaacaaaaatggacccaagagaacaccttgattacttctattaactttgtttctctcacttgcaaaacaacatgaccatttcttcccccaagaaactgaatcaagatgtttgggtagttttataacaaaacctagaaaagtattcttcaaaaaacatatttgtggcaataacatggggcccagttctttcctagttgtccttaatgtctgataaaccagaattataagcaaaagcaataataaaaattataccttcaattttatgaatttgaatcttgagtattactactatctttatgataaacattctattacaatcttgtgtataagaaattttcatattaataaatgtcaacatctggcccactgaccaaagcaatcaaataacattgacaggcagtaagacaacatttcttgtttccttggggtaagtgctagaatagaaagcagtaaaataactttattctaaaatttatgcttctagggccgggtgcagtggctcacacctgcaatcccagcactttgggaagctggggcggctggatcacttgaggacaggagttttgagaccagcctggacaacatggtgaaaccccgcctctactaaaaatacaaaaaaattagccaggcatggtggcaagtgcctacaatcccagctacttgggaggctgaggcacaagaatcacttgaacctgggagatgcacgtggcagtgagccaagattgtaccactgcactccagcctgggcgacagagtgagactccgtctctaaattaaataaagtttatgcttctataatatttatcagtctactaatcctaagaattattgatacatttgtctgattctatgacaagataatgctctggaggagaactttgtcttactaggatccaattatcctacaacaccattaacatatagtacacaggtggccccaaatgctttgaaatgaagtatattttcttaagtaaaataaccactactcaaatcttattttgctttggtttggtacatgaggccctaagccagtgattttcagttaggcaacagcatatataatagtaataatttaacatagtattaaaaagcatatataataagcaagcttattcaatattgggaatatttttagaaaaaaattctattttggtaattcaaatcatagaacaagagttcaacaacagcacggattagttataaaatgctggtttaaactcaacattacaattttctagtgttaatattataaatttctagtgttaacagtcacaagtggtcataatttgttctgcaaaattataatccaacaaaatttttggagagaggagtttatggtcagtgtgcccctctactgtatcaacactcagtgacgaaataactgccctcccccccggcctctttaaaatttttttgtggaagcagtctcgctctgtcgcccaggctggagtgcagtggtgcgatcttggctcactgcaagctccccctcctgggttcaggccattctcctgcctcagcctcccgagtagctgggactacaggccccgccaccacgcctggctaattttttgtatctttagtagagacggtgtttcaccgtgttagccaggatggtttcaatctcctgacctcgtgataggccccgcctcggccttgcaaagggctgggattacagggtgagccaccatgcccggccaactgcctccttttaagtaagaaaatatgagatcatcctcatctggtcccacttgaaaaaaaggagttttgtctgttcctgtctgctccgcttaaccattctgctgcctttttggtttatgcaatctatctttcatagaactgatgacaaagagggttacactcttccataatgattccatacttgctagtttctccttggatttctcggttttgttttacatattttattgttgatacttggtaaataaggcataccatgaactttcaggtgtctataaacatttatgctttaaaatcactttgacattaccaactgtgtcttgttttgctcaaccccttttgtccctaactaccaccacactacaggtttttgctataagtgtgtctcttatcacaggaatccaaagatggttcattaaaaaagaaggccgggtgcggtggctcatgtctgtaatcccagcactttgggaggccaaggcaggcggatcatgaggtcacggcaggcggatcatgaggtcacgagattgacaccatcctgtccaaaatggtgaaaccccatctctaccaaaaatacaaaaattagctgggtggggtggtgcgcgcccatagtcccagctacttgggaggctgatgcagaagaatggcttgaacccaggtgatggaggctgcagtgagccaagatcgcgccactgcactccagcctggtgacagagtgagactcagtctcaaaaaacaaaaaaaaaaaaagtgggggtcagtcctaatgggtgtgtggtgatagctcattgtggttttgatttgcatttctctgattcatgatgatgaccatcttttcttatgtcttcttttgaaacgtgtattcaacgttatgccttttttttttttgagacggagtctcgctatgtcgccaggctggggtgcagtggctcaatctcggcttactgcaacgtctgcctcctgggtttatgcaattctcctgcctcagtctcctgagtagctggaattacaggatctcctgacctggtgacccgcctgccttggcctcccaaagtgctggaattacaggcgtgagccacccaccacgaccagccaggactgccactatttaaaaacaaacaaacaaacaaacagaaaaccgtaagtgtgatgtggataaatttgaaccttcatactctattgttgagtgtgcaaaatggtgtaaccacttggaaattcctcaaaaaattaaaaatagaattcccatatggtccagcaatcccacttctgagcatatatccaaaacaattcaaagtagaatctctaagagctactggcaggttcattgtgcagcattacgcacaatacccaagatgtggaagcaaccgaaatgtccactatggatgaatggataaagaaaatgtagcatatacatagagtggaatattattcagtctttaaaaaaaaaaaaaaaaccacacacacacacaaagaaattcaattcagcatccaaaaaccatgcctaattgtttttattatttatttatttatttgagacagagtctcgctctgtcgcccaggctggagtgcagtatcgcatcttggctcactgcaagctccgcctcctgggttctcgccattctcccgcctcagcctcccgagtagctgggactacaggggcccaccaccacgcccggctaatttcctttttttttgtatttttggtagagatggggtttcaccatgttagccaggatggtctcgatctcctgacctcgtgatctgcccgccttggcctctcaaagtgctgggattacaggtgtgagccaccgcacccggccaattgtttttaatttaaaaactttttggtagatatggggtctcactatgttatccaggctggtcttgaactcctggtcataagtgatcctcccacctcagcctcccaaagtgctgggattacaggcatgagccattgtgcctggtctgacttaatattcttaaagtgtctacactactcagtgtggtctgcagagtcaatgtaatccctatcaaagttccaatggcatttttcacagaaacagaaaatgtaatctttaaattcatatatggaaccacaaaagatcccatatagccaaagcaatcctgagcaagaacaaagtggtggcttcacatcacttgatttcaaaatacactacaaagctatagtaaccaaaacagcacaacactgcggggatagggtgaaatgtgcagataatttgttagagtataaagtttcagttaaccaggatgaataagttctagagctctatcctacagcatggtgactacagttaataataatgtattatatacttgcaaattactaaaagattagatcttaaacattctcaccacaaaaagtatgtgagatgacagatatgttaattaccttgctttaatcatttcacaatatacacatatatcaaaacatcatgttgtatatcatgaatatatactaattatttttccagcacttccacctcagtttcatatactaatttgtatttgtcaattataccttaataaagctgggtggggggcagggaatcagcatggtactggcataaaaacagacaaatagacaaatggaacagaataaagagtccaaacataaaggatagtctcttcaataaatggtgctgggaaaattggatatctacttgctaaagaataaaatggatacttatttcacaccctatacaaaaatcaaatcaagacagattaaagacaaaaattgtaaaacctgaaattataaaaactagaaaaggctgggcgcaatggctcaccctgtaatcccagcactttgggaggccaaggcgggtggatcacgaggtcaggagatcgagaccatcctggctaatacggtgaaaccctgtctctactaaaaatacaaaaaaaaaaaaaaaaaaaattagccgggcgtggtggtaggcgcctgtagtcctagctactcgggaggctgaggcaggagaatggcgtgaacctgggaggcagagcttgcagtgagctgagatcgtgccactgcactccagcctggatgacagagagagattccgtctcaaaaaaaaaaaaaaaaaaaaaagcaaaagcaaacaaataaacaacagacaaacaaacaaaaactactagaagaaaatacagggggaaagcttcttgacattggtctgggcaattattttttggttgtgactcccaaagcacaggcaacaaaagcaaaaacagacaaatggaattgaatcaaactaaaaagcttctgcacagcacaagcaacaatcaacagagtgaagagacaacccaatgaatgggagaaaatatttacaaaccacatatctgataaggggctaatatttaaatatataagaaattcacacaattcaacagcaggaaacaaacaaaatatttaaaaatgggcaaaggccaggtgcagtggcacctgcttgtagtcctagctattcagggggctgaggtaggcagactgcttgagaccaggagttcaagaccagcctgggcaacatagagagaccctgtctcaaaaatggaaaaaagcaggtgcgggtggtagggagtgggggcaaagaacccgaatagacattactcaaagtaagacatacaaatggccaacaggtatatgaaaaaaggctcaacatcactaatcagaaaaatgccaatcaaaaccacaatgagatatcacctcacagctattagaatggctattatcagccacctacggtggctcacgtctgtaatcccagcactttgggaggccaaggcaggcggatcacctgaggtcaggagtttgacaccagcctggccaacatggtgaaaccctgtctctactaaaaataccaaagttagccaggcgtggtggtacgcgtctgtagtcccagtttcttgggaggctgagtcaggagaatcacttgaacccaagaggcggaggttgcagtgagccaagatggcaccactgcactccagcctggacaacaagagtgaaactgtctccaaagaagaaaaaaaaaaatgttcttgcccccaccacacacaaacgttaactatgtgagttgatgggtatcttaattagctttactgtggggatcatttcgcaaggtatacacatatcaaaacatcacatttaacacagtaaatatatacaacttttatttgtcaattatgccccaataaaggtgggggaaaaaccaaaaaggtcattctatcacatgctataacatggatgaagcttgaggacattatatcaacagaaataagtcacaaaagacaaatactgcataatttcacttatatgaggtatccaaaattaacaaactcatagaatcagaaaggagaatggtggttaaaaatggctgaggagagggagaaatggggagatgtgttcaagagtacaggttttcaattttccaagatgaaaaagttctagatctattgtgcaacaatgtgaatatacttaactctactgaactgtgtacttaaaaatgattaagatggcaaattgtatgctttttaccaaaacatataattaaccaaaacaattttactttgtaaagagatgaagtctcggctgggcacggtggctcacgcctgtaatcccagcactctgggaagctgaggtgggtggatcacgaggtcaggagatcgagaccagcctggctaacatggtgaaacactgtctctactaaaaatacaagaattagcagggcgtggtggcacgcgcctgtaatcccagctactcaggaggctgaggcaggagaattgcttgaatccgggaagcaaaggttgagtgagctgagatcacgccactgtactccagctctgggcgacactgcaagactccatctcagggggaaaaaaagcgagagagacagagagagagagagagagagagagagagagagagagagagagagagagagagagagatgaagtctcactatgctgcccaggccggtcctgaactcctgagatcacttcctcaggcttcagagtagttgggactatacgcacatgccatggcacctagcttaaaaaaaatttttttaagggggaaagaaacatgttaaagagggaaaaaaattaagtattaatttttttttgatggagtctcgctctgttgcccaggttggagtgcagtggtgccatctgggctcactgcaacctccgcctcctgggttcaagcgattctcctgcctcagcctcctgagtagctgggactactggtgcccgtcaccacgcacagctaattttttgtattttagtagagatagggtttcaccatgttggctaggatggtctcgatctcctgacctcatgatcctcggcctcggcctcccaaagtgctgggattacaggcgtgagccactgcacctggcccttttatttcttttgagatgggctactctgtcacccatgctagagtgtactggcacaattatggctgactgcagccccaacctctcaagtagcatagtggggaccacaggtgagcaccaccacacctggctaattttaaaaagtttttttgtagagacagggttctacaatgttgcccaggctgatctcgaactcctgaactcaagtgatcctcttgccttagcctcccaaagtactaggattataggcgtgaaccaccacacctggccaataaagggggaaacttttatccagctttgggttagtaccttctatatatcaagaactattctaacattaggacgcaaaaattataaataatactctgggctgggggtggttttcacatctgtactcccagcattttgggaggccaaggcaggcggatcatgaggtcaggagtttgagaccagcctggccaacatggcgaaaccccatctctactaaagataaaaaaaaaattagctgggcatggtggcatgcgcctgtagtcccagctacttgggaggctgaggcaggaaaatcagttgaacccgggaggcggaggctgcagtgagccgagactgcaccactgttctccagcctgggcgacagagctagactccatctcaaaaaaaaaaaaaaataataataataataataatactcttcccttgaggaacccaagatattgagagtgtctagtcatcttaaatgaacacaacctcaagtcccagatgaattctatcctaagacccataaattatggagaatgggaggacattaaggtctgaagtgagcacacccatctcaagtctcaaaacagatagattcctgctatttgataataaaaggaaatgagattcctatttgataataacaggaaatgaactattgatatatgcagcacagatgaatctcaagtaattatggtgagtgaagccagaccaaaagaaatgtatttccatctatagaaaatacaaagtaatcctgggtttactttggatttacccccaggattgcctgggaatgggaggaagaagattgcaaatggaaatgaggtaacttttggaggcaatgagtatgttccttatcctaattgtgttgatggtttcataggtgtataatgtattaaaacttatccaactttatactttaaatgtgtgcaatattttgtatatcaattacttcttagtaaagcagttaaaaaaaaaaaaaaagaaccagggttctttggccacatgattcattccagtgctggggcaattgggatacagattctagaagtgtaccgatcaataaacgtagaagtccatgaaattctgaagtagattatttaacagatgttttatgattgcttagggaaggaaagggaaccagcatgagtcaattatgaacaagtcatgctaaactagctttatttcctgttttgatagggttaccacaacaacacgaaatgaagacagagttctggtgaattcaagccacgcttgtcaagaacttcccatttgtgaggcttcatgttaggactggtggcaaaaacaaataatgatcctgctcttaagaaacttgcaattttgtgagagaaggagacaggaacagagaacatactttgccttttatcacattaaagcacttctgaaacccaaggaggagctgggttaacttcaaatactaagggaaggattaaaagaagatgaggcccgcaaaagccttatcctgaaggatgagtaggcttctgacagaaaagcaagaccgcaaagaaaagaaagaggaaacaggaggcgaggtaagagactgagacatctgtggtcactggccactaaccctcacccagacatgcccatgcccatgagagaaggttattggggtcggggaaaatgctcctcaggtgcccgggaattccctgcatctggaaaagtgtagtctgtacccagcaggtgcacttgaggtggtggtcaaaggggcagctgcttgctggcgtgtattgcacctacattgtgcaggcaggaggccacacacgtgctcaagctcacaacacatggatagtgctgtggctgggaagggaagagcactatgctgaaggtctgctctgccggaactactgacatagaactctaaggagcctgagtattttctatttgaacccaaccttccaggtcattaagaaggtatattaggcctggtgtgggcatggtgatgcacgcttgtaatcccagcactttgggagggtgaggagggcagatcacttgaatccaggtgttcgagatcagtgtggacaacatgatgaaaccctgtctctacaaaaaatacaaaaattagctgggcatggtggcactcgcctgtagtcccagctatttgggggactaggcaagaggatcacttgagccagggaggttgaggctgcagtgagccatgattgtgccactgcactccagcctgggtgacaaagtgagaccctatctcaaaaaaaaaaaaaaggaaaagaaggcatatctgtcatggcaggaggagagagcaaagtctgcttaatgtttcttaggttgattttttttttttttaatggtatgtagggctccatttgtattcttgacctagaccttataaacgtgagaggtgggcctgggtctgggaggtacaaaaagaaggtggaggtaagggacaaagatagttttcagcatcctgatttaaaaatctaagaatgcctgtcagtgattcagatggaggagatgacggttccatccttccagcagcatcaggagagagatcaagttgggaattcttaacagaagccacagtgattagcactcctgcagagagagaatttcaagaaaagaagtcggaagacagaactcaggagcagcatgaggatgaggaatcagttaaagaaagtggaaagaaatgataatggagtaagaacctttaggccaggcgccgtggctcatgcctgtaatcccagcactctgggaggccgaggcgggtggatcatgaggtcaggagatcgagaccatcctggctaacacggtgaaactctgtctctactaaaaatacaaaaaaaattagccgggcatggtggctggcgctacttgggaggctgaggcaggagaatggggtgaacccaggaggcagagcttgcagtgagccaaaattgtgccactgcactccagcctgggtgaaagagtgagactagtctcaaaaaaaaaagaacctttgttgtccaactccagaggccatgtagttctgcttaaccatgtagcagaaccagaaaagggtggtgtttcccaagacaaagaaggaaggcatttcaaacaggagagactgagaaaagtaagaactggaaagcattcactgaatctgcatgcaaccagacgatgtgtggtaactttggttcaagtaaggaaatggagaggatggggagaggagcagaaagagtacagccgactactttttaaagagtgatcataaggcaaggataacgaaaaaaacttaaatccaggtgaaaaactgagaggcacaggatgttatgaaagccatggtcgggggctgggggaggggaggctgaaggctgcaggaccgggtagggtgaaagagaaggctccaatggctaaccagggggaagagaagggagagtaaattccaggcagaggagatgtggggcagtggtgcagaggcctgtgggaacctggggcgacagagtgcctgcagagaggcggacacacagggacatgacaggggaagctggagggtgagcaagagccaggccatatttatattttcgtaattttatcctgggaagccaccaaaggatgctaagcacagactttaagcatggcaacatttatatttttataacttttcctcaggtagcagtttgttgaaagaatggaatggggaggatggtgcactgggtcacccggaggcaaggagccctttcagccaactcagaatgaaggggagccacagctctggataaatgggcaaagagcaggctcacaagaaatgggtgcttatttcacaaacctcacatgtcccagcagggtcctgttcaagcagtctccatccaattagatgaaattcctcaaggacacaactgtatgttctaaatagctcatgtcttctttactgcagttgtaaccaaatttgcagggcgggaaaaaaacagtatccttatctgatgcctctcaatgaagatatgacaacaaaaatcctacaggtggccacaaatgccataaggaacaggctgttagccagaagtactttggtcttgacaactcagcttccacctgtcctagccccaagatacatgaaataccagtgggccccaggctcaagtgacccaaggatatttcaaatgtctttttcttttctttttttttttttttaaagacagaatcttgctctgtcatccaggttggagtgcactggcgtgatctcggctcactgcaatctccccatcccgggttcaagtgattctcctgcctcagcctcccaagtagctgggacaacctacaggcacaagccaccaagcccagctaatttttttttttttttttttaagtagagacagagtttcaccatgttggccaggctggtctcaaactccagacctcatgtgatccacccacctcggcctcccaaagtgctgggattacaggcatgagccactgtgcccagcctattctttattcttaatactttattcatttgaaagctttccttttgtggtaaggtacagttcctttcactgatgtttatttgttctatcatttctcataacccccccacccccacatcctgaaggtacttgctttcttgtagaaatacttaggtctgtccgtggccctgaccctgtaaatagggcacttggcattactattgttctccaatgcccacagaaggtcagaaagcaatgaaccaatctgatcctcacagctataccacttccaatacggctaccactttttttttttggagacagagtctcgctttcttgtccaggctggagtacagtggcgccatcttggctcactgcgacctccgcctcccaggttcaagcgaccctcctgcctcagcctcctgagtagcaggcgtgtgccaccatgcccggctaatttttgtatttttagtagagacggggtttcaccatgttcgtcaggctggtcttgaactcctgaccttgtgattcgcccgcctcagcctcccaaagtgctgggattacaggcatgagccactgcgcccgcccgtctcctcctttcaacaccatatttactaccgtgtgaaaagcaacaaatgttaatatggttaatgcaatacacagtactttaaagtcttgtttcttcctatgtgaagacttccgtttttggtgtattttatatgaggcagacatatacactcattagcaatttaagtacattaaaggtattaaaaaacagaattcttttttttttttttttttgagacggagtctcgctgtgtctcccaaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccaaaaaacagaattcttaggagcttgaggattctgtttcacaaaaaaagactgacagtactcgaaatcaatcttattatagattggtggggtttgtgattaagtatgaagaataagaaatgtccatgtctgcccatgaaatcattttctcactatgctctgattaaaactgacaaacatttaaactgagattaaaaataaattctacacattaatcatttacgcattcactttaaacttgcttacacttactgataatactgctttgtcttagtttatagatgtatattactcaaaatatttacagttcatttattgggaaccaggtaatgatggtattgaaaagaagttatgaacaattctcacttaataatacctacaatttattgagtgtttattatctgtcaggctctgctctatgttagtatctgtggacctctctctaagaaggtggtatttaatggtgccttgaaaagcaggtaggattttaataggcagcacacgaaaaagcacttaaggaagaaggagctacagaagctgaagcacggaaggctgggtaccaggtgctggatagttcaatatggctggagtttacacctgtccaggggaagaacaaaaggtgatgttactaaaaagctgagaaatctgtactttacttcaataacagaagatgaagagtctggatgtggtggctcatgcctgtaatcccagcactttgggaggctgaggcaggtggaccacctgaggtcaggagttcaagaccagcctggccaacatggtgaaaccctgtatctactaaaaacacaaaaattaggcatggttgtgcgtgcctgtaatcccagctacttgggaggctgaggcaggagcatcacttgaacccagaaggcggtggctgcagtgagccaagatcatgccattgcactccagcctgggtgacagagtgagactctgtctcagggaaggcaggggaggggaggggaggggaagggaatcagaaacacaggtatagaactgactgaaggccaggcgtggtggctcacgcctgtaatcccaagcactttgggaggctaaggcaggtggatcacctggagtcaggagtttaagaccagcatgaccaacatggtgaaaccctgtctctaccaaaaatacaaaaattagccaggcacgtagtggcaggctcctgtaattctagctacctgggaggctgaggcagaagaactgcttgaacccaggaggtggagggtgcagtgaaccgagatcgtgccactgcactccagcctgggcgacagagcaaaactccatttcaaaaaggaaaaaaaaagaaaaaaaaaactgactaaagaggctaaaactagacatagggagaccagttataattcttgaaatatctatacccatcaacactttgaaattacagtgcttgttagacctgctgcctgatcttgctatttacggcattagtaaagaagcacatataaagacttcttaatttttcaaaagtggtatttcagcataactgattccctttgtaatctcacattttattttattcatttaaaatattaatctgaaaaggagccacaagtttcaccaactgcctaaaggattcacgtcattaaaaaaaaaaaaaaaagatgagaactcttgttataagggcaatttatagattcagtggaaatggcagagacaggaaactagtacagaagtttgtattcaagagaaaaaaaacgtcagtttgggatcgtaaaggatgtgcatcaaataactttaaaaacatttgaatgttaaagttaattttatttatcaaataatcacctacattatgttaagcactgtggataaagcagtaaaaatataaagctctctgccctcataaactatgagaggagatagacatagaggctgggtgcagtggctcatgcctgtaatcccagcactttgggaggctgcggcgggtggatcacctgaggtcaggagtttgagacctgcctgatcaatatggtgaaactccatctctactgaaaatacaaaaattagttgggcgtggtgccgtgccatctgtagtcccagctactcgggaggctgagacaggagaatcgcttgaacccgggaggcagaggttgcagtgagctgagatcgcgccactgcactccagcctgggtgacagagggagactccatcacaaaaaaaaaataagagagagagacataggtattaataaacatatttgtcataaacatgactacattataaattatgataattgctaaggaaaatgcaagttatataattaatgttattaaggataactagaaaacttagtttaaattagaagcttacggaagactcttcttctctaaagaaattagggaaggcatttaaacagagaactgaaggataagccggaattagccaggttgctgggtggcaaaggcagcaagtattctacaagcagggagagggtagaccagaagtagaccagaagtagaccagaagccctaagaagaccactgtggctacagtgtaccagagagagcgtggctcacgatgaggcagaagaaatgcgcagtgacccagcagttatgctaaggatttatcttttaagtgtcctttcactttaaactggggaataaaagtatccaacttatattttgtaaatgatcttaccaaataagagaaaaactgaactgtaaaaaggaaaaagtggctgggggcagtggctcatgcctgtaatcccagtgctttaggaggccaaggcaggtggactgcttgaacccagaagttcgagatcaggttgggtaacatagtgagatcctgtctctattttaaaaaaagaaaataaaaataaaaaaaggaaaaagttaaaaaaaaaaaaaaaggaaaccgttccaagcactgccataataccagcaagaggtgactgacagtggcgtggactaagcaacaaggatgtaattggcatgttaagcaggtcagttcagtgttcagtgtgaaaccataccacccactgcaggacatctagcaacccagacccaaggtcactatcaatccagcagcactctcaagtcagtaaaataataatttaaaaaaaaaaaaaaaacacccaccacatctctgaagggagtagtaaagtccttggaatgcgtaagagcagtgacagtggaaatggaaagagacagccaagactgaaagggaaaggctgctgagtgggatccacgaatgagatggtgagcagagcaggccagataagatcatcaaggtcaaaaatgaattgtgcagagaggagaaaaaatttgcaatatgtaggacttgtatttagcatacataaagaactcttaaaacttcaaaacaagactacaaacaacccaatattacaaataggcaaaagaataaacacttcctttgtgacaacaaatatgaaaatatgactgatgagtcataaaggaaatgtaaattaaaaccaaatacccattagaatagctaaaataactgaccaataccaagtgttggtgaggatgcagcaaagttgaaactctcatatacagatgtctgtaggagctttattcctaacagccctaaactgtgtacgacccaaatgttaattaacaagcaaagggtaaacaaactgtggtacatccatacaacaggacagtactcagcaataaaaggaattactactaatccatgcaacaaggacaaatctgaaaaacactatgctaaatgaaagaagccaaacacaaagagaacaaacttttaaatcccatttatatgagattctagaaaagctgaagctaatctatagtgataggaagccgtggctgggtgcagtggctcacacctgtaatcctatgactttgggaggctgaggtgggtggatgacgaggtcaggagtttgagaccagcttggccaacaaggtgaaaccccatctctagtaaaaatacaaaaattagctgggcgtggtggtgtgcacctgtaatcccagctagtcaggaggctgaggcaggagaatcggttgaacctgagagacaggaggttgcaatgagccgagatcgcgccattgcactccagcctgggtgacagagctggactctgtctcaaaaacaaaaggaaagaaagccgtgcttgcctgaggcacaaactgactgcaaaggtacccaagaaagctttttgaagtgatgtaaatattctgtatctttattgtggtggcagttacacaactacatacatttgtcaagatttcactgaacagtacacataaaaagatacattttattgcatataaattatatctcaaaaggtgattttttaaaaatttagctgtgctacaaaattaaggggttgattctctttcatggttcataagctcatattcaaggaaattccaagggaaatgttccaaacaggttttaagtaatgacagtatcattagaataaatgcccagccttccacaatcatttcaaaggctttgacataaaatttctaatatttttaggttttcttcccatcctcttcatcccctgtcattatagtcatgtctcatagcagaggctcaatatttgtggataatatatccaccttatttagacaaacgttattatcatgcacaagcaccatatactgtagcaactaaaatgctacctaacaactgtgaatgggttatttttagggaaagctattaagctgttctctaagccacccattttggtgaactttaattatctgaacacgaaactacagcactctgtttcacagataaaaattatcttgtcttcagatgctaagtaagttagactgagccaaactcatgttccaaaaataaataggtagataatactaatgattgctttaaaagaaaatgtattccttactttagcttggttctctgacaattcactaaccaagaaaaacagtgcaaaggtttttttttttcagatgctgcaaaccattaagtgaactattaaaagctagcctaaggttatttaagcaataaaaccagtaatagcaaatgcttagcatttattcataattttttattattttaagagccaatgttccaatgtactataggtaccatggcttaaaatctagtcattaacaagtatgcaacttctctagaaaaggtgctctggagagcccagagcttgaacaagttttgttggttacatatgcatttgtcaatttcttcagtaataaaacagactaaaagacccagaaaaggtttcaattctggtcctatccctcactagctgagagacactggctgaattacttagtatctctgagtaatcacttgcttggctagaaaatgaggaaagcccggggattgtgaagattagaaaaagcagatgcagcctaaaagatagtaggccttcaaaaaaaagttgtatggtcttttaaaaattattttacttggccgggcgcggtggctcacgcctgtaataccagcactttaggaggccgaggcaggaggatcacgaggtcaggagatcgagaccatcctggctgacacggtgaagccccgtctctactaaaaatacaaaaaattagctgggcatggtggcaggcgcctgtggtcccagctatttgggaggctgaggcaggagaatggcatgaacccgggaggtggaggttgcagtgagctgagattacgctactgaactccagcctgggcgacagagcgagactccgtctcaaaaaaaaaaaaaattattttacttattattattcattacatttatcatgtgataccctaaaaaggaagtaacatcagaaaagaacactgggcttcaaatcaggaggtctgagttttagtcctaactcagctatgccctacatatatgctttgataatgctggccaagttacaaaaagaagattccattatttcatgttcaggctacatccaaacataagcagcacaaaataaaaaatatggataaagagacacactcagttatacaggtgtatgcgcagacactgacatagatgaagacttgtagtgacttatattcagaaaagtttccacaaatttttggtgaactgtggtacccaaattattaaagtatgaaaaacatttctctcttcatgaatgggaaaaatgtctattttacttgatctaagatatactaccaggatttagtactgcgactatccatcatcttaaaaatccataaccaagcagctctgttttacttaaagcatgctagggtagcccaaagtgagacttggtaacagatactatctaatgcaaagcagttactgcttagaagtgttctgaacttgccatgagaaagaaagggagaccctgatgaaatagatggagtatccacttcttgatcatttccctacatttcctttctcctcatttatttcctcccactttcactggaaaagaactttacaatggtctgggtgaggctagctggcagtgagttatgacaacagctagaagtagtatcaacacaaaccaagagcattaagtgacccctgaggtagagtgagaaaataaggaaggactacatttaatcataatgatcatagtcactagcacagtgctaagaacttaagaaaaatccttatatattatcttcaccacaaccctatgaaacataacccctactttatagatgaagaaactgaggcagagtggagggtcaactaacgtgtccatgattacatacctagtagttaacagaactgagattcaaatccaggtgtgctgacccccaaaacccatgttctgaaccatgacactttatataggccaacagtccttggccacaggctcttgtggtgatcaaccaagttcaggttcatcattgagccagattcagacaggtcaactgaaaagaagctgaagaaggcaggcagtaaggacaagaaaaataatcataatgatcatgatatagaaaatgtactgcttcccaaagtagcctatccatttggaaggttctggctatttagatctatttcctcaggataagtcaaaacctgtctttcctgaaataaggtgagtatgtgctgtaaatgaggtgtgggagtatgggagagcaggctggaaggcagaagatgtgaaggcaaaccaggcacagggaaggtgagaaagggacccgaacggggacaagttaaaagaaaacattgaagactcagcagaaagaatccagagatgtttagtgctgccaatcatgacaattaagtgactttctccagtatgtatcagcagtctgagcaagatcagacaaaataaacagtagggttcctatagagtgggagtggagagatcaggagaactgagaatctggtcagagtggggaggtcagcagacagaatccagagcgaggccagagaggaccagcacaccgggaaaacacaaaggtgagggtctcaagccaggggtcgtcagggagagagggcaggatagggagccatggtctagaaaagaggatgatctactttgtcatggtgaccctggcatgcttttgtaagctgtaccccaacgagtcaagtcaaaggaagagaggctcagatgaccacctccgtcactgaaatgtaagagtgaagaaatgcaaatattttctgaactgcctcacttttggaaatattaaacacctgtctcagaaatctggaaaatgactaagatggggaaaatgtttaaacttgcagtatccagtattattatctaaactgaaaagaactgcctgcacaactaagcaggtggtgagatgttacataacagatgctaaactaggtaaagtggaaaaatgtaatacataattataactttaaaatgccagtaagaaaatcttcagtcagctctggaaaactaattttacttcttttcatgaaaaagttgcagttagtttcttttgcaacctgtcatgatagaagaggaattgcagaaggaaaggaagaccctaaacaaaactgataatcattcatctgtatgtgttttaaaacatatgcaggtagttttcatatatggctggtgggaatgcaaactgtacaactcttctggaggggaactgggcaatacctaacaaaattatatatgtgtacatcttttaacccagcaatcctacttctaagaatctactctgaaggtacacctccaatgatatgaaaaaacatatgtacaagattatccacagtagcactatttgtaattgcaaaatactggaaacaatctaaatgcccacacattggaggagactgaagacactatgttatatccacatggagtactatgcagcagtaaaaatgaatgaaaatcattctaagatgtctaagaacagacacagaatgaattccaagatatattgttaagtgaaaaaaccaaagtacaagatttagactatgctatccttcatataagaaatgggcaataagaacatatacatatatctgcttatttgtacaaaagaaatacaggaaggataaaccagaaactaaagagatcagctacctacaggggataggtgggaaagggataaaacgaaatgggaatggatggtagggataaggaaggagtgatatttctctgagtatatctttgtgtatagatgactcaaaaccagagtaatgtagcgcataccaaaaaaattaaagaacccagaatacaaacagtaacaagtgaatctaactgcgttacaaaggaataacataaccacactgaagggcatgaggaagaaactttgaaaacctattttgactggatattgtaaagctaaaggcataaagaactgtaacacaaatgctgctacctagtaagtaaatttgtttctcacaaagatgtgagttagcaattctgacactaattcatgtagacagtggtactgactgaaaaagtaagtttaaaaaaatgaaggataatgacagccaggttggcaaaataattacaaataagagggaaggctaaaataaaccacacagtgttggattagaatgagatatcagtatgaactcataatttctaacatatacacagacatacacagaaataaacatagatacatgtgtaatatgtagctgagtatacataagcctattttcctagttctgtctgctgagaagacttagaagcagtgacacccagtagcaatgagcacacttaaaagcatattgacagccaggctgtaatcccactttgggaggccgaggtgggtggatcatttgaggtcaggagtttgagaacagcctggccaacatggtgaaactcctcttttactaaataaattcctttactaaataaaaaaattagccaggcgtggtggcgggcatctgtaatcctagctactcaggaggctgaggttcaagaatcacttgaacccgggaggtggaggttccagtgagccaagattgcaccattgcactccagcctgggcaacaagagcgaaactccatttcaaaaaaaaaaaaaaaaaatacaaaagcatattgaaagggcctagaggccaacctgaaagagcaaactaaagttgaaattgtaacaatctgagcaacaaaataaatcacagtattagactaaatccatagaataaaacacatatccatgcatccacacctatataaataagtgaataaatgagagggaggatagttcttccttacagatgcactccaattaatacagaaggaatgaaggaaattggggaaaaaaatcagaattaggcaaaaaccacaataataagtttcagacaagacccatggatggatgctaaaatcagtgagtaaaattgatcacagtctcagagtacatcccctaagatgtctacgataatagtcgtaaaaggataaacaggcagataccaccaccttaaccaaatgattaacatctaagacacagcaacatcatgaattctcagatatgatgtgctgagaagagcacaacacacttaaaaatgcataatctcattctaatcatgaaaaaactcagacaagtccaggtgcagcggctcacgcctgtaatcccagtgctttgggaggctgaggcggatggatcacctgaggtcaggagaccagcctggccaacatgatgaaaccccatctctattaaaaatacaaaaaactagctgggcacgatggcaagcgcctgtaatcccagttatttgggaggctgaggcaggagaatcgcttgaacctgggagacagaggttgcagtgagccaagattgcgccactgcactccagcatgggcaacaggggcaaaactccatctcaagcaaacaaacaaacaaacaaaaacaaaaaaatcagacgagccaaatgcagtggctcacacctgtaatcccagctatttgggaggctaaggcaggaggactgctttagcccaggagtttgaggaagaccctgtctcgaaacaacaaaaaaaaccctaagaataactgtcctagactgtgtgtatatgtgtgtatgaattgggattttattttgtaaaggaccccaggtgattctaaagttcaactaagatggagagtcactgcaccaacccttttcttctcagctcactttgtcctgggcccatatctcatggttttgggtctactgtggaagtaccttctctacagaacaaagacaaagcaatagaacccaaattcttccaattccctttgggatctattcccttcttctcctgcctaccagtatgaacttctatgggattatgctgatgagaaaaaataaattacatttaagtgactgataccaaaaactggaattacttcacagatgagaaacctggtcccagatacagtgcaccttctggacctcagtatcttcaattttaaaatcattgttttgaatctgatttctaattgttaagctgaagtgtttctttaaatttttaagttggttaaaatgtgtgtgtgtgtgtgtgtgtgtgtgtgtgtgtgaaagaacctgctccctcatcctcaacagcctcatcaatctccacccattacccatttttattagttgcttatctttccattatttcctcatgcaaacacaaatacatattaatttatttacacgtattagagtaaagtgatttctaaatctgaagaggcatcagactcatccagggagctttttaaacaagtggacacttagtttctattttatacctattgactgaacaaaacccctggagagtggagcccagaactttgacaaagttctctcaggcagttttctgtgacagacacctctcagggtacttaccccagcccacatcacctttacccaatagggatctgtccccttttgtctgtgctgttgagagtattgctcctggccacagctgatgaggtactacccagcccagacaagaatccattctaaggtagagctgggccaactagctcctcttctcagacagcctggagctggagcacagagactccaaggggccaggctggctggcagaagagtatctggttgcataactgggaatgctgggatgggccacatgcacccagacttcattctgcagagaggagccaagtagtagacagatctggactgcagaaacaaggcctgctgctccacagagaatgacagaggcactgccttggttctcagtgacttcccaattcttcaatctagtcctccattcctcaggtcttcagtaggttttctggagtgagtgaaggcagcaggagtttcagcagtcgtcctgcagatcatctgttactctgaatatgcagtgggtgagtgttgtgggcgtggctgttatctgggggcaggttgaaaagctgcaacactgccactgactctggcagttatttctctgtctaggtctttgcttgtgtttggaacagatgtatttactgctcaagagtgcaaatgaggagacaatatgggaagaaaagaaaagaaatttcagaaataagatttccactgtaacttgagaaataaaaaatttgagtaatttcacaagaactcataattctgcttaactagtattccgtaggatgacagtggcaatgtggcagcttttcaacctgcccccagatagcagccatgcccacaacactaacccacgatacattcagagtaacagatgatctccaggacgaatgttcaaacttgtgccgtcttcgctcactcccgaaaacctacttaagtgatagagtatatttgaagaaataaccttcaaactattcaacttttattttgggtcaagatacaaagccttggtcttggaagtcctgaaacctgaattcaagttcttgtattgtatcacagctctgtgcttgtaacctcgggcaattatcttaacctcactgaacctcagtatcttcctctgtaaaatgtaaagaatacttatctcacatataaggttacttggatgaacaggtacgtgaacttgtttcataaattcaatacaaacagtgtcactgccatctagatttttatcactttcatctccaatctcacttttttcattattttaatataattttaaataattacctttttttttgagatggagtcctgctctgtcacccaggctggaatgcagtggcgcaacctcgggtcactgcaacctccgcctcccaggttcaagcaattctcctgtctcagccacccaagtagctgggattacaggcaccccgcaatttttttgtatttttagtagagacagggtttcaccatgttgggcaggctggtctggaactcctcgcctcaagtgatctgcctgccttggccacccaaagtgctgggattacaggtgtgagccaccgcacctggcccttaaataattaaatttaataatcattatcattcttattctttttgttgataactgtaaactctgcattagttttccttatatttcttttcctttttttttttggagacagaatctcgccttggctagagtgcagtggtgcaatcttggctaactgcaacctctgcctcccgggttcaagtgattttcccccctcagcctcctgagtagctgggattacaggtgcccgccaccacactcagctaatttttatatttttcagtagcgacagagtggtcaggctggtctcgaacccctgtcctcaggtgatccacctgctttggcctcccaaaatgctgggattacaggcgtgagccaccaggcctgcccagttttccttatatttcattaggcataaaaattatgaagctgggtgcggtggctcacacctgtaatcccagcactttgggaggccgaggcgggtggatcacctgaggtcaggagttcgagacccgcctgaccaacatggcaaaaccccacctctactaaaaatacaaaattagccaggcatggtgctgcatgcctttaatcccagttacttgggaggctgaggcaggagaatcacttgaaccagggaggcagaggctgcagtgagccaagatcgcgctactgcactccagcctgggcgacagagcgagactctgtctcaaaacaaaacaacaacaaaaacaaaaaacaaaaaactctatctatctatctatctatctatctatctatctatctatctgcatgctaatttttagaacatgataactacataggactttaaaatagttaaaagtcctaccatagagtcgaggtgacttagccagtcacccaaaaacagagctaggattaacccttattcattcttctgaattctatgttctttccattatacaagaatgtgcccagaaaatcctacacaacagaactctgggaagagctaagctgagaaatggtacagaatgctgccttcaaaacccaagaaaataaacacattataaacaaagaacaaagataagactcaactgcaaggaacacagcaagcaaattttaaagggcagcccaggaaggagctgagagtgttaagtacaaaccatcaaggctcaagagaaaaggagatggcttcacagaatcaaaaacccacaagaagtcaggcatgatggctcgcacctgtaatcccagcatttggggaagctgacgcagatggatggcttgcccctaccagtttcagaccagcctgggcaacacagaaagcagtctccatcaacacgaaacattttaaaaattagctgggtgtgatggctcctgcctgtagtcccagctactcgagaggctgaactgagggaggaagggacccagaatcacccagctatgatcactgcagtctagcctgtgcaacagagaccctgtctctaaaactaactaaagaaataaatagcaggaagaagtaaaaagaaagatctaggatgcaggaagagaatgagaagacacatacccggacccagccaaaaaaataaaaatcaacaatgattactctcgaaattgatgttatgaaatcaatgccaaacagtaatacataaataaataaatcctgatacaaaatagtaaaatgcatgcagaaatgtaagcaaacaagagtgcaaaagaatacctgcacactcagagtcaagtagggctggttctacattgttaaaggacacagaggctggctgctacacgctgggggagggaagaaatggagagtgactgctcatgggaatggggttgctttttgaggtaataaaatgttctgggattagacagtggtggtggttccaaaactttgtgaatatatactgaaaacaactaaattatattctttttaaaggtgaagtttttcttttctctggtaggtaaattatgtccaaaaaaaaaaaaaaaaaaagcatggtcccttcaaacaaaaatcccttttctcagatcattatttcaggagctaacacttaaaagagagatcccttcactctggaaagctgacagtaatcaaaacagggcatgaaagcctggagcagggagacagatcagctctgggagttgggatggggaagaagagagaaatggcatcttgatgatactttttatcctggccaacccacttcaccagcgaaaagctgataagcactcaagacagaggccctacactaaagaatttaaaagtatacaggccgggtgtagcaatttgtacctgtaatcccagcactttgggaggctgaggcaggcagatcacttgaggtcaggagttcgagaccaggctggccaacacagaaaaacccagtctctactaaaaatacaaaaattagccaggtgtggtggtacatgcctgtagtcccagctacctgggaggctgaggcaggataatcacttgaacccaggaggcggaggttgcagtgagccaagattgtgccaccacactccagcctgggcgacagagtgagactcaaacaaacaaacaaacaaaaacaaaaacagaacttaaaagtatacatctggggggagaaaaaaaatgtaggggtggacgtggtggctcatgcctgtaatcccagcactttgggaagctgacgctgtggatcccttgagcccagaagttcgagatcagccctgggcaatatggagaaacccagtgtctacaaaaaatacaaaaaaattatctgtagccgggtgtggtggcacgcgtccgtaatcccagctactcaggaggctgaggcaggagaatcgcttgaatccaggaggcaagaggttgcagtgcgccgagatcgcgccactgcactcctgcctggacgacagagcgagactccgtctcaaaaaaaaaaattatctggggtgatggtgtgcgcctgtggtcccagccacttggggggctgaggtggtagaatcacctgagcccaggagatcgaggctgcagtgagccatgatcatgccattgcactctagcctgggcaacaaagtgaggctgtctctaaaaagttaaaaataaattaaaactaaaatgagggccaggtgtggtagctcacgcctgcaatcccagcactctgggaggccaaggtgggaggatcgcttgagtccaggagttcgagaccagccttggcaacatagtgagaccctgtctcttgaaaataaaataaaaaatttaaaaatttttaaaaactgaaaaaatgaagcaatataaatgcccaacaaatgggggcaacagttatataaataacctgtttttaataaaatttaacattatgttgatgttacatgttggagtcagatacatagaaaaaggaaaaaataggacacaatagtatgggataatcattacgtaggtttaaaaaaacaaaagaatccttgctgagaacaggtctggcagagcaaagtgagctttagcctgaagtgggagggagaaagtaaaacagtgggcagggctctggaggaaagaaggatggtagtgcttcaaagggaagcagaagttttggctttgttttatttttaggacagaagagtgatcagcccctaggaatttggatgagatcatccagagagtgtgtatgggacacagagggcccaagaactaagaacaaagagtcaaagacttgggaaaaccagaggtgtctcagcaaagtagtagatgtaactttttaaaaaggaaatggcttataacatcaagtgctccagaaaaaatcaaaatcttttgattttccagggagaatggcaaaaaaaggggaaaaagaatctttggtgaggaaggccttcaggaaaaagcaaccagtccagaaagatcaaaatcaagaaagactgtacatagagtgtgcacaccatcagttcagagtgcaagagtgggggtagggggctaaagtctggctctcgtgggcagaagaggtgggcacagaaagcagagcaagcagcacgaaccattcccgagagagcctgactatgaaggggagagaacaaatggcacttgtctcacagactctggggcagtgcccaggaaattaaatttaggactatatatcaatttaaaagtactggatagagtaacgaaagtgatgttttcagtaagtgttgtacagcagaaggcttgtttttgttgattttaaaaatctttcatgggagattggagagatgctggtaaaaaaaaatacagcattaaaataaaatctttcactataaaactagctagtacggccaggagtggtgactcacacctgtaatcccagcactttgggaggctgaggcggggtggatcacctgaggtgaggagttcaagaccagcctggccaacatcgtgaaaccccatctctactaaaaatacaaaaattagccaggccgtggtggttcatgcctgtaattccagctacttgggaggcggagacagaattgcttgaacccgggaggcggaggttgcagtgagctgagatcgcaccactgcactccagcccgggcgacagagcaagactcggtctcaaaaaaataaaataattaattttttaaaatgctagtgtaacttcagaaaacttagaatatgattttaaataaaaataataactaaactaaaaaagcaaatcctgtataagcccttagttacttgggaagtcatttaaaagttaagcccatatcatctcaaattccaaaacttattgcaaggtaaataatcaaaagggtggtgctggcacaaagaaaaaagatatagattgatgggacagaaatgaaaatctagaaataaacccatctatggtcaactgatttttgacaagggtgccaacaccactcagtggggaaaggaaaagactatcctttcccttcaacaaatgatgctggtacaactagacagccatgtgcaaatgaataaagctggatccttacacttcacaatatacaatggctcaaacacttaaatgtaagagctagaacaataaaactctacaaagaaacatagggataaatcttcagggtaaaccctgaaaatctggcaatggattcttacatatatgacatgacaggcataaacaacaaaagaaaaaaatagataaattggacttgaccaaaatttaacaactttgtgcttcaaaggacactagaaagaaaatgaaaagacaactcacagaatgagagaaaaatatttgcatatcatgtatttgataaggaatctgtatctagaatgtataaagaacttttaaaactcaatcacaggagctgggtgtggtggctcatgcctgtaatctcagcactttgtgaggctgaagtgggaggatcacctgaagtcaggagtttgagaccagcctggccaacgtggtgaaacctcatctctactaaaaatacaaaaattagctgggcgtggtggtgggtgcctgtaatcacggctactcgcgaggctgaggcaggataatcgcctgaacctgggaagcagaggttgcggtgagctgagatcgcaccactgcactccagcctgggcaacagagtgagagtgtgtctcaaaaacaaaaacaaaacaaacaaaaaaactcaataataggccaggcatggtggctcatgcctgtaatcctagcactttgagagactgagatgggaggactgcttgagcccaggaatttgagaccagtgtgggcaacatggcaagtccctgtctctacaaaaaattaaaaattagccagatatggtggtgcatgcctgtgatcccagctacttgggaggctaatgcaggaggactgcttgagcccaggagttcaaggctgcaacgagccgtgatcacaccactgcactgcagcctggatgacagagtgagaccctgtctctaacaaaacataattaaaagatcaatacttcaatttatgttcaagtggttaaacacagaattaccatatgacctggcaaatgaaaaccatgaccacatagaaacttgtacacaaatgttcgtagcagcattattcataataatcaaaaggtggaaacaaaccaaagctccatcaactgatagacaagcaaaaggtggtgtatccacacaatggaatattattcagccataaaaatggaatgaagtactgataaatgctacaacatggatgaaccttgaaacatgctaagtgaaagaagccacacatgtgatgccatttatacaaaatgtccagataggcaaatctatacagatagaaattagattggtagttactttacactgaaaaagaaggggagagagagagagagagtaaatagctaaaggatacaggattggtttctttctttcttttttgacacagggtctcgctttgttggccaggatagagtgcagtcgcgtggtcacaggttactatagccttgacctaggctcaagcaattctcctgcctcaccctcccaagtagctggaacctcagggccatgccacaattcctggctaacttttaaattttttgtagaaacaaggtttcactattttacccaggctggtctcaaactcctaggctcaagtgatactcctgcctatacctaccaaagtgctgaaattacaggtgtgagccactgtatccagtcaagggtttcttgttgaggtgattattctaaaaattgactttgatggttattaaacatatctgtgtatatattttaaaaagctaccctgggaggccaaggtgggcagatcacgaggtcaagatcgagaccatcctggccaacatggtgagaccctgtctctactaaaaacacaagaattagctgggtgtggtggcgggagtctgtgatcccagctactcaggaggctgaggcaggagaattgcttgaacccgggaggctgaggctgtggtgagctgagatcacgccactgcactccagcctggcgaaaaagtgagactccatctcaagaaaaaacaaaacaaaacaaaaaaacacgctgaattgtacactttaaacgggtgaaatgtttgtaaattatctctctctctcttttttttttttttgagacagagtctctttctgtcacccaggctggagtgcagtggcgcgatcttggctcactgcagcctctgcctcctgggttcacgcaattctcctgcctcagcctcccgagtagctgggattacaggcacacaccaccatgcccggctaattttttttttgtattttcagtagagacggggtttcactatgttggccagactggtcttgaactcttgacctcgtgatccgcctgcctcagcctcccaaagtgctgggattacaggcttgagccaccgtgcccagccataaattatatctcaataaagccttggttcttttgaagttaagtccctggggcaagaaatatactagatgaacttagaacatattgtagtgccaggaagtatggagctaaacatttttttacatgtaaataattaaggtatgtcaaagggacacagaagccaactgaaagagctcccaatgcccaaagctggaaaaacataagcaccaaaatcgaagtgccattgggattgtaacccaaaatgtaaaattaatattcacaagtccatagtgatatatacaaatggggagaagagacaatctcccaaatagaagaataccaaataatttatgttgatactacaccatcaaggaggtggaagataactccctactccttcagtgtgggatacacttaatgacttgcttccattgagtatattacgcaaaaaggagaaaacagtgagacacctggcaaacactttagccaggtgatcaaggtcaacaacaagagtgttctgttgacagtatatgcccttgatgtgatgtgatgagaatggcactatctttgtggtcttcctcccctccaaacccacaaccccactttaatcatgcgaagaacattaagcaaagctgggcatggtggactgtgcctgtaatccctgctacttgggagactgaggcaagaagatcacttgaacataggagcttgaggctgcagtgagctatgattatgccactatactccaccctgggcgacagagtaacaccctgtctctaaaataaaatttttaaataaaataaaaaatttattttaaaaaagttaagccctttttagtatttaaatatattgctaacaagtaaaaaaaaatgcatgaataatgatatggtttaaaatttttttttttgagatggagtcttgctctgttgcccaggctggcgtgcaatggtgcgatctcagctcactgcaacctccgcctccagggttcaagcaattctcctccctcagcctcctgagtagctgggactacaggcatgtgccgccacgcccagctaatttttgtatttttagtagagatggggtttcaccatgttggccaggatggtctcaatctcttgacctcgtgatccacctgcctcggcctcccaaagtgctagaatgataggcgtgagccactgcgcccagccggttttaaaattttgactgttggccaggtgtggtggctcatgcctataatcccagcactttgggagaccgaggtgggtggatcgcttgagtccaggagtatcagagcagcctgggcaacatggtgaaacctcgtctctacaaaaattacaaaaattagctggctgtggcacacgtctgtagtcccagctactaaggaggctgaggtgggagaatcacttgaacctgtgaggcagaggttgcagtgagccaagatcgcgccactgtactccagcctgggtgacagagtaagaccctgtctcaaaaaaataaaataaaatttttactgttttcaaagactgattagtggtctggaaaatgattatactactgtgttggatcaaagattcagaataccaaatgatatgatgtatataaaatgtaatcccaattttactaggaaaaaaatgtgccaggatgttgacagcagatatccctgggtagcagcattacaggtgaatgctttttgcataaatgtgcctttctgtgttttccaaattttctctaaagaaaaaaaactgagatgattatcaaactatattatttggggattacaaattgtagcaagttcaggagaagcacagattcattagcccttggaacaaagctgtttcagaattcagtatttttcagattttagaaaggtaatacagtgcatacatatgtgcatacatccctggcgaggtctggtgtgtaccaaggaatccagcactgatatttctgcagcaaacatacaaataatcacactagatgggaaaaatacagactatgaatagtctcgtggcagtccacgtcaggttttgccccaaatgagcttacaaaagatacccagaaaggtctgaaaccctgagctgcaaataaagcactgtggacctgtggaaggatcctgaatgaggaatgagtttcaaccgttagaaccaattccagtggcgacgagcccctccctatagttttgctgaagtaagaacacttttatttgtggtgtgaggggtacagaccatatttagagatgagaagacatcagaggcagaagaaggggtaaagagaactcacttcttcagcaaagggtaaggctgagctctcctgtcagagaggagagtgcaggggtcaccagacagcactctgaggatcactatatctcaaccaagcccatcaagtttgtacttctgatatgtctgataatttacttgagttatgtcatttaacaggtcggccaagccttggagatctagtcagaatgcctgcatgcatatttttaaaatttagatgtatacatacttataatggagagtaaagattcaaaacccaaagaattactaggatatttttaaagaacaggtgagatttattaggaatagacatagtgatcaaatggttatagaagacaggaacacaacattaagctccagtgtacttatcccctttataatgttgatacttatgatacagtatgtaaataaaatattacctacccttacattgtagcaataggcttaccttttaacatggctttgctacaaccaacaaggtggtgtccactctaggtagtccacattcagtttccaaccatcccattaaaatcccttcgtctgttttgtgttgccataacagaataccacagactgggtaatttataggaaaagaaatgtatttcttatagttccgtaagctgggaagtccaaggtcaagaggcctgcatctggcagaggccttcttgctgtatcaccccatggcagaagggcaagcaaaggcaggagcgtaagagacagagagggcccaactcacttttagaccaacccactctgtgataatgacctaaatccattcatgagggcagaacccccatagccaaatcaggtcttttttttttttttctttttttctcagatggagtctcactctgtcacccaggctggagtgcagtggcgcgatctcagctcactgcaacctctgcctcctgggcagtgtgttggcaaggttgtggagaaactggaatccttttgccctgttggtgggaatgtgaaaaggtgcagccactttggaaacagtatgggaggctgagttgtgaggatcacttgaactcaggagtttgtggttcctcaaaattaaacacagaattaccatatgatccagtagtgcccttctgggttcctacccaaaagaatcgaaagcagggtcccaaagagatagttgtacacttatattcatagcagccttattcacaagaggcaaaagcaacccaagtgttcatcaacagatgagtggtgtgtgtatttacaatggagtatattgttccaccttaaaaaggaaattgtgacacatgctacaacatggatgagccttaaggccattatagtaagtaaaataagccaatcataaaaagacaaacactgtatgattccacttacatgaggtacctagagcagtcagacttcatagagacagaaagtagaatggtggctgccaggggcttggaagaaggaaaaatggagagttatttaattgctatagagtttcagcattgcatgatgtaaacagccctggaggccaggcacggtggctcacgcctgtaatcccagcactttgggaggccaaggcgggtggatcacgaggccagcagatggagaccatcctagctaacagggtgaaatcccgtctctactaaaaacacaaaaaattagccaggcgtggtggcgggcgcctgtagtccccgctactcaggaggctgaggcaggagaatggcgtgcacctgggaggctgagattgcaccacggcactccagcctgggcgacagagcaagactccgtctcaaaaaaaaaaaaaaaaaaaagagctctggaaattggttgcacaatgtgaatctacttaatgctacagaacagtacacctaaaaatagttaagatggtaattttttttttttttttgagatggagttttgctcttgttacccaggctggagtgcaatggtgcaatcttggctcaccgcaacctctgccagccaggttcaagtgattctcctggctcagcctcctgagtagctgggattacaggcatgcaccaccacgcccggctaattttgtattttcagtagggacagggtttctccatgttggtcaggctggtctcgaactcccgacctcaggtgatccgcccgcctcggcctcccaaagtgctgggattacaggcgtgagcacctggccaagatggtaaattttgttatgtgtatattaccataattttttaaaaaggctccatgaaattatctatgtacataggtatctagcctatatcccacagtcattcactccaatactttattctctaccccattctgggatgcataaagattgctcttaggattacatagtgatttagttaatacagtcatttcaacactcaaaagacatgatccttgtttcaccagagtaaaatgagactctgagaagttacaggacatgctctaagtcacccagccataagtgtcagagctgaattttcaaatgcagttactaatttgataaatgagatatgttaccttgctgttcttaaaaaggcttgtaacttcagtgaggaacttattcctgtcttcattcatgtattcaactaatatagagaaatgaatgggaaagtgaagagaagatgaagactattacggagatggcacagggttagccagccttatttgtgttatgcagatggggaaacagacctaggcaggaatctgcctgattcaacaaatatttactgagtacctactatgtgcaatgtgtatactaggtgctggggatacagcagagaacaaagtccccactctcaatgaaaggggccagtctttttattcatctttagttaattttaagcacacaacagctatctcaaactttcttcacactttccaagcccctgatcccttatgtactcttggcagatgccccaccttatctcttaccagaacctaaggccaactagcataaaatcccttgagcacacttagattggcatgcttttactgtgacatctgttcctacagcacccttactttcttctcttgagctgagggtgaagatctctttctttcccatctgtaatctcacaatatgcacaactacaccagagacaatggaggcacaatacaggccagaggtctgttcctcattccttctgcggggccttcctccagtgaatatctcttctaacattgtcaatcatatccaacagaaaaagagatctctccattggtacaaaaacctacagctcctaagaagattttgactctcactgctcaacttctcaaataaaaattcctccactttagttctaattatcactcaaatgctgttagacctgtgggcaggtcactatatccctgcctaggtctgtttccccatctgcgtaacagagaaataattgtgctttatctgtcctacagaagtgtgaagaggtttgatgtgacagcagtgaaagcaatttaaaaagtacaaagtgctgtataaaagaagacgttttcataattattctgttttcacatgctatctttattccaatgatctcaaagtacctacccaagcacagttctaactctagtatatgtaagcaaacgtgcaagtctgtcaccttccacacaaagagtccccccacccccgccaaacacaccactccctctccctctccttctccctctccctctctccttctcccgctttccacggtctccctctgttgccgaagctggaccgtaccgccgtgatctccgctcgctgcaaccttcctgcctgtttctcctgcctcagcctgccgagtgcctgggattgcaggcgcgcgccgccacgcctgactggtttttgtattttttggagacggggtttcgccatgttggatcggctggtctccagctcctaaccgcgagtgatctgcctgcctcggcttcccgaggtgccgggattgcagacggagtctcgctcactcagtgctcaatgttgcccaggctggagtgcagtggcgtgatcttggctcgctacaacctccacctcccagccacctgccttggcctcctaaagtgccgagattgcagcctctgcctggctgccaccccgtctgggaagtgaggagcgtctctgcctggccgcccattgtctgggatgtgaagagcccctctgcctggccgcccagtctgggaagtgaggagcgtctctgcccagccgcccatcgtctgggatgtggggagcgcctctgccccgccgccccgtctgggatgtgaggagcgcctctacccggccgcgaccccgtctgggaactgaggagcgtctctgcccggccgccaccccatctgggaggtgaggagcgtctctgcccagccgccccgtctgagaagtaaggagcccctccgcccggcagccgccccgtctgggaagtgaggagcgtctccgcccggcagccagcccgtctgggaggtggggggcagcccccgcccggccagccgccccgtccaggaggtggggggcaccccccgcccggcagctgccccgtcggtggggggcgcctccgcccggccgccccgtctgggaagtgaggagcccctctgccgggccgccaccccgtctgggaggtgtgcccggcagctcattgagagcgggccatgatgacaatggcggttttgtcgaatagaggggggaaatgtggggagaggagagagatcagattgttactgtgtctgtgtggagggaggtggacatgggagactccattttgttctgtactgggaaaaattcttccgccttgggatgctgttgatctatgaccttacccccaaccccgtgctctctgaaacatgtgctgtgtccactcagggttaaatggattaagggcagtacaagatgtgctttgttaaacagatgcttgaaggcagcatgctagttaagagtcatcaccactccctaatctcaagtacccagggacacgaacactgaggaaggccgcagggtcctcctctgcctaggaaaaccagagacctttgttcacatgtttatctactgaccttccctccactattgtcctatgaccctgccaaatccccctctccgagaaacacccaagaatgatcaataaatactaaaaaaaaaaaaaaaaaaaaaggaatattttcacgtgcaaatgaaaaagccctaaacaaatcttaaaatatataaagtggttcaaaaaatgtttattgttattattttaatagaggcctatacatggagcatttatttgggaaagttttaaatgaatgttttcccctgttttggttgttatcaatctacactttaccaattttcaataatgatcatgcctaattaattcaaattaaaaggtgtgtaatacaaaaaaaaaaaaaaaactgcaaccaaccctcgaatcagctcaatctctcactgaattatggttatctgtcaccactgtatctgcctatcagtgattagggagagctctctctggagaaaaatgtcacctagagcatcaacaattttcatacacagtatccagcattcacttgaacgttaccaagcatacaaggaaacagaaacgagaaaaaagagacaacatatccacatatccacagtgacccagttactagttactgaagatgatctttaaaatagctgtaattcggccgggcgcagtggctcacgcctgtaatcccagcactttgggaggccgaggctgaggtcaggagttcgagaccagcctagccaacatggtgaaatcccgtctctaaaaatacaaaaattagctgggcgtggtggggcgtgcctgtaatcccagctacttgggaggctgaggcaggagaatcacttgaacctaggaagcagaggttgcagtgagcctagggtgtggtggggcgtgcctgtaatcccagctacttgggaggctgaggcaggagaatcacttgaacctaggaagcagagattgcaccattgcactccagcctgggcgacaaattgcgactgtatcaaaaaaaaaaaaaaaaaaagaggtaactcttggaaaggagaaaatatctgcagcacatgaatctaaaaaaagactcatcaaaatctacaaagaactcctataatttaatgaaacaaaaatctccacagaaaaatttgcaaaataacccttaaatacttcacgagatagccgaatgtcataaacatacaaaaaagagttaaccaccaaaaaagagctaaaatatcagagaaatgcaaacaaaacccacaatgcataccacttcatacccactagagaggctaaaaatgataccaagtgttgttgagaatatgcactggtctgaactctaatacactgctaatggaaatattttaccactttggaaaacagtttggcacatctactaaaatggaatctatgcacagactgacacagtcattctgctactaaatatatacccagcaggacaatgtggctcacgtctataatcagcccaggctggtcttgaactcctgagctcaaagtgatcctctcaccttggcttcctaaagtgttgggattacaggcatgagccaccacatctggccacttttctttatgtatattatacatcaataaaagtaaagaataaaaagggagaagagtctgaaaagaacaattatcacaaaattaaggaacgtactcaactcttaaagatttgagaaggcgtttctaaggtactagcaatgttccattttgcaatctgcacagtgatgacaagtatttaacttattctgtaaacagtaccttttttttttttttttttgagacagagtcttgctctgtcgcccaggatagagcacagtggcgcgatctcagctcacggcagcctctgcctcctggggtgacgtgattctcatgcctcagcctctggagtagctaggattacaggcaggcgccaccacgcccagctaatttttgtatttttagtagagacaagattttgccatgttggccaggctggtcttgaactcctgacctcaagtgatctgcccgccttggccttccaaagtgctaggattacaggcatgagccactgtgcccagccacaaacagtacttatatcttacctatgtttaaatggatattcaaaataagattaaaagaggtaagaaaatacaatactctagtaaatgtaaaaataagtgagaagaataaatgccaagagaaatataattaccaagaagaaattcaaagtaggaacagtcgtataaccatttttaaaataattttgaatcagcttaacatgttttcaacaaaaaaccaaacacataccaaaaccaaaaaaccacccaggtccagacttgtacaggcaagttctaccaaactttgaaggaatcattctaattttacagaaataaaaacagaagaataggaaaagaaacacttgccaattcattttgtaagggtagtctaattttcataccaaaccacatgagaaaaaccctattatttattaacaagccaaatccagcaatatataataataatacatcatgaccaagttgggtttaatcccaggaatgcaaaattgattcaatattagaaaatctattagggtaacatgaaacttaaagaaaaaaaacaagaaaatttctatacatgcaattaaaaagcatctgtagaaattcaatcattcaggattctttttttctttaagtttaaaaaaacttgacaaagaaagctttatgaagccaggtgctgtggcatgtgcctgtaatcccagccattcaggagggtaaagtgggatgatcacttgagcccaggagtttgagaccagtctgagcaacatagcaagaccctgtttccggggagggggtgggtgggaagtaagccttatgaaaaaccagtagcccctatcactcaataaaagctttccttttaacatcagaacaagtcagggatgccctctgtatcaccactgctcttcaactttgtaatggagagtccggccagcacagttaagacaagataaaatatatctaagtcatgaaaagaaacaaaatatcatgattttcagatgatatgtttgtccttaaaaaatttaaagagggattactggaataagagtttgttggacaatctttttattccagtaattcatcagtttacaaaagtcaaatgcatttctataaaccatctacagatatctcttagaatatagccgggcatggtggtgggcgcctgtaatcccagctactagggaggctgaggcaggagaatggcgtgaacccaggaggcggagcttgcaatgagctgagatcgccactgcactccagcctgggccacagagcgagactctgtctcaaaaaaaaaaaaaaaaaaaaaagatatcacttagaatagcaacaacaaacataaagtatcaaggaatcaattaaacacatgatgtgcaataataataacacaaaactttactgggaaaacaacttaggaaaacaatgtggaatacccggtgaatgtacatatgccctaccatccagcaattccactactggggaatctgtctaaagatctgtgaaactcttgtgtatcaggagaaatgtgcaaggttacttgcaggaacactgtaataacaacaaacctaatgtccattaatactagaatggataaattgtggtatatttatacaatggtatataaagcagtgaaaacaagtaactatactatactcaaaaacataatgatgaatgaaaaaagctagttgaagaatacacacagtatgatttcacttatatgaaattcaaaaccaggaaatactaagtactgtattgtttaatagaaagataatagtccagcccgggtgcggcggctcaagcctgtaatcccagcactttgggaggctgaggcgggcggatcacctgaggtcaggagttcgagaccagcctgaccaacatggagaaaccccatctctactaaaaatacaaaactacctgggcgtagtggcacatgcctgtaattccagctacttgggaggctgaggcaggagaatcgcttgaatctgggaggtggaggttgcagtgagtcaagattgcaccattgcactccagcctgggcaacaagagcaaaacttcatctcaaaaaaacaaaaaaaaaaacaacagaaaaacaagaaaaaaacaagaataaacacatcgagccgtgatcatgccactgcactcaagcctgagtgagagagtgacaccctgtctcaaagaaaacaaaagacaaaaatacataacaggctgggctcagtggctcacacctataatcccaggattttgggaggtagaggtgggtggatcacttgaggtcaggagttagagaccaccctggccaaggtgatgaaaccctgtctctactaaaaatacaaaaattagccagatgtggtagcgcacacctgtaatcccagctacttgggaggctgaggctggagaactgcttgaacccgggaggtggaggttggattcaagtgacagcgccactgcagtccagcctgggcgacagtgagactttgtatcaaaacaacaaaacacataacagtcattaattaccacacataaaggtgcttaatggataataagtgctcaaggaaatggcagtcatggtggtggttgcagagaacaactggaggggattaagagtggtggtagaaaccaagcagaaaccagtctaagaaaaccaaaaaaataccaggcaaatagtttcaaaggaaaattataccattttaagataaggtagactggtggctggcgcctgtaatcccagcactttgggaggccgaggtgggtagatcacctgaggtcaggagtttgagaccagtctggccaacatagtgaaaccccatctctactaaaaatataaaaattagttacacgtggtggtgtgcacctgtagtcccaacttcttgggaggctgaggcaggagaatcacttgaacctgggaggaagaggttgcagtcagccgagatcatgccactgcattccagcctgggtgacagagcaagactctgtgtcaaaaaaaaaaaaaaaaagacaaagtagtcttaatgctatttcagaacacagaaaaggaaagaaaacttccacactcattttatgaagcaagtgtaatggtaaccccaacctgacaaagactgcacaaaagatactacagttgaatactacttacgaatatcaacacaaaatctctgaatattagcaaacagaatccaatggcacattataaaaaggaatacaaataaacaagcacagtttattccaggtatgagagattccatataaggaaatctattgacatgatcttcacattaacaatgttaaatgtgatgaaatcatatcatcttcacggaggcagtaaagacatctgacagctgggtgcggtggctcatgcctgtaatcccagcactttgggaggccaaggcgggtggattgcctgagctcaggagttcacgaccagcatgggcaacagggtgaaaccctgtctctactaaaatacaaaaaattacctgggggtggcaatacgcgcttgtagtcccagctacttgggaggctgaggcaggagaattgcttgaaaccaggaggtggaggttgcagtgagctgagatggcaccactgcactccagcctgagagacagagcaagactccatctcaaaaaacaaacaaacaaaaagaaacaaaaaactaaaataggaaatgatggatactgccttaagtaaacaaaatacacctcggtccaaagccagcatctgacttcatgtgaaaacattagagacttccctgctaacatcacacaccacataaggctaaaatattttccaatttacatttttagaggtaagcattaaattctatgatgccagacaaacatttaccagatttttttttttgagatagagtttcactcttgttgctcaggctggagtgtaatggcgcacaatctcggctcgccacaagctccgcctcccaggttcaagcgactctcctgcctcggcctcccgagtagctgggattacaggcatgtgccaccacacccagctaattttgtattttttgtagagacggggtttctccatgttggtcaggctggtctcgaactcctgacctcaggtgatccgcctgcctcggcctcccaaagtgctgggattacaggtgtgagccaccgcgtctggccaaaatttaccagttcttgaatgctgaatcctgctgggataactggaaacactcctaatgttactataaactctcacactgccttgttggcaataattaaatagctctttctagcagttgtgttcaagtggacagataatcacaaatgtcttttctttctagctccctttggacgaaagaaagaaagaatttacaacacgtctaaagattgtcacttttatcatccctttgaatgataagtgatcagggctgtcccaaaagaatgcctgaaaacattacaaaatgttatcataagcagaatggctcactaaggggatgaacattctggcaagtcttaatctagcatcactaccaactgttttttcactggtctaaaacataacatctaatatttttatttgcctatatagccctgcagtaataattaacttgtgaaaggtctacactgatttttttctttataaagtatttgcttcaaccatggaacagaaacaaagttgatttaatgggaaaaatgtaaatttatttgaggataggttcagcactgctaaattgaaaagggaaagaaaatttcaaacaaaccccaaaaagaaacattttcacatctgtagtgaaaaagctaaatagcagtacactaaacttggttactgacaaaataaatccttgtggccaaggtgaggcaaagatattactctctactttgctagcctaccttgtgttcagtgaattcaaacattaattggggcaatgtattgtttttgcttcattttctttagctgtgcagtaaagtctttgctttcatagaaagattgtgccaagttctttctttttcagaattgcttttaaatcagttctatttaagtatttctctctctctcaaacttgacatttttcattacaccttttttttccaatgccaaaatagcagcattaacattcattccagtcactaggtaaaaactctcttcagtcaaacacacatgaataatctaattcgtgaggtaaacgactactgtcatacagtattacgaagttccaaccttacttgcagagcaaaaaataaaaaataaaaatagtcattttcctcaagggtttaattgtgggcttttaatgttgaagtaaatcaatttactagtttttaacctcaagtttttccctatttcattatatctcaataatgattatccagagatttctgaggtaaattacattaaagacagcgctagtaactgggaaacaatccacacatgaatcttaatatattgcatatatgctaatttcatgtaatgttcctgagggcggtgacaatattagagctgtacgagaccctagagaccatcccaatcccttaactccacagatgagaaacacaaaaacttgcagaagcagagtgacgagcacatgcccatgtgacatgtcatcagaagcagggaccaagactcaggtctcttgccttccaggccagtcctcttttggtaggctaaaagctgcctttcacagcttcccacaaatttcaacacatcctcactcaagtacgtttctgaaagggactcaccgacaactctttagagaaaaggaactatatctcaaaccataggaaaagttctatatctagcttatcaaacttttagtctctgaagcatgtgagagtaagtttgccagtatttctttctcattatcccccaatactttagtgactatttccaacaaacaaaactagactattctcccatacaaacaaaatgctaccatcaaaatcgtcaacgctcacctgtcagattatgaccaaaggcctctaagtcagaatcccgcccaggcaaaatgacatggcagccaactgtggagcctcggttggcctcggatagctggtccccccttcattcacaccacatatctgaggaccagatatggaaagcctctcatgctggaaaacttggcacagtagaaaggcggccacacttttgcccgtcacacaatgcacattcacgggggacctgtgctaaaccattcacagacaacctgtttctgggtcagggtttcgtatacagcagagcagtcagctatcgacacaagggtttgtaacaaaaaacaaaaaacaacaaaaaaaaggaaggacaaaccaaaacaaaaaagaaaataccaaaaaaaagaagagttaaaaaaaaaagaagataaaaataaaatcattaacacagatacacgactacaatctaattttcagacattctagttttgccaatcatgccgattcagaatcatgaaccacatggagttgccatgtttctgcacacttctttagtgtggaacaattcctcagtgttttcttggttccatgatcttgacttaattttgaggtttacaggccagttattttgcagaatatccctaaactcgggttaccttgatgttgcctcctgaagatttggattatgcatgaaacacttgactgtccctattctaactatataaagatgctccttgacttactatggacttacatcccaataaacccttcataaatggaaaacctcataaggtgaaatgcttgttttttttgggaaagtttcttgctctgttgccaggcgggaatgcggtgacacgacgacggctcactgtagccttgaccactcaggttcaagcgatcctcagccccaggctcccaagtagctgggactataggcacgtaccaccacacctggctaattttttttttttttaatttttagtacctttagtacagaaaaggcctcactatgttgcctagattggtctcaaactcctaagctcaaggaatcctcatgcctcggtctcccaaagtcctgggattataggcatgagtcctgcacccagcctagctgaaaatacatttaatacacctaacttaccaaacatcacagcttagcttagcctaccttaaacatgttcagagcacttacattagcctacagttgggcaaaatcatctaacgcaaagcccattttataataaaagtgttgagtaactcatatgatgtatgaaatactatactgaaaatgaaaaacagaacagttgcgtgggtactcggaagtaaggtttctactgcatgtgtatcacttccataccattgtaaagtcatctgaccaccaagccaaatatttgtacttctgcacatgctgctttacatagagaccgagacaaagggggattcacatcttgtcaaccctgtttacttcaaaggaataacagagcattaactaggtaccaagtgctcaggacttcaagtatactgttttatttaatactcatgacaatcctttgaccccttacttgtgactggcaagttacccaacttttgtttcattttcctcatctgtaaaaaccggagagtgatacacactccctggagaatgacagggaaaacagtaccaagaactttaacctaacaagtcagaaatcaatgagaccccttttgacaattcccaccttgccctttagacattccgagatatgcagctttatttaataaatgaccccaccttgggcctcagctgactagaccagaggcagacactctcccaggctggaaaggccaggtggagtgagctgttctgtgcagaatgatctccctaacagtgtttttacacattctgttccacttggaattggattcagagtgttctcagcctctggtcatcaaaaaacctgaagacacataccttcagggagctagggtcagctctcctctgctgagtgcatggggaagtgacaaaagagaaaagaggggggaaaatccagctgctgagagatgtagggtacaagaagcttttgtaactgtaaagagggagggaggtagctacgttggtctattttccagttcctggttccaactatacctaaagctttaactgcactttctatccttgcagtaatatgacaaaggcccccagatcttaatcataaacttttcattttctataatgcagtctctacaaagtagtgcctaaaacattccagcactctaccctaccttttacccagctagctctaagtcttccttcaggtcccagcttaaacaccacttcctcccggaaacccttcatgactactcagaatatcttatatcatccagtggcactccacacctcaccatactcagtaaatgttattactgccctgttggactgtaaacaccaaagagtaagaacaacttttgttcactactttgttcctactgcctagcacataatccggtacgtgtttaataatattaaatgaatgaaaatcaagaaactggtagaggtaactagaaggaatgggaagaaatcaatactgcttcctgataaaaattaagttgctagatgacagatcctttggagataaagaaaaaacaaaaacaaaaaacaaagttactttaactctaatcctttctagcctcttcttcaggtctgtctgcaatggcataatcattttatactttagggctaatccattcaggaacccaggctgtaggaagtacgtttctaggtaactcggtataacagagaaaagcctatagtagttaaaagaaaaaaggtcacaggatttggggtctgcataaatctcaatttacatctcagttctgcaatatacttactggctgtgaaccctgaacgagttacctgacacccagttcccttatgtgtaaagtgcaaaatataatacctcaaagacaaggatgacggtcaggcgcggtggctcacacctgtaatcccagcactctgggaggctgaggcgaatggatcacgaggtcaggagttcaagaccagcctgggcaacagggtgaaagcccatctctactaaaaactacaaaaaaaaaaaaaaacttagccaggtacagtggcaggcacctgtaatcctagctactcaggaggctgagacaggagaactgcttgaacctgggggcagaggttgcagtgagccaagatcgcgccactgcactccagcctgggcaacagagtgagactctgtctcaaaaaaaaaaaaaaaaaaaaagacaagaatgagaatgaagcttaaaccagcaaggcaggcttgcaactaacattagtcagttgatcatggcatattatccatgcagacacctgctatccagctcctactggccataggttcaaaccccagggcctgccttgagtctgagaatctgggagggaccttggagaccatctatcctgtgggttgcccaacatcattttcaaagcaatcaaatcctttttccaaatgggatcttgccctgctaaccctaatagttactacctatgtgaactgaagatgataatgactaaaaggaaattaagaaaaagaaaaaagactaagggcagaggaagaagggaaacgggaggggaaggaggtagataagagaagagcaaagaatagaaaaaacagggattaggggagagaatgctgtatgtgaagtttccctatttggggtgaggcctgaagcccctaagagaggaggagatttgaaaaccacagacagagcccagtcctttcatgttatagcaggggaaatagaaacacataaattttgttcagctgcctatagctttctcctcctgtggttctgctcagtttccagaaagcctgggtaacgtctgaatcctcctggaatctctcttcttccttctggtacggtgtgggccatttcaaagctcaggcaggtggcctttcctagagggagcagagacagcgcagctactggatgagctcctaggcacctttcagtgtgggagcctcaagaagtgaaagaaaaaaagcaaatctaaaggggagcaaaatagcatctcaggattaggcaagagggtgggtggagtaggccggaggcaaggagctctagatgtttgttggggaatgaggtgtttttcaattaataggtatataaattgtgagcaaggtgaggaataaattacatacagttttggggaaaagtcaacttgaatttacacaaatcagattatgggaatggtgtaatggttatagctaactaccaggaatacatcattagggatgctattaatataaaaattaattttgttttgacttatccttttactctaaactctgctcagaaacactagattcttctgttactcatgtaagctgctgtccttgcatctttgagctccaaaagtgtagaggagacttcttgattaaaaaagttaagtaaacaatgagcaagcaaaattaagaatctcaatatctctgtctccaggtctagagtttttatatatgatatatgttattgctgttcctgcctttcaaacaggtggtacaaacacccagcagagatccatgaagagagtgcattaacaggaagcaatagggcaaagttcatagagatgagctttagagaaaagcgggacttaaatagagcctgatgtttcttggggcaggctggggtgctgtactatgggcatcttggcaggatgattctccagtggagggagtgtaccgtgcaatccagaccatttagcatgtctgcccttgacatgcctactgacggccaataacaccccctaatcaacgtgacaacacaacaaaaagccgcccccctatacatttccaaatgcctctgtagcagggaggtaaaatcacccccactgagtaccacgagataaagtaggcacaatgcggccaggtgcaatggctcacgcctgtaatcccagcactttgggaggccgaggcaggtggatcacctgaggtcaggagtttgagaccagcctggacaacatggcgaaatcctgtctctactaaaaatacaaaaattagccaggcatggtagcacacacctgtaatcccagccactcaggaggctgaggcagaattgcttgaacccaggaggcaaggttgcagtgagcctccaagcaaaactctgtctcaaaaaaaaagtaagtaagtaggcaaaatgggcagaaagcataagagataaagtgggagtggaactggcagacagaaacagggccatcctttaatgactccgtcacccacaagatcaagtccaaagtccttaccaaataatgcccttcaggatttggccctgcctacccccagctgtctcaactcccaccttcttactaaggcaccctacactccagccttcccaagtaatttgtggttttcctgacctgatgcactgtgttcacggtctgtgcctttacatgcacacttcgctttgcctagaaggcatttctcaaggcaaactcctactcacacatcaacacctagctcagaagtctgggaagccaaagaaagacagccccaagtcactcagctcttctcttcctctcagcacttcacaaactcctgggtaacactggtatcttctctgtattattccccaattccatcccattatttggatgaagagttcaataaacattttctgagtaaataactctacatgaaaggttttaaaggctaaaaagtgatacaagcaaaagcagacaacagatatttcttgttactgaaataatctattttctcaactctgatctttggtggagcactacttaggaaccagaaaaactggggttgcttcatcacttcctagctgtgtgtcattgggcaagttaactaacctctgtgtgcctcaagtttcttcacttgtggggtaaaaaacaaacagaagttaccacttttgctgtacagttatatggcttagcattaatgtatgtaaaatacaaaacaagagtgctgaaaaagtggtagttctactagtctgctataatcacaataaccttaacaagacaggaggacattgtaccatcaggaatgtgatcacaatgaaattttagttgaaaccatccccctcttttttcttttattcattcagctttcccaagttgaacatccccgctttaaaaaaaaaaaaaaaagaggccaggcacagtggttcacactgtaatcctagcactttgggaggctgaagcagggggatcacctgaggtcaggagtttgagaccagcctggccaacatggcaataccccgtctctactaaaaataaaaaaattagccgggtgtggtggcacacacctgtaatcctagctactcgggaggctgaggcaagagaatcacttgaacccaggaggcggaggttgcagtgagccgagattgtgcaactgcactccagcctgggcgacagaacaagactctgtctcaaaaaaaaaaagagctgaaagtcaacaaatataatggcttgtcagctgcattctgtttccctcctatagtactcaataccaatcccttaatgagtaccatctcccttggctcctttgataacgtgcactcccagttctttggtctctctggccacatttcctctgtcctcttccataacttgacctttattgacacagtaaaggcaggcactcctttggcttagttctcagatgtcttatccactcttaaggcttcaattaatatctctatgaagatgaccccatgagctctcttgtcgcattcagaaacagcatttcaaactcaattaaaccaaaatagacacttgctatcttagtctaagatgaccaagcatactaagagtgtttcaatctctcctcctctccctcctccccgtctacactgttcccttatacatctgaccagtcatcagtttcctcttctttgccagagttacctggttggtcctctgttctacttcagtggttcttaatgtttccaggataatggactcatttgaaaatctatcaaatgctatgtattttttaaccaaaaagataaatatagaaaacatataattacaatttcttttttttttttttttgagacccagtcttgctctgtcacccaggctggagtacagtggcgcgatcttggctcactgcaagctctgcctcccgggttcacaccattctcctgcctcagcctccccagcagctgagactacaggcgcacaccgccacggccggctactttttttttttgtatttttagtagagatagggtttcaccatgttagccaggatggtctcgatctcctaacctcgtgatccgcccacctgggcctcccaaagtgctgggattataggcgtgagccaccgcgcctggccatgattgcaatttcacctaaccaatgacccagataagaatctgtgctcatccactcaagattttaactaccatttacacaaattttcatctccagctcctgctcccctcttacaaattttaagatggtttctggatatagcctgaatggcctacaggcattacaaacttaagttcaaaccagaactatttccccctgacaaatctgctctaacagtattcctttacttggataatggcaccaccatctcccaggctcccaacctagaggcctcagaatgaacaaccgcccatagccaatcaaccagcaagccttgttctatctcagaaatccctccaaatccaaatcccacctctcttggtctcttaccctttaaggtctcataatcctttgattccactcagacttgccatgattaaaagtctttttaccactcttcccacaagggtccctgttactatttctgtcaatacaaaactcctcacctccatctgctaccttccgctgccactttattactgcacctctaggtggttaggctttcctaatttattcctccactccggttcttcttccttcattcccactagtgttgatttgtcttcccaaaaaatttcaaaattgaccatgtatgactgcctctttcaaaaaaaggccgggcacggtgactaaagcctgtaatcacagcactttgggaggctgaagtcagggggaccacctgaggtcaggagtttgagaccatcttggccaacatggcaaaacgctgtctctacaaaaatacaaaaaaaaaattagctgagcatggtggcacgcgcctgtagtcccagctactcaggaggctgaggcaggagaatcgcttgaacctaggaggcagaggttgcagtgagccgaggtcatgccactgcactacagcctaggcaacaagagtgagactccacctcaaaaaaaaaaataaacaaataaataaataaataagatgcttcctccactgaacaaatatacagtcaaacttagttttgcctttggagtcctctacagtttgccacctaagtacatttccaagattagattccacagctcaagctgtcacttgttcctattatctgcatatcaaaatcacacccactcttaaaggcccaactcaaatcccactcttcatctttacatcctctacataatcattaggaaaggactctaaacaaaatagtcacaattcctaatgaactgataaggaaacagaagggggtaaatctaaaaaatggctagaaatccataaatccttttggaagcattttttaaaagatcaccattcaaatattagtgaatatttcaacgagccctccataaatccagcactgttagccaatatttattaaatgctaataatgtgcaatggagaaggttaacagcagggtatttcatcaacctgataaaaggctataatctggatcttggattcaaattccaattacatttgtatttcacttaggaaacgacaatcacaaaaaggggacttagcatttcaaatggagagtcagaaggtcaaacaagcctacagcagtgacagaagtagttcccacatctaaacaacttcagactagtaaaaaccttatcagacaggagaaatcttatcagatgggggtatcttttcaattgacatgtcctaaacgtaaaatacttttttcagtccacattttagataagctaatcttgttaaaagggccaaaggatgtgatgggaaattctgagcctctcataatgagacatgttcactggcacacttcccagtgagtgcaacagcaatgcgatgtgtggtggagaaatgatgctactggcaatactttctctccattactttttagggccttatttctttcaggctcgacctaatttaaattctgtcttggctcctaagcctgtgagttcacattaattttcacagttgtattcagcattttgctcctaaacaaagtgaaaacattaaagattcaattaaaatctctttaaaaagaattttaactaatctttctatctagctacaatacttggtaaaacataccttctatggcatttctaaaattatgattgaaatttgaatacatttccgaaacagacttatatttactttataacagtaagatacagaaaattctgcaagtattaattacactaaggaacgcagagtgttttcctaaaaacagctgaaaagagctacagtgtgtctagtagaatctcagtctacaatcttaataactctagttctatgacctcaagaattggcttcacctcgaaatactttctcacctgaaaaaaggaataacaccatcttttcctccctcaatgtggctgctcaaataaaatgaaataatatatgtagcacagtacctgccacgaagggttcaataaattattagtttactttcttcagtcaacacaaaagacacattcacaagattcagatttaaggaaatctatttccacaagtcctcaccagcacaaaatgctatcgctagtttgctctaataaaaactaccatcagccgggcgcggtggctcacgcctgtaatcccagcactttgggaggccgaggcgggcggatcacgagatcaatacatcgataccatcctggccaacatggtgaaaccctgtctctactaaaaaatacaaaaatgggccgggtgtggtgtcgcgcgcctgtagtcccagctactcgggaagctgaggaagaagaatcgcttgaacccaggaggcggaggttgaagtgaaccgaggtcacgccactgcacttcagcctggagacagagcgagaccccgtctcggggggaaaaaaaaaaccgtcactatcatttcacttttctaagggacctgaatcaagatgagggagtctacgtgtgattctgcaagaactccattaaggctgcatacataatgaccactaaatcattaacaggagtccatagcaattgggctaaaacatctgggagcatttatgctggtaaaagagctcacttgggggctaaaaaaaaagtcaaattaggcccaactctaaacggatctttaacaaatcaagagagtaatgttagtttatccttcctgaaacgccagcagtacgatattaaaatccacttagaagtaaaaacttcaagacggaaatatgccaccaacactggcgtcagtaatccattttagaaagcctgcgcggagaccaccattagcaccgctgaggatatttaatgaaagccgttggctgcaaacagaggcgaagagagaaaaacgattatttcggtgttctgcacacacgcggaggcaaaacgctttcaggacctcagcagccaccgccgccaacaccgacaagcatctgatggaattcacagttttacaatcgaaagtccaaaagaaggccatgatactagcaaattgaggggtggggacccttccgttgccttcccgagggtccagactttaaaggccgcgctgcgcccggggccaagggtccactagtaccggcctacgccccccgcgccactccctgagccccttcccgagcgaccgaaggcccgggaaccgcgagcaacaacacctaaacctcaaccggcccggggccgcgcccgagccctggcgcgcggaccgcggtgaagtccgggttcgaggtcgccgcggcgcctgaggccgaggcgcgggcgaggccgaggctgcgtccgctgcggccccgggcggtgggggggccgggcgtggccggtcgcggacactcaccacaccatgccgtaggcgccctcgccgatgtacgagaggttggtgtagcgcggccccacgtcgaacacctgcccgcggaccatctccgggcccgcgcccgccgccgccgccgccgccatgttggctgccgggccgccgccgcctccgccgcgctgagctcgacgctcggcggccgccgctcagctcttgtcgcccctcccgcagggactgcgccgccgccggtgcagccgccgacgctgaccgggaggaggaaggaagacgccgagcgggagagctgaagagccgacagccactcggaccgattgcctgcctgcctgccagactgacgggcgggccggcgggcgggcggagggaggggc

SEQ ID NO: 1859 - DNA, 98652 bp, Homo sapiens
tatatgtaactttctaaataatttttaattctaaatttaaaaaaataccttccaataaggagcttggaaaagaatacaaaataatggaccttgaggaacataatattctagaaacaaaaggcagcgcctcccttgctagagctcactgtattaaactccaggtacctgacaaatttaagatctgtatcctggctggaatctagcagtctcttcaaaaattagttctttgagcttttccttaggcaagtcatccaattccatgtcgaacttgaatggtgcttcggcgatgggctttaaaagaaaacaaaacatttaacagtcaaagttgttatgggtaaggcagtaatttactgattcataaaatgaccactgctcagattctgaatttacaacaggactgatgtctcataaaaacttaagagttgatggccgggcgcggtggctcacacctgtaatcccagcattttgggaggctgaggcaggcggatcacttgaggtcaggagttcgagaccagcctggcccaacatggtgaaaccccatctctaccaaaaatacaaaaaattagccgagtgtggtggtgcacgcctataatctcagctactcaggaggctgaggcaggagaatcgcttgaacccaggaggcagaggttgcagtgagctgagatcgtgccactgcactccagtctgggtgacagagagagactgagagttgtgcccacactcctcaagttctcataaacacttagcctgggagcaactgaatctgtttcaagtgtttttctgaacttaccacaaatcccagaataatttttaaatgttttaaggcagtgaatgtcgaaataagagaaatgtgctgctgttggggtggtggtacgtttatccaatcaacacccataatactaaaatacatgcatttcattaaataaatcatggtatctttgtatgaaaaaacatcttagagctgttaaaaattaagctgcaaggccaggcgcagtggctcacatctgtaatcccagcacgttgggaggccaaggtgggaggatcatgagaccagcctgaccaacatagtgaaactccatctctactaaaaatacacaaaaattagctaggcatggtggcaggcccccgtcgtcccagctactcgggaggctgaggaaggagaattgcttgaatccaggaggcggaggttgcagtgagccgagattgcgccacggcactctggccgaggcaacagagcaagattccatctcaaagaaaaataaaaaaaactggccaggcacggtggctcacacctgtaatcccagcactttgggagaccgaggcaggtggatcatgaggtcaagatattgagaccatcctggccaacacagtgaaactccgtctctactaaaaatacaaaaattagctgggtgtggtggtgcgtgcctgtagtcccagctactcgggaggctgaggcaggagaattgcttgaacctgggaggtggaggttgaagtgagccgagatcacaccacggtactccagcctggcctggtgacagagcaagactccatctcaaaaaagaaaacaaaattaagctgcaaggaagattaataggaaaatgcctatgttgtgtcaagagaatgaaaactattttatttttaaaatttagatacagaaatacaagactgagaaggaaatactccaaaatgttagtaactgtaacaagattataaagctacatatttgtagtatgaaaaaaatctctcctgtattttcttacaagtttgcttttctctttttttttctatacaaaacctcgctttgttgcccaggctggagtgcagtggtacgatcccggcttactgcaacctctgcctcctgggttcaagcgattctcctgcctcagcctccggagtacctgggattataggcgcctggcaccacacttggctaatttttgtatttttagtagagacagggtttcactatgttggccaggctggtctcgaactcctaacctcaggtgatccaccaaccttggcctcccaaagtgctgtgattacaagtgtgagccaccatacctggccccatttttttttttgagactgagtctcattctattgcctaggctggtgtgtactggcatgatcttggctcgctgcaacctctgcttcccggggtcaagcaattcttatgcctcagcctccagagtagctgggattacaaacatgtactaccacgcccagctatttttgtatttttagtagagacggggtttccccatgttggccaggctgggcttgaactcctgacctcaagtgatcctcctgcctcggcctcccaaagtgctgggattacaggcgtgagccactgcgcccagcccccattttaatttttaaccatactccagaaagctatttaagtaaaatataaactgtctatttagatcaaagaaccccatacacactcagtgacaaactgattattattttttagagaaagagttttgctctgtcaccgaagctggagtgcagtggtgtgatcacagctcactgaaacctcgatctcctgggctcaagagatctttccacctcagccttctgaatagctgggactacaggtgtgagccaccatgcctggccacattttgatttttaaatgcccgtgaactaatgcaatgttacagaactaagctgatgataataccagctgtcaatcagtgaatgcctagaatctcacctctcacccatgtaatcctcacatggggcctttagggggaggaagcacagaccccaaactctgcactaagctttggccatctgaaaggggagaaggactcatgtccagaagaataaatagctcagcccgaaggagggctatgcatctgggatcacaggaggtgtcctacacgcatcacccaccaccccagccagctgatttggactcggaagcttgggaaatctccagcccactaagcttgtaagagccccaaacctgtattctctcctattctgtgttactggctatgttgtaggtatttcacaagctgcctaacttgttgctggaggcagagagatggatgtggaagggaaagctgattctttcaaaaataggagggtaaagactattctctgtgcatatgagcctcaactacaacaatccaaacttttggttcatattgcatttttctttgttatcctccagagaataaagttaaaattgaaccccagagacaccagagagccaaggcactaggactgtcttggggagaacatgacatgcagcatcttctacctgaatgccctgcctgctctgaagagctgccatatccactctggcctcatcacttcttacaacaggctctcgtgtccttgtctctagggaatagcacacccgacatggagtcgccaagccacagtggaaactgtccaagttgacttccctccccactctgtgtgctgtccctgtcagcaggctgcccacctcctctccaccccggccatcctcagggccagcacttcacttcaggtgtctcttcctgtcacaccatgacaatggcctccagtctcagacccatgccctctgtgctccatactggtgcagctgtcccctttatacatgcgtttaccccgcccctacctgttgcaggtggcctggaggaagtcttctgagatagacagagttacggggggagggatttcaagctgtgccccacagcactcgtcctcaaggcaaaggtgggcttgttggaagaaccgggtatggcagcaggtatatctcaggaaaatctaagcaagatatggttggtccactgctggctgatctatgtccctgaagcagcagccaggaacatgagctcttacctcgtcactcgggtcgtaatactgctccagatatgggtgggccagagcctgttctacttcaatcctcttgtgtgggttgaatgtcaacattttgtccaataagtccagagctataaagagaaaggttttgcagtagtgagagcagaagtagtcacagaaatacttcaatttcctgtttaagtaacttacccacaaaacaactgagctaagcatgactacagagagagcagccagcacaaagggtgctgactatatctccaagcctcccgagactgtgaacatagggaccgaccatctgacaattgcagaccgcaaacaaaaacactggcactacttaatgaagcgtcttttctgacaatgatcatttcttttttttttttttttttttttttttgagacggagtctcgctctgtcgcccaggctggagtgcagtggtgcaatctcggctcactgcaagctccgcctcccgggttcatgccattctcctgcctcagcctcctgagtagctgggactacaggcgcccgccaccacacccggctaattttttgtatttttagtagagatggggtttcaccgtgttagccaggatggtctcgatttcctgacctcgtgatccgcctgcctcagcctcccaaagtgctgggattacaggcgtgagccatcgcgcccggccagcaatgatcatttcttattaggttatttgtaggtaaaggtcaacttcatccatctgcaaattagcacatactattaagccctcaaagtagaatgataaaatatcattatttcttcttaaaacattttaaaatttaattgtatgtcccttctcaccattcctaaaatgataaacaatcacgtaaaatttggtacaatttaatactcatgatcagtttaaggaatcacttctagccactactttcaaaaagtaagttttcactatttactaagaaaatgtttcctaacccttaagaacaatcagtagaccttccgaagggattgcttgggtgctggggggaggtgggaggcatcttgctgcctgaggtcactgaagggctgtgggtgtgtatttgtgctcagccccggccaattttgacctcccttgttgcaacccctgaccttaagacaacaggagatgataaacatggtaaaccacatgctggacataatgagaaattccgcatagaaaacatttaaaagttatgtatgtttctatctataatcttttcaatacatacaagtgcactttaggaaattacggaataatgatattttgttttatagcctagataacttttcagagtagagaatccagacaggttttgctgtgactgaaggagtgtctgcgcagtagaagaggtggtcatgcctgcagctgtgaccctgggtctgtgggcacacaaactggctaggtttaggaagtggccctctcaagggtcaggacaaagacgcatgatggtcaagaacccaggaatctctggttcaaatcctacttccaaggaacacttgtagatatgtgtgcaagacacacaacccttgccgaatcttaagattcctgtggttggctgggcacgggggctcacgcctgtaatcccagcactttgggaggccaaggcgggcggatcacaaggtcaggagatcgagaccatcctggctaaaacggtgaaaccccgtctctactaaaaatgcaaaaaaaattagccgggcatggtggtgggcgcctgtagtcccagctacttcggaggctgaggcaggagaatggcgtgaacccgagaggcggagcttgcagtgagccgagattgcgccactgcactccagcctgggcgacagagcgagactccgtctcaaaaaaaaaaaaaaaaaaaaaaaaagattcctgtggtctataatataggtaataaatcccactttgcttcctgctcccaaccagccctccccacatagaactcacagacattttctcaaggactttcttgaaactagattaagtcatttggcttttcacccaattagatactgtctgtgctaagaaaagtccagaaggcctggaccacaataagattctaacagtattacttctaaaccactgggggcagaagggtcctactcaaacttgttcgtattaagtagacaggcactccaagccaactggatgttttgcagcttaagcatttctaaaacagatccattagttccttaaagttaaataaattctaggcccttaaacctccaggcataaatttcaaagaagacagctttttaaaaaaagatttgctacttgaaaagtagctagatctccagccttctgttactgcaagtgctatttctacattattcatagctacagaaggagaaaaggagagaaccgggaagcagctggcaggtgcggatcccacagtcaagaatgtccggactccctcctcccacgccacatgggcattcattggtaacactcagatggtgtgaatcatggctgcctgtgtggatgcttacttggatacaggttttatttcccctaaaagactggaagtccctttgaggctagtattactcctgaccacaaatcctgactttccctagtgccttccagaatactacattttctctttctgtgttttttaaaacagagtttggattttgttctatggcccaggctggagtgcagtggcatgatcatagcttactgcagccttgaactcctgggctcaagcaatcctcctgcctcagcctctcgagtagctggtactacaggcacatgttaccacacccagctaatttttttaaattaatttttctgtagagatggggagtcactatgttgcccaggctggtcttgaactcctgggctcaagtgatcctcctgcctaagcctcccaaagtgctgagattacaggtgtgagccactgtgcctggcccttgtctttttttttttgaaacgggagtctcactctgttgcccaggctggagtgcagtggcgctgtctcggctcactgcaacctccacctcctgggttcaagcgattctcctgcctcagcctcccgagtagctgggattacaggtgcctgccaccacgccaggctaattttttgtatttttagtagagacgggggtttcaccatgttggccagcgtgttctcaaactcctggcctcgtgatccacccgccttggcctcccaaagtgctgggattacaggtgtgacccaccgcgcctggccagcctggcccttctctttaacttcaaatagtatgtaacaacctgattccaaccctttcttctaatccatcatccttttttccttcttgccctgtcctggacctggggaaagccattgactggctctccacagtgcctcttcatgtctatcttgcctgcctcgtgaaactctgaccctgaatcaatgctgcaacctgtcacttccatcctcaactcatgtttctgtgcggggccagagaaaagactgaactgtgcaaagtgtgccagtgcgacagtgcttctcaaactttctgatctcagaactctttatactcatcaaaactgagggacgatttaaaaaccagttaattctgctcatagctcaaatagttacataagtgcttttccctgagaaaaccactgcattcagtatgcagcagaaatgctatacgtgtttgtcacacagacatcgtgaagacatgtattaaggatggatttaatatggtgagtactttttactggcactggttttgagcagtgggggtgtggcagtgcagagctcagtaacctctctagttccactgccttgacctgcctgtggtgctggggactctgctcatcattgctcctgtgccacaagtgctgatggcaacatagagagcagtgtgagtaactctttaagaagattattaaaacagctttaaccttgtggacaccctgaaaggatcctggggatctcaggtgtttaaggagcacactatcagtaactaccgttctacaaaaactcaagattttcagcctcatcaaggccctcaacagcttctggaaagctttggtcagtcccctcctctactctcagatttcacccaacttgcacggcttgaatcatgaccttcttgctaactgaccctcattactctcagcatatcttcttgagggtgctacagagaaaactgaggcacccaagagtgatcttcgcggaattccctcctagccagattcacacacacccttactgacactgccaagaaagatatcctctctctactcaaagtcaattctccccaacttgtggcctggtccacaaccccttcccctcatgtggaccagtcgtttctgtctccactttccatttcaaatttctcacttccattcactgtttcaactcctcttgcatggtcaccaacaagcccctcattggaaaatcaacccacattttccaatctatatcttgctagacctctctgctgcatggacactgttgtgcatgcctactttctcaaaatgccatcttctgcttctgtgatatcacatggcactagtttcttttctttgtccctattccatcactggctgaaggtttgtgttctccaacttctcacaatctcactcttcttcttcttcttcttcttttttttttttttgagacagggtctcactttgttgcccaggatggaatccagtggcctgatctcagatcactgcaatctctacctcctgggttcaagcgatcctcctacttcagcctcccgagtagctgggattacaggtgtgtgtcaccacatcaggcttatttttgtatttttggcagagacggggttttgccatgatgctcaggctggtgtcgaactcctgggctcaagtgatccacctgcctcggcctcccaaagtgctgggattacaggcatgagtgaccgcacccggccacaatctcattcttctatcttttcaatctcttgcaagatttaaaagaccacaggttaaatacctcccaaagctatattgagctgagggtgaccaagctgtagatcaataaatccaagtttgtgtaggtaataaaatatatagcctatgattccatttacaatcaatgtatgtatctatatgtgtaataaagtctgcaaggttttcaaacattaggttatctgagaaatggagacagacttcttatagaaattgcgttttttaatttaaaaaaaaaaagtgggggccaggagtggtggctcacgcctgtaatcccagcactttgggaggctgaggcaggcagatcacgaggtcaggagatcaagaccatcctggctaacacggtgaaaccccgtctctactaaaaaatacaaaaaattagctgggcatagcggtgggtgcctgtagtcccagctactccagaagctgaggcaggagaatggcgtgaacctgggaggtagagcttgcagtgagccgagatctcgccactgcactccagcctgggcgacagagtgagattccatctcaaaaaaaaaaacaaaaaacaaaaaaaaaaaaaacggggggcggggggggtccgggtgtggtagtggcaggaggatcccttgagtccaggagttcaagacaggactgggaaacatagcgagaccccatctctacaaaatttatttaaattagccaggcacggtgcttgcccgagcccaggagttcgaggctgcagtgagctgtgattgtgccactgcactccagccttccagcctgggcaacagagggagaaccctgtctcttcaggaaaaaaaaaagggggggggtgggggggagaaaatagaattccttatcttccctcactctcgggatcacctgctggttgtgcccaccagcatccactgcccctctaatccatccaacagtgtttgctataggggagcgctcaggcttgcccacgctcctgggctgtgctgtgggaatggtgacactcactgggccatattcacctgagtccccttggccacagtgactgctcagggataggcatggcatccaagctgagcacaaagaggtgatgagagtcagcctaagtcctggctgcagtgatcaggtcaagtgtcttactctcatcatgaaaagagaggctgactgacagacagcccagagcaaggcaaaactggatgataaagaagtccagattctagacacagtgtctgtgcccatcaatccacatgtgactgaacttttcagttatcagagccaataaagctctttcttgggccagtaagttcttgttatgtggaactgtggaactgaaaagacctcagacggttgacccaccaaacccggccttctggtctgtgtgaatgactcacccacattcccttgctccccaagcaccatcattcaatggtaaccactgcttatcttttcacatatgttgttgaattcttttctatgcattttcttgtagaaggctgaaatcatattatgtatgacaaatgctgttttattttcccttagtaaatactgttcattagcattttcccccactatcaaaactttgtaaaaaaaatcacttttagcggccttaaaatattcctttaagtagatgtctcataatttactcagccatttgattaacatttggcacttaggttgtttctaatgcctaacaggtgccttaaattaaacacagactaaaccaaattctcaactgctgtcacccaaactgctcctcctatagttttcctcatctcagtatttcctgtagactgtgtgttcttgtcctttgctcatttatttatacactgtggtcttagatttgtctctgctctttagatactaataatattaataatgaatctaaagttaacaataattccttaactcttttaattatcctatgaggtgggaactacaattgtctcaatttagggttgaggaaatcatgaaacagcttaaataacttgtccaaagtcaaaaatccaagtagcagaaccctagtttgaactcaggaggcggactccagagcaccgggtataaccactgtactttgctgccttctacagaacagttaggagaaggtccagtgttactcaatttagaacattttagacctattgtccacacctaatctaattttatttagcttttaaacttttatatgtctctctttccttgatgtttgttttaaaacataggaagtctttctccatgcagagatcagaaaaatactgaatactctattgttagtttctcatgatataaattttaaataagtatcaattcttttagaattcattttgatgtgtaatgatttaaattgattttcctccaaatagctattcaactagcccagtaccatctgctgaataataatttcttctccctcactgaagtcatttgagagaatcgtaagctaagactcctttaaagaaaaatctacaatagtgtcggtttaagggatacagcaatcaaaaatttccaacaaacatgaaaaaatttcaatctcactcttaattacagaaaaacaaattaaatgccactcccccatttggttggcagacctaaaagttcaatacccagaattgctggaacaaaagacatgtgacagaattgccagactgtcctctacagagactcaaccagtttacactccaccagctctctccgaaaacacccttttccccacagccttgaccacacagtagggtgtcaaactttgatgtctgctactctgttgaggagggcgttaaaaaaaaaaaagaattactgacttttcaatgtttgtatcttgtataatgagtaaacatgagtaccttttatatatttaagagctgtttcatcttccttttctgtgaactctcattaaaaattctagcttgtaagttttttaatctcttgagttccctgaggtcttccattcatttcctgacaaatctagactatcagttctgtaagaaagctctctctctcttttttttttaatgagtcctcagacttcccatctccaaacaggttcttaatccctcttattgctggtactatgtatgtccagggccttagaagccttgatggcaccaaacagacactcaaatctatccactgaatgaatgaatttatgtatgttttcttaaaaatataaaaacaactggctagatgtggtggctcatgcctgtaatcccagcacttttggaggccaaggcgggtggatcccgaggtcacgggatcaagaccatcctggccaacatggccaatatcttggctaaaaatacaaaaaattagccaggtgtggcggtgcgcgcctgtagccccagctactagggaggctgaggcaggagaattgcttgaacctgggaggcagaggctgcagtgagccgagattgcaccactgcattccagcctgggtgacagagtgagactccctctcaaaaaaaaaaaaagaaaaaaaagaaaagaaaaataacagtgctgggtgcggtgctcacgcctgtaatcccagcaccttgggaggccaaggtgggcagatcacgaggtcaagagttcgagaccagcctggccaacatggtgaaaccccgtctctattaagaatacaaaaattagctgggcatggtgacatgtgcctataatcccagctactcgggaggctgaagcaggagaattgcttgaacctgggaagcagaggttgcagtgagccgagatcgcgccactgcactccagcctgtgtgacagagtaagactctgtctcgaaaataaataaataaataaatacatacatacataaaaagcaaaaattagccaggtgtggtggcacgcacctgtaatcccagctattcaggaggctgaggtgggagaatcgcttgaacctgggaggcagaggttgcagtgagccaacatcgtgccactgcactccagcctgggagacagagcaagacgctgtctcaaaaaaaaaaaaaaaaattagccacgcatggcggcacatacttgtggtctcagctattcaagagactgaggcggaggattgcttgagcccaggtggcggaggttgcagtgagccaagactgtgccaccgcactccagcctgagtggcagagtaagaccttgtctcaaaacaacaacaaaaaaacatggtagaactgttgaagtgatgttctgagatttggttccaagagaccttgcagcataggctcttgctcttttggaatatttctgccatcatgagaagccactgagtctagtctactttaggataaagaggcaactgtaggaaggaccaactgttaagacgttaaaccaccacaattgagggatggtgaagggagccagcagatgactgcagtgcatggctgaacccaggtgggctcagcagaactacccagctgtgccagcccaatggactcatgaacaaatgcatggctgttatttcaagcctgagttttggagtgtttttttaatgcagcaataggtaactgatgtaaactttaatgtccaatgtgagtctggctgaaggacacttatgggtcacatccctacaagggaacaccatgtagtcactctttaacaactagaggccgggtgcagtggctcacacctgtaatcccagcactttgggaggccaaggcaggtggatcaactgaggtcaggagttcgtgaccagcttgaccaacatgatgaaaccccgtctctactaaaaataaaaaaaaattaggccgggctcagtggcttacgcctgtaatcctagcactttgggaggccgaggcgggcagatcaggaggtcaggagatcgagaccatcctggctaacatggtgaaaccccgtctctacttttagattgtgtttttgtttggttttgttttgagatggagtcttgctctgtcacccaggctggagtgcagtggcatgatcatagctcactgcaacctcaaactcccgggctcaagcagtcctcccacttcagcctcctaagtagctgggactataggcatgcaccaccacatctggctaatttttgtattttttgtagagatgggttctcactatggtgcccaggctggtcttgaactcctaggctcaagcagtcctcccgcctcagcctcccaaagtgctcggattataggcatgcgccactgcacccagtcagttttcttttatagacgattgtcgatagtacctgcgtcacaggattgtgtgaatgttcataccactggcatttgtaggtctaacatctttccatatcttgctctgttgcccaggctggagtgcaatggtgcaatctcgcctcacggcaacctccacctcccgggttcaagcgattctcccacttcagcctcctgcgtagctgggattacaggcacctgccaccacacccagctaattttttaaaatttttatttatttatttatttagagacggagtctcgctctgtcggccaggctggagtgcagtgacaccatctcggcttactgcaagctctccctcccgggttcatgccattctcctgcctcagcctcctgagtagctgggactacaggctcccaccaccacgcccgtctaattattttgtatttttagtagagacggggtttcaccatggtctcgatctcctgacctcatgatctgcccgcctcggcctctgaaagtgctgggattataggcgtgagccaccatgcccagcctgtaattccaacattttgggaggccaaggagggtagattgcttgagcccaggaattcaagaccagtctggcaatgtgatgcaatactgtctctaagaaaaatacaaaaaattagctgggcgtggtgacatgcgcctgtggtcccagctactcaggaggctgaggtgggcagatcgcttgagcccagggaggtcgaggctgaagtgagtcgtgatcacgccattgtactccagcctgggcaacagagtaagaccccatctcaaaagaaacaaagtaaggccaggtgcggtggctcatgcctgttaatcccagcactttgggaggccgaggaggcagatcacctgaggtcaggagattgagaacggcctggccactgtgacgaaaccccatccctactaaaaatacaaaaaattagccaggcatggtggcatatgcctataatcccagctacttgggaggttgaggcaggagaatcgcttgaacctgggaggtggaggttgcagtgagacaagatcgcaccactgcactccagcttgggcaacaagagtgaaattctgtctcaaaaaaaagtaaaataaaaacaaaaaacaaaatgaaggccgggcactgtggctcacgcctgtaatccgagcacttcgagaggctgaggcaggtgcatcacctgagatcaggagtttgagaccagcctgaccaacatggtaaaaccccatctctattaaaaatacaaaattagctgggcgtggtggcgcatgcctgtaatcccagctacttgggaggctgaggcaggagaatcacttgaactcgggaggcagaggttgcagtgagcccagatcacgccattgcactccagcctgctgggcgatagaagtgaaacttgaaagaaagaaaggaagaaagaaaggaggagaagggaggggagaaaaaagaaaatgaaaataagcagccaggcacagtggctcaggctgagacgggtggatcatgaggtcaggagttcaagaccagcctggccaagatggtgaaaccctgcctctactaaaaatacaaaaattagccaggcgtggtggcgggcgcctgtaatcccagctactcgggaggctgaggcagaaaattgcttgaacctgggaggcagaggttgcagtgagccaagttcacaccactgcactctagcctgggcgccagccagagtgagacgccgtctcagaaaaaaaagaaagaaaaaaaaatgaaaatgaaaataagcataaaaaaagaatcagaaatagtttgatgcaactcatgattacagacaagagtaaggaaacaaacaggagaggaacgtttgggagtaggcctatttattacagttttgttgtttttttttttttttaagagataagagtgtcaccgtcagcgtggagtgcaatgatgcaatcacagctaacagcagctttgacctccttgggctcatgcaatcctccctcctcagttccccaggtagttcagactacaggcaggtactactacactcggctgaattttaagtttttaatcttgtagagatggggtcttactatgttgtccaggcaggtctcaaattcctggcctcaagcgatcctcctgcgttgacctcccaatgggctaggatcacaggcatgagccacattaccaggcctaatgatgcagctttgttgcttatgcagctctttaaaaaagtgactcaggaaataacatttagtaacatttagataacatgcttaggtggtataatatacaagcaaatctaatcagtaacatgtattatgcatgtgacattctagctaaaaatatcctaccatcaaaatacattacaggccgggtgtggttgctcacacctgtaatcctaactcttcagaagcccagggtgagcagatagcttgagctcaagactttgggatcatcctgggcaacacggcgaaaccctgtctctacaaagaatacaaaaattagctgggcatggtggcacaggtagtcccagctactcagatggctgaggtgggactacctacctgtagtcccagctactcaggtggctgaggtgggaggatggcttgagcctgggaggtggaggccgcagtgagcccagattgtgccactgtgctccagcctgggtgatagagccaaacccgtctccaaaaaaaaaaaaaaaacccaacccccaaaaaccggtcaggcacggtggctcacgcctgtaatcccaacactttgggaggccaaggtgggcagatcacaaggtcaggagatcgagaccatcctggctatcatggtgaaaccccgtctctactaaaaatacaaaaaattagccaggggtggtggcgagcgcctgtagtcccagctacttgggaggctgaggcaggagaacagtgtgaacccgggaggcggagcttgcagtgagccgagatcacgccactgtactccagcctgggcgacagagcgagactctgtctcaaaaaaaaaaaccacaaaaaacaaaaaaaacaaaaaaaaaccacaaaacaccccaaaaccaaaatacattatataattacaaccacacagaagcttgcacacattagtgcaaaaaaagtgaaaggttactgtgggatcctggtgatcaatatcttactcccttaccattcctcccatacttcttaactgtctacaatgatgaaattcttctacctttatatgaaagattaaaagaaaatttctcccattttcaaaagaaattcatttctaaacaaccaagtatttctcaaccttcactcaggtcaatacataaaaccaattcaacatttaagtagacagttgttaaatatacatatacacatatattcatatgcatgtatagataaacacatacagataaaataggaagttagaaatagctaaatttctaacagaacactggataaaaatgctataaaatcattaacgataacctagatctatgcactgatgtggaaaagatattcaagacacaattctattaaccatgacatttagggaataattataaaagaattttaccttcttaaatatttctataatttctgaatttttaaaaaagttaacctttataataattatttttaaaaaataaattatagagaaaatatgcacatgtatgtagataaagatatggaaggacaagcaccctattcagattccctcctcaacttttaaggaaccctgtttttataaatgggcccacctagataatccacctacctagacaagacaatccaggataaccttcctatctttaaagtcagctgatgggcctattcggggcataccacactgcccgtggattagccctgctctgtaaggagcagttaaaaaaaaaataaggtcagctgataaacaatcttgattgtatctgcaaccataattcctgtttgccaggtaacctaacatagttataggctctagaaattagaatacagccatgggggtgggtggggggtcattagtcggcctatcatggttttataacagcatgaagttttaaaaactagctgcctaatatatttaacaggtacacgttaaatgggaataaagaataatacaattattaaacgaagctaacctaaaaaaaaaaaaggataaaaaaatcaaatgtatcacttttttttttcatgggtactctaaaaaatctttgcttaacataaggtcatgaagattctctcctgttttcttcttgaaggttaataactttaggccttatatttaggtttatgctccattttgagttttgtaaattttgcatatgggtgtctaattgttccagcaccatttgctgaagagactgacacaaacaatgacatggatttttataaatctcaaatgcattatgctgaatgggagaatctagacataaaaaggctacatactacatgattccattaacatgacatgccggaaaaggcaaaactatagggatataaatcagatcaatgattgccagagcttggggttgcagagggatgactgactacaaacggcacaaggcaacttttggggatgatgggaatattccacatctcaattgcggtggttgttacatgacagtttatgtttgttaaaactcagaggcccacacaactaaaaagtgtgaattttattctgtgtaaattattcttcaataaacctgattttaaaaattatcaagtgacaagatgaaaaggtgtaatttgtttgcagggtcctagacttcctgagacctaaaaatgtgaccttaggctgaacgctgtggctcacgcctgtaatcccagttttgggaggccaaggtgggcagatcaaaaggtcaggagttcgagaccagcctggccagcatggtgaaaccctgtctctactaaaaatacaaaaatgagccaggcgtggtggtacgcgtctgtagtcccagttacttgggaggctgaggcagaagaatcgcttgaacccgggaggaggaggttgcagtgagccgagatcgggccactacactccagcctgggcgacagagtgagacactgtctcaaacaaaaacaaaaaaaaagtgaccttaatgcaaattaaaattagcaaagaaaccaaaaggtggagaactagaccgtcattaccaggttcccttactgcactgccactgtttccaaaaaaaaaaagggggaagacaacaattcagagtgagcactaaagaaagcattatccaatagccataggctcatttttcaggctagtgacctaacaatttaacaaataaacgcgaagctaagcctaagaaaaaactaatcaacgaaataacatttacctttggagtcagcatttgggaacagcctgttccatggcaccttatttttgtgtggaagagaaagcaaatagttcctagcttttaaatttattatacaattcaggtcttcttgtgatggggatccaagaatacctatcagataaaaaaattagctattagttatcaggaccaaggtaaatgactacacaccatcaactctgagtcggaatgaaccctgataattgatatgagccgttgcttatcaccactcctgatgtttacctttcttatgtttttacacaaaagtccttaacattttaaatcagagaaggttaaaaattcacacctaccacaggttaaagagtatattagaactcttcttaatttaatgaagtgactttgatgtaagctgtacaaacttgagtaaatctagctcctgaagggctcgggaaccttacccaaaatgtggttcagctggtcaagataatgcttccctggaaagatgggcctgttagaaagcatttctgccagaatgcagcctacagaccaaatatcaatggacttggtgtagccctgcaggagaaagagagaaaagactgaaaatggtatctggtgttacaggacatgatgagatcttcctgtatgacaggtgcattgctgatgggactctgaacttctcctttgactctacaattcagaaatacaagtaaacaacatggaaaagcaaaaaacaatttggctttcttatgagaggctgaacaaccaagattatgtgattttatttttctcttcatagttgattaacttgggctgggcacagtggctaatgcctgtaatcccagcactttgggaggccgaggcgggcggatcacttgaggccaggagtttgagactagcctggccaacatggtgaaaccccatctctactaaaaatacaaaaaaattagccgggcatggtagtgggtgcccgtaatcccagctacgtgggaggctgaggcaggagaattgcttgaacccaggaggcagaggttgcagtgagccaagatcgtgccactgcactccagcctgggtgacagagcgagactctgtctcaaaacaacaacaaacccacaaagttgattaacttattaaattagaatttccaaagtatacatccgtccttttttgaaacaatttgagagacagatttagaattgtcataaattggagctggaaaaagaaaaaaggtctaaaaaccttttctgggtttgggggagtgtgtgctagctccatcatattttaccaatctcttctaaaatattctcagctgggcatggtggctcacgtctgtaatcccagcactttgggatgccgagacgggcgaatcacctgatgtcagaagttcaagatcagcctggccaacatagtgaaaccctgtctctactaaaactacaaaaattagccgggcgtggtggtgggcacccatagttccagctacttgggaggcagaggcaggagaattgcttgaacctaggaggcagaggttgcagtgagccgagattgcaccactgcactccagcctgggcaacacagggagactccatctccaaaaataacataacataacatataacataacataacataacataacataacataacataacataacataaacataacataaaacataacataacatataacataacataacaaataaaataaaataaaagaattctcatcttcttttcctattcatttttcaggaatatgttttcttttaaaggaatcctgttagaagtcatgggaggatactttgggaggctgaggtgggagtactgcttgaggccaggagtttgaggctgcagtgaactatgactgcagttgcactgttacactcctaatagcagcatgtgaaagaaaatgcatttcctcatgtcctcaacaacactgggtattaactaattattattattattatcattattattattattttgccacacatggtggctcacacctgcagtcccagctactcgggaggctgaggtgggaggatcacttaagcccagggattggaggctgcagtgagctgtgaccgagccaatgcattccagcctgggtgacagagtgagaccctttctctaaaaattaaaaaaaaaaaaaaaaaatcatggaaggattctgtctgaatcataacaatggtgcaaaaaagatgtttctccaaggaatataagctgactcttttaaaattaagagatggtgtcatcactctgtcactcaggctgaagtgcaatggtgtaatcatgcctcactgcaaattcaacttccttgtctcaggtgatcctctcacctcagccaggtcctgagtagctggcactactgagtagctggcacacagtaggtgggccacaggcatacaccaccacacctggttgatttttaaattttttgtagagaaggggtcccactatttgcccaggctggtttcaaactcctgggctcaaatgatcctcctgcctcagcctcccaaagagctgggattacggcatgaggcaccatacctggctccagaagtgccttctaatacaatgaagtgcttttctggtattcatgttaaaaatgcatgacccaaaactgaggggcattctacaaaatagctcatctgcactcttaaaggagactaaagaaacacaacaacctgtctctatgaaaagcacaaaaataaataagtaaatcagccatgagcagtagcacgtgcctgtagtctcagatacttgggaggctaaggtgggaggatggccttgagcccaggaggcggaggttgcagtgagccgagatggtgccacggtaccccagcctgggtgacagaatgagaacccgtcctttttttttgagacggagtcttgctttgtcacccaggctggagtgcaatggcacgatctcagctcatgcaacctccacctcctgggttcaagcgattctcctgcctcagcctcctgagtagctgggatcacaggtgcctgccactatgtccagctaaattttttgtatttttagcagagacagggttttgccatgttggccaggctgatctcgaactcctgaccccatgtgattcacccaccttggcctcccagagtgctgggattacaggtgtgagccactgtggctggcctgcgaacctggtcttaaaacaagcaagcaaacaagcaaacaaacaaaactcatgacagtacaacatgtgaacctgtgcccaggtcggggggtggtttgggtggggtatagttcaaaggttattgggataatatctaaaatgtgaatataaactgtgcattagatactgaatcagtattaagtttcttgattttgaaaactgtactgtggtcatgttagagaatactcttaaggcagggtttttcaacctcggtatgactaacattttgggctgagaaagtttctgtttggagggctgttctgtatatcgtaggatttttagcagcatctctggcctcttgatgcagggagtacccctacccctcactgtgacaaccctgccacatgtccccagggaacaacaggaccatggtttgaagtaaagacatactgaaacaaggtgaaggggtgtatctacaatttactctcaaatgactcagagtgcgtgggagtgcccacacacatgcacacaaagaatgataaagcaaatggggcaaaagataaaaaatcggtgagcctgaatctggggtaaagggtatttaggagttctatctggcggttctacaagagtgttccagagactcctatgggttccctctagaggatctgagaggtcacagtacatttattatactactatgacattttcatccttttcagtcacgagtgaaaagaagatttttccagatgcaatatgatgagtgatgatgtgtacatgaaaatgtgacacttggaatatctgtgtaactcagtgaaccagtattttccaaatacgctaaaaaatcatgcatgagtatgagtgcaaggtagactaatggattttaacgaaatagtatcaagaattcactgatatgatttcagattccacactgcaattaacctttaagaaaccaccacttgtttaaactgggggtaggatcaaagaatagccacaagtggctgaaaagactactaaaatttccctcctttttccagctacatacctgtgtgaagagttttcctctggccataccaccctgaacacgcccgatcttgtctgatctcggaagctaagcagggttggcctggttagtgcttggatgggaggaatagatcttgaatttcataaatagcactcagacatctatttttaggcttatttgtaaatgtcttgataaaatgtctgattactgttacatactagggaaaaatctcacttttttgtgtgttatgcttttaagcatagattttgtttgctaaaatgttatttagaattttgcatgtatttttcactggcttgcgatttttctttttatataacatcttttttaaagggtctttattaatattgcactcaagttttcttctgttttctatgctctgaattcaagcagttaaaatccatgggaaagagttttccttgacatttttgaagaactatgcatgtaatattatattgattattaaattgattaaagcctgaaaaaaaaaaaaaaaagagttttcctcatgaacttaaaccaaaacaacatatttgacagactgaatgcagaaccagatgagaatccaactgtcttctattaagccagacattaaagagacttgcaaaaatgaaaacaatgccactcttctcactaaaaggttgtttttcgttttgctttttttaaagacagggtctcaccctgttgcccaggctggagtgcagtggcgtgatcacggtacaccgcagcctcaatttcctgggctcaagaaaatctcccatctcagcctcttgagtggctggaactataggtgcacaccaccatgcccagctgattttaaaattttttgtacagatggcagggcacagcagctcacacctgtaatcccagcactttggaaggccgaggcaggtggaccacaaggtcaggaggttgagcccatcctggctaacatggttaaaaccctgtctctactaaaaatacaaaaaaattagccaggcgtggtggcggacgcctgtagtcccagctactcgggaggctgaggcaggagaatggcgtgaacctgggaggcggaccttgcagtgagctgagatcacaccactgcactccagcctgggtgacagagcacgactccgtctcaaaaaataaataaataaataaataaatttcttttttgtacagagtctcactatgtcaccagggctggttccaaactcctggtgatcctcctgcattggccttccaaagtgttgggattataggtgagagccatcatgcctggcctcactaaaacgtttttattgtagaaaataaacttattcttaagaaaaacatgtaatttatcttaacatgtagtgggtttactatttaaaaattaattaatacattttaaagtttcatattgtaggccgggtgtggtggctcatgcctgtaaccccagcactttgggaagccgaggcgggtggatcacctgaagtcagaagttcaagagcagcctggccaacatggtgaaaccccatctgtactaaaaaatacaaaaattagccgggcatggtggtacacacttgtagtctcagctacacgggaggcgaggccggagaatcatttgaacccgggaggcagaggtcgcagtgagccaagattgagccattgcactcaagcctgggggacaagcgccagacttctctccaaaaattaaaaaaaaaaaagtttcatattgtaaataacaatagatataacctacgtaactaaaaaaaggtgtgtgggtccttgactttttttttttttttgagacagagtctcactctgtcacccaggctggagtactgtggcaagatctcggctcactgcaacctccacctcccaggttcaagcgattctcctgcctcagcctccaagtagctgggattacaggtgtgtgccaccatgcccagtgcattttttgtatttttagtagagacagggtttctccatgttggccaggctggtctcgaactcctgggctcaactgatccacccgcctcggcctcccaaagtgctaggattataagtgtgagccaccatgcccagctggtccttgataatttttaacaaatgtaaagggatcttggctgggcgcagtgggtcatgcctgcaatcctagcaatttgggaggctgaggtgggtggatcagttgagcccaggagtttgagaccagcctggccaacatggcaaaaccctgtccctacaaaaacatacaaaaattagccgggcatggtggtacacgcttgtagtcccagctacacaggaggcaaggctggaggatcgcttgaggagggggtggctaccagcctgggtgacagagagaaaccccgtctcaaaaaaaaaaaaaaaaaaaaaaagccaggcacggtggctcatgcctgtaatcccagcactttgggaggctgaggtgggtggatcatctgaggtcaggagtttgagaccagccaatgtggtgaaaccccatctctattaaaaatacaaaaattaggcaggcgtggtggcaggtgcctgtaatcccagctacttgggaggctaaggcagggagaactgcttgaacctaggaggccgaggttgcagtgagccgagatggtgccgttgcactccatctgggtgacagagcaagactgtctcaaaaaaaaaagaggctgggcgcagtggctcacacctgtaatcccagcactttgggaggctgaggggggtggatcacttgaggtcaggagtttgagaccagcctgaccaacatggtgaaaccccgtctctactaaaaatacaaaaattagctgggcttggtggcatgcatctgtaatcccagctacttgggagactgaggcatgagaatcgcttgaacctgggaagcagaggttgcagtgagccgagatcataccactgcactccagcctgggtgacagagtgagactcggtctcaaaaaaaaaaaaacagaaagaacaaaagaaagaatgaaccaatgaaagaaagaaatgtaaaggtatcctgagacaagaaggtttgagaatggctaccttatacttttcttgcaacttttatgtttttagacagagtctcactctgccacccaggctggagtatagtggtgtgaccttgcctcactgcaacctctgcctcccgggttcaaacgattctcatgcctcagcctcctgagtagctgagattacaggtgtccaccatcatgcctggctaattttttgtatttttagtagagatggggtttcacaaagttggctaggctggtatcgaactcctggcgagtaatccacccaccgcggcctcccaaagtgctgggattacaagtgtgagccaccacacccagcaacttttctttaaaaaattttttttctttcctaaacaagctaaaacagcgcaagttttctgaaagctgaaattctataaaacgttacaaatatgtacacagagtgctctagcttctcaaaactgggacaatatgagtttaaaaaaaaaaaagaaagaaaattaaaatggagaacacataaaaaaaaaatcctgggtctgcaatagtgttttaaaaacaaaggtaggatacagaggaagagaaagggtaaatgggaaaaatcttcataggagaattctagctaatacaagtaaaagaaagaacaaatttagaaaattaccattttataacctccagtatgataactgacagaagtgagtgctgaaccactgggggaaggctgctgggaaacaaggatggccatcctggctaacatggtaaaaccctgtctctactaaaaatacaaaaaaattagccgggcgtggtggcgggcacctgtagtcccagctacttctgcaccgtcttcaggaatctgtagtggtcgtgttagaaacgtgcaagctacatctcatcagaaagaactcactggaggaatccacaatgtgaaccactctgtgaaacaactgatctgtacattgcaaagtactgaatgtcttaaagaagagaggaagggcaagactgttctagactaagaataatgcatgaaacaattaaatcatgtgttgaaaacagagttacctagacttttttgggaggatgggatgtcatggaattaatgctgatcattttatgaaagggtaagggtactctagctgtgggaagaacaccttccttgtaaggagcattagtatgccccaaagggtctaggagtgaagtgttatatgttggtgaagtgtcacatggtctgacaaaagagaagagacagaagaagaaagagagagagaaaggaaagagtaagagagggaaggagggataagaaatatgacaaggtgttaatagctggagaaccaaggacaggggcatatgggtattcactctactctcaatttttctatgggtttgataattttctacattaataaaaataaacaaaatgaagacaactgctagaagtaacattctcaggctacaggtatcgcaaataagaaaaaaatgaacactcaattttcactttggtgaccctgcaagtagaaggaaaagctggtcatcttgaagaacaccctctctggctacttctccctggagggtaatagagaagtggagacagtggcggcgtctaagtcagaacggagactgcaagaccaagccacaccaggacaaaggcacaccaacagctccctttacaactggcactgaacactggcatgccaatgctccttgtttagaatggctgtcacgtggccagtcagagaaagaacctgttgtgtgggattatttgtgatatagaattacagagaatcaacatggcattttcttctctgaaacatctgttacaccaaatccttctttataatggaatttatgttaatgagattttacttttataactaaactgaacaaatgtaggatatcaagaaaaactaaatgctttaaacaaattccatttccttatgaaaaaatctaatagcttatctgtactagtaataaaggatggaggaagaaaaagaagactataagctaattagacctgttctttcatttccactaagcctctcaggactatttctggttcctgggccctagatacaagatccaatgtctatttttattgcttttcttcaagtatctttacatgacagcagagggaactgtgtttaagaatcttataatcctgagatactagatacaggtagtatgtcaggcctacttaactactcaattttcacaccttattcatatattatttgcaaataacagaaaaatactgaatctcaatctccatagcagccctcaatttttgcctcctggctcataaacccaacaaaaaatgtcagacttcacttttctgggcttttgtaaacttattcaaccatttcttatgaccaagacacagaccttgctagtagagtgtggatgagacctggatgcactctctatagccactcacagatgcagaggaaagcacttcatttggaagcaggaaatcacgtaatttcaaaagaatccacggcagttcctactctgtccacatttatgttttcttcaagtacaacaaattacaatataattctgccgaagagacattcttcattatcagataaatttgacctttatagaatagccctggcccatgttcacagaaatacacattactgaataacctctacaacaaacccagcctgcacctaacagtgacagcgataggtaggacttcaggacagctgtccaaggagtgaaacacagaccacttatggtaacagtgactggagaggcacaccccctcctactctacaaccgtcagcactatatcagctgaggtagagaggctgagccctagggcccagaagttcaatgccgaacaaaatttagacagcaccttggggccaggtgtggtggctcatccctgtaatcccagcactttgcggggggcgtggggggtgctgaggtgggtggatcccttaagctcaggagttcaagaccagcctgggcaacatgcgacataggaagacgccctacttttacaaaaaaaatttaaaaattagccagatgtggccaggcacagtggctcacgcctgtaatcccagcactttgggaggctgaggtgggcggatcataaggtcaggagatagagaccatcccggctaacacggtgaaaccccgtctctactaaaaaatacaaaaaattagccgggcatggtggcgggagcctgtagtcccatctacttgggaggccgaggcaggagaatggtgtgaacccaggaggcggagcttgcagtgagctgagattgtgctactgcactctgcctgggcaacagagtgagactccatctcaaaaaaaaaaaaaaattagccaggtgtagcggtgcactctgtagtcccagcaactccggagactgaggtgaggagggtcacttgagcccaggaggttgagactggtaagccgtgatggtgccactgcactccagcctgggtgacagagtaacaccctgtctcaaaaaagacagcaccttgtctctggccagacaggcaaactctcaacgcagagggagacttacggcttactgcaatgcattcagaaagttctcttacttactggatttctttttatgcaaacttcatccttaccttggaattcaacataatttctggagccctgtaccaacgtgtggccacatattctgtcaggaaccctgtgtgatcatggtctggatctgcaacacgggccaggccaaagtcacagatctaagagagaaaaaaaacaggataacttcttagaaattctaacctttcatatcaaaacatcacaaaaataaaaaaggcaataggaataataatgctactaagtggcagatactttctgggcattctagaaaatcattatttaattttcccaacaacctgaaaagcaatcaacatgttagagaccaggatgcaggctgaagaagtctttacagagcacactttaagaagcatccctacctttcattatctgcttagcacaaagcaatctcaataggtgaattgacaaaaactgttctgagtagtcaccaaaaccaaccagtacccttttctcagcctgtcctgctggagctctcaggactgctgtgaagatctgcactggccttctattctcagactctactttctgctagtcttctacttagtctataaatataagtatttccaaagattcttcccacttccttcttctaggtagtcaaacctactcccaaagctttttttttttaaagtttcatatacttaagaatattttatttttaaaaaatacatagtttctcattttctccggtctcaagcatctactggcctttcatcatctggccctccaatatcatggtgtggcttattttctatttttagtagagatggggtttcaccacgttggccaggctggtctcgaactcctcacctcaggtgattcaaccacctcagcctcccaaagtgttgggattacaggtgtgagccaccatgcctggccatgatttttttttaaggtctgtcaacactataaaatcaaagactaaccaaatttacatgacactaatcaatacaatgccaaggctacaaaataaaaaagcagtagtactcagtataattccatacaaaggaaaataaataaggatatggtacaagaaaatataccttttgggctgtgtaaattcagattttcaaaaacaaaggatgccccaaagacgtgtttcatttgtatctatcagagtctttctttcataggcatagccagaattttcacatgttgtgatcccagcatcttgtgactcctactgggatttctgtgggatcagtctagtaaacaagggcacagactagtatagctcacgttccctggtagttacactagaaatgtgctagcagagcctccaaatagggtctgtaaccctggtgagttcctgtggtcctgaagaataaagtctacaagagaggatcccggaagggtcctaagatgtcaatgtctgctgggtcttaagcttcataaaataagtgcaaagcatgtttatggaaaccaaaaagcaagcttatttctgtcggccttgactgataacagagccaaaagttaaaggtctaagacactgataatagctgatatcgataagggttcaagatattttggtaagggttcaagagtaaaaaacactgtaacatagaagtcattggatgaaggttgaagaaatcttcttgaaaatctgaaaggacctaaataacaggaggtcagtgacgctgcaagttacaaacttcctaggccaaggggcctgtgggaataggcatcatggtcacatggcactgaggatgtgataaatgtgcagtgatcccagagctccagcaaacacaagtcctctcctcatgtggtgttctcaactgtcatatgcacactgaactgccactgcctcttgccctgctttgacacgctcactgtaacaaatcagtgacataccatactcatctttgaatgagattctctcttctcgcatttatacccatgagaatgatgcacacacattgctgtatacttttttttttctgagatggagtctcaccctgttgcccaggctggagtgcagtggtgccatctcagctcactgcaacctctgcctcccactgattctcgtgcctcagcctcccaagtagctgggattacaggtgtgcgccaccacacccagctaatttgtttgtattttcagtagagacagggtttcaccaagttggtcagactggacttgaactcctgacctcaggcgatccgcctgcctcagccactcaatgtgttgggattacaggcgtgagccatggcacctgactgctgtatacttttaaaatatcagtaaaggccgggtgtggtggcaaatgcctgtagaatcccagcactttgggaggtcaaggcgggcggatcacgagatcagaagttcgagaccagcctggccaatatggtgaaaccccgtatctactgaaaatacaaaaattagccaggcatggtggtgggcacctgtaatctcagctactcaggaagcttcagcaggagaattgcttgaacccaggaggtgaaggttgcagtgagctgagatcatgccactgtactcctgggcaacagagcaagactctatctcgaaaaagtataaaataaaaataaaaataaataaaataaaaataaaataaaataaaataaaatgttagtcaatttgttatgcttctgattctttgtgttaacttgggttttcaagacgatgcctaaattatgccacggccaacaactcgtgtgtgtgagtgtgagtaggtgaacagaatggccttaaagacaagtccataaactgggaagagacaacagagagagtagtctggttctatttgttttattcttaaagatgaacactttcaagcaaaaataagagccaattcttcccagaaatgttatatgcttaaaatattgattgagaatgtctctccaaaaacaaaagcaatctgccataacagggctatgatgataaccaaaagaaaaaaaaaacacgaggagacataaaaatattcactgcaaattttcaagacaatcattaagtgccaaagaagtagtacagccatcctaaacatagctttattcgttttgtgcccacctgactcttggttgcactgatccaggtaaaggagctggttccatcccatgtggaaaagacataaacctgtatcagaaggatcctaagaggggacagagtccaatccacacaatatctgatgaaggaagctgtcctttacatctcactggacattggccaccgtgttcacccaccgtgacaaaacccaccgctttttacacacagttctagaaggttccccacgatctacttgcaaccaacctttttagcttagtgtcgatgactccctattactcatccaatgctgcagccacagggaggaagactcagtgctttcggtagtagtcccttccttcttattttatttctgtactctctgcctatgataccctatgtccaatagagccactggcctcccgcaagaaaagctacccaacctcgagggccggcacagataccaccttcttcctgctgcctcccagtcccagccagcgctagcccacctctctcctttgcatttgtacaccatctttttctccatctcagttacagaacatctcattataatcacctactgtctaccagatttctgatctatcagttttcagatttcaagggcagaccctcatctctcttgtctggcgtatctcaaagggcttctcataggagtgtctgttgaactgaaatccaataaatgattattgctatacatatatatgtacttaagcagctttattaacctataattcacacaccatacaatttgctcatttaaagtgtataactcaatggttttagtattataatggtggaaattaaccattaccaccatccaatttgaaaatatttttataacctcaaaaagaaattccagtgagttagtattccttccttctttattctcccaactcctctagccctaggcaatcagtaatccactaattctaatttttgtctctatggatttgcctattctagacatttcacgtaaacagaatcatacaatatgtgtcttctgtggctgccttccttcacagacatgtttccaagattcatccatgttgtagcattatcagtacttcactcctttctcttctactgtgtggatccaccacactgtatttattcatcatcagctggacatttggattgtttctacttactggctatagtgaacaataccactatgaagatttgtgttcaagtttttgtatagatgcatgttttcattttcactaaggagtggaatcctcaccaacacttattatctgactttttaactacagccatcctagttagcatgaagttgtttcaatgtaattttgatttgcatttttctactgactaatgatgtcaagcatctatcattccatgtgcttattgccatctgtatatcttctttagagaaatgtctattcagatcctttgtccattttttaaactaggctatttatcttttcattattgagttataagagttcttcatatattctagttttaagtcccttatcagatgtatgatttgcaaataccttctctcattctgtggcttgccttttcacttttttgatggtttgctttgtagcacaagtttctaatcttgatggaatccacttacttttttcttttgttgcttgtgcttttggtgtcatgtctaagaagctttgcctaacataagattgcaaagatttacttctatgttttctaagagtattaaagttttagcttttaattgagttcttcaatccattttgaatttttttttccttttgagacaaggtctcactctgtcaccccagatggagtgcagtggtgcaatctctgctcactgcaatttccacctcccaggctcaagcagtcctcccactcagcctcctgagtagctgggaccacaggcacatgccaccacgcccagattaatttttttgtattttcggtagagatggggttttgccatgttgcccaggctggtcttgctccggagctcaggcaatccacaggccttggcctcccaaagtgctgggattacaggcgcgaaccactgcacccagccattttgagttaattttttcatctttttgtatgtggctattcagttgtcccagattcatttgctgaaaagactattctttccccagtgaatggtcctggcatccttgccaaaaatcagttgaccatagatacacgggtttatttactgactctcacttctattccactgacctatatgtctattcttatgccagtagcacactgtcttgattactgtgttttgcagtaagttttgaaatcaggaagtgtatcagttctccatatgaatttccatatgaattttgggatcagcctgtcaatttctacagaaaaaaacaactgggggctttgatagggattgcactaaatctgcaaatcaatttggagaatactgccatcttaacagtattaagtcttatgatccacagacatgggatgccttcccatttatttaggtcttcttgaattcctgtgcatttttttagactgaatcgacatcgctccgtcacatctaagatatccataaatttccctcgtttacctgtaacacccattaaaacagaaatatgtaaatgctgcatattttcagaactctgaggactgtaaagaatttggggttttcttatttagttggaatgccttattaggtattaaagtcagtgacgttaagttttctgctgctatcttttgaataaaatttattgaagaaaaatgtcaccaacaaaacatgattttaaaactaacacataaggccaggcgcggtggctcacgcctgtaataccagcactttgggaggccaaggtgggcggatcacaaggtcaggagattgagaccatcctggctaacacggtgaaaccccatctctacaaaaatacaaaaacaaagaaaaattagccaggcgtggtggcaggtgcctgtagtcccagctactcgggaggctgaggcaggagaatggcgggaacctgggaagcagagcttgcagtgagctgagatcgcgccactgcactccagcctgggtgacagagcgagactccatctcaaaaaacaaacaaacgaacaaaaaaactaacacataatgtacgtgatcctgtttatctatataaagtataaaaatacacatgtatgcaagagcatagaaaatactttgggagaaaatacactttgttttttaggacagagttttgctttgtcacccaggctggcgtgcagtggtgtgatctcggctcactgcaacctccgcctcccaggttcaagcggttctcctacctcagctcccatgtagctgggattacaggcgcatgccaccacgcccggctgatttttgtatttttagtagagatggggtttcgccatgttggccaggctggtcttgaactcctgacctcaggtgataaggcccaccttggcctcccaaggtgctaggattacaggcgtgagccaccgcaactggccaccaatttgttatagtagttagttatcacggcctggtgctgtggcccacatacataatcccagcactttgggaggccaagaaaggaggactgcttgagcccaggagttccagaccggcctgggcaacatactaagactctgtctttaagaaaaaaaaaaaaaaggtatctctggggagaaaggagcaatgggataaggaagaagaagaggactaccacactttattagcatttttgccataaacatgtttttgggtatttctggtgtaatttaaaatatgaataatgacaaatataactatgcttcagtgaaagggtttttcaatatatatcaccttaatagtaaataacctggctgaccttgagatcacaggtggtgttgagcagcaggttggaaggcttgaggtcacggtgcagaacgttagctgaatggatatattttaaccctctgaggatctggtagagaaaatagcagatatggtcattgctgaggtgttgtgtcttcaagagcttgtaaagatctgtttccatgaggtcctgtactatatatctgtttgcacaggttaaggtaaaacaccaattagctggtcacatttagcaaagcattgaaaacaaaaatgcatcctctcttgactctcttcccaaacagtccatcattacaccatgaagcccttaaaggaaagaagaaactgaggaaaacttggtttccttcatggaaagaatctgaagtcgttaactccttttaggtcctgtgagatggcaggcattccagcattacatctgactgatgcggctatgggcctagactgagatctgaaacaggctgttagggaaattctggtcaatcttgaagtctcaacctctttgctctctaaattgtccaccatcaacgaaccccctccaaggtttgctggaaacactgttagcctgtaagtagcagatactccctcctctgtttggtccagtaacctgtaatgtcactattctttttacttcttgttgccgctcccctcctctcccaagctcctcaaaagccaaacataaaacttccagaaatacaggtctagaaacatactcttactagtaaatccaaccctaagtctattttcttgactcttccattactgttaagatcttaaataagtaagactatgggcaagtcgttctaagaaggggtttgtgctagttttcctcctcatgctttcttgcctggtcacgtacttaactacctaaaagtttagctatggctactttctttctcacagaaattaaattattaaagcatttagcctttaacttcatcatagtattatttcattagcagtatttctacatttcttttactcacttctgtgtaaacactagtctctgtttcttacagatttatgctataggaggcgcagcatgggattcaaaggaaacatgatttaaaaatctgtcatctgagagaggcttattttcatggcaaaaagtaaagcaggaccaacaggtggtagtggcaggaggcatttcacttcaaatatcactacaacttattaacagagctgtttaaaaatggaaagggctgcctagaaacagcgagctcccgcaccctggaggggcggaatacaaattgggtaaactggtaggagtgctgtataaccctttcccttctggcagatcctcttcagtatacttaacctctctatctttcaaatggagcctttacccaggcagcatcctctagatctgttcagtccagatttctaaatgttggtcagagttaatcacataatttcagacctcagttgaccttaaagatcatgacgaccagttccttcattttaaaggtggggaaactgagacctaaagtggtaacctgactcttaagatcaggacagtcctgatttcaccaggtagatagccagggcaccctctttcttagtctactactgatcttccctttaccttttcatcatcacaacaaaccatcccttggacagaagaaacatgactgcaaacagagttaaccaagattttccatgactagacttagggagtaaatagcaaacagattacgattttccctttagcatgtttaatgcacttttcctttaagttcaggaaatttcaagttctatttactcaacaaggttaccaagcagtggaattggccagttgcctaaaaaggatacacatctttcatttgctcgatggttggtgctcgaataatgtcattgattccaatgatgttctcatgtctgaagcgcagtaagatttttatctccctcagggttctctggcagtaggtctggtgctcaaaggggctgattttcttgatagctactcgaactttgttgacattatcataagcagagcttaaaaaagagagagagagatggcattaaaaacagccctcagaatatttgaagaaggcaagttggtaaagtattatatttttaacactgtgtaaacacctgtttcatacccgtgaaggcagcatgtatattatccacaaaaaggcctcaagctagggaggatggatgcaactgacatgagagagcacacagtgactctcaaaactaacagagaacctagccctgttaactgggtgaaagtcttgcctttataaacccagaaatacacaaacaagcattctcccattgtcttaaacagcaactgcattctggtgagagtaatcacttctgtctctgaaacaccttcttactgttgtatcaaattcctctgacacagaagaaacattcaaataacctacaactgtacatctttatccctaacaaaaatggacccaagagaacaccttgattacttctattaactttgtttctctcacttgcaaaacaacatgaccatttcttcccccaagaaactgaatcaagatgtttgggtagttttataacaaaacctagaaaagtattcttcaaaaaacatatttgtggcaataacatggggcccagttctttcctagttgtccttaatgtctgataaaccagaattataagcaaaagcaataataaaaattataccttcaattttatgaatttgaatcttgagtattactactatctttatgataaacattctattacaatcttgtgtataagaaattttcatattaataaatgtcaacatctggcccactgaccaaagcaatcaaataacattgacaggcagtaagacaacatttcttgtttccttggggtaagtgctagaatagaaagcagtaaaataactttattctaaaatttatgcttctagggccgggtgcagtggctcacacctgcaatcccagcactttgggaagctggggcggctggatcacttgaggacaggagttttgagaccagcctggacaacatggtgaaaccccgcctctactaaaaatacaaaaaaattagccaggcatggtggcaagtgcctacaatcccagctacttgggaggctgaggcacaagaatcacttgaacctgggagatgcacgtggcagtgagccaagattgtaccactgcactccagcctgggcgacagagtgagactccgtctctaaattaaataaagtttatgcttctataatatttatcagtctactaatcctaagaattattgatacatttgtctgattctatgacaagataatgctctggaggagaactttgtcttactaggatccaattatcctacaacaccattaacatatagtacacaggtggccccaaatgctttgaaatgaagtatattttcttaagtaaaataaccactactcaaatcttattttgctttggtttggtacatgaggccctaagccagtgattttcagttaggcaacagcatatataatagtaataatttaacatagtattaaaaagcatatataataagcaagcttattcaatattgggaatatttttagaaaaaaattctattttggtaattcaaatcatagaacaagagttcaacaacagcacggattagttataaaatgctggtttaaactcaacattacaattttctagtgttaatattataaatttctagtgttaacagtcacaagtggtcataatttgttctgcaaaattataatccaacaaaatttttggagagaggagtttatggtcagtgtgcccctctactgtatcaacactcagtgacgaaataactgccctcccccccggcctctttaaaatttttttgtggaagcagtctcgctctgtcgcccaggctggagtgcagtggtgcgatcttggctcactgcaagctccccctcctgggttcaggccattctcctgcctcagcctcccgagtagctgggactacaggccccgccaccacgcctggctaattttttgtatctttagtagagacggtgtttcaccgtgttagccaggatggtttcaatctcctgacctcgtgataggccccgcctcggccttgcaaagggctgggattacagggtgagccaccatgcccggccaactgcctccttttaagtaagaaaatatgagatcatcctcatctggtcccacttgaaaaaaaggagttttgtctgttcctgtctgctccgcttaaccattctgctgcctttttggtttatgcaatctatctttcatagaactgatgacaaagagggttacactcttccataatgattccatacttgctagtttctccttggatttctcggttttgttttacatattttattgttgatacttggtaaataaggcataccatgaactttcaggtgtctataaacatttatgctttaaaatcactttgacattaccaactgtgtcttgttttgctcaaccccttttgtccctaactaccaccacactacaggtttttgctataagtgtgtctcttatcacaggaatccaaagatggttcattaaaaaagaaggccgggtgcggtggctcatgtctgtaatcccagcactttgggaggccaaggcaggcggatcatgaggtcacggcaggcggatcatgaggtcacgagattgacaccatcctgtccaaaatggtgaaaccccatctctaccaaaaatacaaaaattagctgggtggggtggtgcgcgcccatagtcccagctacttgggaggctgatgcagaagaatggcttgaacccaggtgatggaggctgcagtgagccaagatcgcgccactgcactccagcctggtgacagagtgagactcagtctcaaaaaacaaaaaaaaaaaaagtgggggtcagtcctaatgggtgtgtggtgatagctcattgtggttttgatttgcatttctctgattcatgatgatgaccatcttttcttatgtcttcttttgaaacgtgtattcaacgttatgccttttttttttttgagacggagtctcgctatgtcgccaggctggggtgcagtggctcaatctcggcttactgcaacgtctgcctcctgggtttatgcaattctcctgcctcagtctcctgagtagctggaattacaggatctcctgacctggtgacccgcctgccttggcctcccaaagtgctggaattacaggcgtgagccacccaccacgaccagccaggactgccactatttaaaaacaaacaaacaaacaaacagaaaaccgtaagtgtgatgtggataaatttgaaccttcatactctattgttgagtgtgcaaaatggtgtaaccacttggaaattcctcaaaaaattaaaaatagaattcccatatggtccagcaatcccacttctgagcatatatccaaaacaattcaaagtagaatctctaagagctactggcaggttcattgtgcagcattacgcacaatacccaagatgtggaagcaaccgaaatgtccactatggatgaatggataaagaaaatgtagcatatacatagagtggaatattattcagtctttaaaaaaaaaaaaaaaaccacacacacacacaaagaaattcaattcagcatccaaaaaccatgcctaattgtttttattatttatttatttatttgagacagagtctcgctctgtcgcccaggctggagtgcagtatcgcatcttggctcactgcaagctccgcctcctgggttctcgccattctcccgcctcagcctcccgagtagctgggactacaggggcccaccaccacgcccggctaatttcctttttttttgtatttttggtagagatggggtttcaccatgttagccaggatggtctcgatctcctgacctcgtgatctgcccgccttggcctctcaaagtgctgggattacaggtgtgagccaccgcacccggccaattgtttttaatttaaaaactttttggtagatatggggtctcactatgttatccaggctggtcttgaactcctggtcataagtgatcctcccacctcagcctcccaaagtgctgggattacaggcatgagccattgtgcctggtctgacttaatattcttaaagtgtctacactactcagtgtggtctgcagagtcaatgtaatccctatcaaagttccaatggcatttttcacagaaacagaaaatgtaatctttaaattcatatatggaaccacaaaagatcccatatagccaaagcaatcctgagcaagaacaaagtggtggcttcacatcacttgatttcaaaatacactacaaagctatagtaaccaaaacagcacaacactgcggggatagggtgaaatgtgcagataatttgttagagtataaagtttcagttaaccaggatgaataagttctagagctctatcctacagcatggtgactacagttaataataatgtattatatacttgcaaattactaaaagattagatcttaaacattctcaccacaaaaagtatgtgagatgacagatatgttaattaccttgctttaatcatttcacaatatacacatatatcaaaacatcatgttgtatatcatgaatatatactaattatttttccagcacttccacctcagtttcatatactaatttgtatttgtcaattataccttaataaagctgggtggggggcagggaatcagcatggtactggcataaaaacagacaaatagacaaatggaacagaataaagagtccaaacataaaggatagtctcttcaataaatggtgctgggaaaattggatatctacttgctaaagaataaaatggatacttatttcacaccctatacaaaaatcaaatcaagacagattaaagacaaaaattgtaaaacctgaaattataaaaactagaaaaggctgggcgcaatggctcaccctgtaatcccagcactttgggaggccaaggcgggtggatcacgaggtcaggagatcgagaccatcctggctaatacggtgaaaccctgtctctactaaaaatacaaaaaaaaaaaaaaaaaaaattagccgggcgtggtggtaggcgcctgtagtcctagctactcgggaggctgaggcaggagaatggcgtgaacctgggaggcagagcttgcagtgagctgagatcgtgccactgcactccagcctggatgacagagagagattccgtctcaaaaaaaaaaaaaaaaaaaaaagcaaaagcaaacaaataaacaacagacaaacaaacaaaaactactagaagaaaatacagggggaaagcttcttgacattggtctgggcaattattttttggttgtgactcccaaagcacaggcaacaaaagcaaaaacagacaaatggaattgaatcaaactaaaaagcttctgcacagcacaagcaacaatcaacagagtgaagagacaacccaatgaatgggagaaaatatttacaaaccacatatctgataaggggctaatatttaaatatataagaaattcacacaattcaacagcaggaaacaaacaaaatatttaaaaatgggcaaaggccaggtgcagtggcacctgcttgtagtcctagctattcagggggctgaggtaggcagactgcttgagaccaggagttcaagaccagcctgggcaacatagagagaccctgtctcaaaaatggaaaaaagcaggtgcgggtggtagggagtgggggcaaagaacccgaatagacattactcaaagtaagacatacaaatggccaacaggtatatgaaaaaaggctcaacatcactaatcagaaaaatgccaatcaaaaccacaatgagatatcacctcacagctattagaatggctattatcagccacctacggtggctcacgtctgtaatcccagcactttgggaggccaaggcaggcggatcacctgaggtcaggagtttgacaccagcctggccaacatggtgaaaccctgtctctactaaaaataccaaagttagccaggcgtggtggtacgcgtctgtagtcccagtttcttgggaggctgagtcaggagaatcacttgaacccaagaggcggaggttgcagtgagccaagatggcaccactgcactccagcctggacaacaagagtgaaactgtctccaaagaagaaaaaaaaaaatgttcttgcccccaccacacacaaacgttaactatgtgagttgatgggtatcttaattagctttactgtggggatcatttcgcaaggtatacacatatcaaaacatcacatttaacacagtaaatatatacaacttttatttgtcaattatgccccaataaaggtgggggaaaaaccaaaaaggtcattctatcacatgctataacatggatgaagcttgaggacattatatcaacagaaataagtcacaaaagacaaatactgcataatttcacttatatgaggtatccaaaattaacaaactcatagaatcagaaaggagaatggtggttaaaaatggctgaggagagggagaaatggggagatgtgttcaagagtacaggttttcaattttccaagatgaaaaagttctagatctattgtgcaacaatgtgaatatacttaactctactgaactgtgtacttaaaaatgattaagatggcaaattgtatgctttttaccaaaacatataattaaccaaaacaattttactttgtaaagagatgaagtctcggctgggcacggtggctcacgcctgtaatcccagcactctgggaagctgaggtgggtggatcacgaggtcaggagatcgagaccagcctggctaacatggtgaaacactgtctctactaaaaatacaagaattagcagggcgtggtggcacgcgcctgtaatcccagctactcaggaggctgaggcaggagaattgcttgaatccgggaagcaaaggttgagtgagctgagatcacgccactgtactccagctctgggcgacactgcaagactccatctcagggggaaaaaaagcgagagagacagagagagagagagagagagagagagagagagagagagagagagagagagagagagatgaagtctcactatgctgcccaggccggtcctgaactcctgagatcacttcctcaggcttcagagtagttgggactatacgcacatgccatggcacctagcttaaaaaaaatttttttaagggggaaagaaacatgttaaagagggaaaaaaattaagtattaatttttttttgatggagtctcgctctgttgcccaggttggagtgcagtggtgccatctgggctcactgcaacctccgcctcctgggttcaagcgattctcctgcctcagcctcctgagtagctgggactactggtgcccgtcaccacgcacagctaattttttgtattttagtagagatagggtttcaccatgttggctaggatggtctcgatctcctgacctcatgatcctcggcctcggcctcccaaagtgctgggattacaggcgtgagccactgcacctggcccttttatttcttttgagatgggctactctgtcacccatgctagagtgtactggcacaattatggctgactgcagccccaacctctcaagtagcatagtggggaccacaggtgagcaccaccacacctggctaattttaaaaagtttttttgtagagacagggttctacaatgttgcccaggctgatctcgaactcctgaactcaagtgatcctcttgccttagcctcccaaagtactaggattataggcgtgaaccaccacacctggccaataaagggggaaacttttatccagctttgggttagtaccttctatatatcaagaactattctaacattaggacgcaaaaattataaataatactctgggctgggggtggttttcacatctgtactcccagcattttgggaggccaaggcaggcggatcatgaggtcaggagtttgagaccagcctggccaacatggcgaaaccccatctctactaaagataaaaaaaaaattagctgggcatggtggcatgcgcctgtagtcccagctacttgggaggctgaggcaggaaaatcagttgaacccgggaggcggaggctgcagtgagccgagactgcaccactgttctccagcctgggcgacagagctagactccatctcaaaaaaaaaaaaaaataataataataataataatactcttcccttgaggaacccaagatattgagagtgtctagtcatcttaaatgaacacaacctcaagtcccagatgaattctatcctaagacccataaattatggagaatgggaggacattaaggtctgaagtgagcacacccatctcaagtctcaaaacagatagattcctgctatttgataataaaaggaaatgagattcctatttgataataacaggaaatgaactattgatatatgcagcacagatgaatctcaagtaattatggtgagtgaagccagaccaaaagaaatgtatttccatctatagaaaatacaaagtaatcctgggtttactttggatttacccccaggattgcctgggaatgggaggaagaagattgcaaatggaaatgaggtaacttttggaggcaatgagtatgttccttatcctaattgtgttgatggtttcataggtgtataatgtattaaaacttatccaactttatactttaaatgtgtgcaatattttgtatatcaattacttcttagtaaagcagttaaaaaaaaaaaaaaagaaccagggttctttggccacatgattcattccagtgctggggcaattgggatacagattctagaagtgtaccgatcaataaacgtagaagtccatgaaattctgaagtagattatttaacagatgttttatgattgcttagggaaggaaagggaaccagcatgagtcaattatgaacaagtcatgctaaactagctttatttcctgttttgatagggttaccacaacaacacgaaatgaagacagagttctggtgaattcaagccacgcttgtcaagaacttcccatttgtgaggcttcatgttaggactggtggcaaaaacaaataatgatcctgctcttaagaaacttgcaattttgtgagagaaggagacaggaacagagaacatactttgccttttatcacattaaagcacttctgaaacccaaggaggagctgggttaacttcaaatactaagggaaggattaaaagaagatgaggcccgcaaaagccttatcctgaaggatgagtaggcttctgacagaaaagcaagaccgcaaagaaaagaaagaggaaacaggaggcgaggtaagagactgagacatctgtggtcactggccactaaccctcacccagacatgcccatgcccatgagagaaggttattggggtcggggaaaatgctcctcaggtgcccgggaattccctgcatctggaaaagtgtagtctgtacccagcaggtgcacttgaggtggtggtcaaaggggcagctgcttgctggcgtgtattgcacctacattgtgcaggcaggaggccacacacgtgctcaagctcacaacacatggatagtgctgtggctgggaagggaagagcactatgctgaaggtctgctctgccggaactactgacatagaactctaaggagcctgagtattttctatttgaacccaaccttccaggtcattaagaaggtatattaggcctggtgtgggcatggtgatgcacgcttgtaatcccagcactttgggagggtgaggagggcagatcacttgaatccaggtgttcgagatcagtgtggacaacatgatgaaaccctgtctctacaaaaaatacaaaaattagctgggcatggtggcactcgcctgtagtcccagctatttgggggactaggcaagaggatcacttgagccagggaggttgaggctgcagtgagccatgattgtgccactgcactccagcctgggtgacaaagtgagaccctatctcaaaaaaaaaaaaaaggaaaagaaggcatatctgtcatggcaggaggagagagcaaagtctgcttaatgtttcttaggttgattttttttttttttaatggtatgtagggctccatttgtattcttgacctagaccttataaacgtgagaggtgggcctgggtctgggaggtacaaaaagaaggtggaggtaagggacaaagatagttttcagcatcctgatttaaaaatctaagaatgcctgtcagtgattcagatggaggagatgacggttccatccttccagcagcatcaggagagagatcaagttgggaattcttaacagaagccacagtgattagcactcctgcagagagagaatttcaagaaaagaagtcggaagacagaactcaggagcagcatgaggatgaggaatcagttaaagaaagtggaaagaaatgataatggagtaagaacctttaggccaggcgccgtggctcatgcctgtaatcccagcactctgggaggccgaggcgggtggatcatgaggtcaggagatcgagaccatcctggctaacacggtgaaactctgtctctactaaaaatacaaaaaaaattagccgggcatggtggctggcgctacttgggaggctgaggcaggagaatggggtgaacccaggaggcagagcttgcagtgagccaaaattgtgccactgcactccagcctgggtgaaagagtgagactagtctcaaaaaaaaaagaacctttgttgtccaactccagaggccatgtagttctgcttaaccatgtagcagaaccagaaaagggtggtgtttcccaagacaaagaaggaaggcatttcaaacaggagagactgagaaaagtaagaactggaaagcattcactgaatctgcatgcaaccagacgatgtgtggtaactttggttcaagtaaggaaatggagaggatggggagaggagcagaaagagtacagccgactactttttaaagagtgatcataaggcaaggataacgaaaaaaacttaaatccaggtgaaaaactgagaggcacaggatgttatgaaagccatggtcgggggctgggggaggggaggctgaaggctgcaggaccgggtagggtgaaagagaaggctccaatggctaaccagggggaagagaagggagagtaaattccaggcagaggagatgtggggcagtggtgcagaggcctgtgggaacctggggcgacagagtgcctgcagagaggcggacacacagggacatgacaggggaagctggagggtgagcaagagccaggccatatttatattttcgtaattttatcctgggaagccaccaaaggatgctaagcacagactttaagcatggcaacatttatatttttataacttttcctcaggtagcagtttgttgaaagaatggaatggggaggatggtgcactgggtcacccggaggcaaggagccctttcagccaactcagaatgaaggggagccacagctctggataaatgggcaaagagcaggctcacaagaaatgggtgcttatttcacaaacctcacatgtcccagcagggtcctgttcaagcagtctccatccaattagatgaaattcctcaaggacacaactgtatgttctaaatagctcatgtcttctttactgcagttgtaaccaaatttgcagggcgggaaaaaaacagtatccttatctgatgcctctcaatgaagatatgacaacaaaaatcctacaggtggccacaaatgccataaggaacaggctgttagccagaagtactttggtcttgacaactcagcttccacctgtcctagccccaagatacatgaaataccagtgggccccaggctcaagtgacccaaggatatttcaaatgtctttttcttttctttttttttttttttaaagacagaatcttgctctgtcatccaggttggagtgcactggcgtgatctcggctcactgcaatctccccatcccgggttcaagtgattctcctgcctcagcctcccaagtagctgggacaacctacaggcacaagccaccaagcccagctaatttttttttttttttttttaagtagagacagagtttcaccatgttggccaggctggtctcaaactccagacctcatgtgatccacccacctcggcctcccaaagtgctgggattacaggcatgagccactgtgcccagcctattctttattcttaatactttattcatttgaaagctttccttttgtggtaaggtacagttcctttcactgatgtttatttgttctatcatttctcataacccccccacccccacatcctgaaggtacttgctttcttgtagaaatacttaggtctgtccgtggccctgaccctgtaaatagggcacttggcattactattgttctccaatgcccacagaaggtcagaaagcaatgaaccaatctgatcctcacagctataccacttccaatacggctaccactttttttttttggagacagagtctcgctttcttgtccaggctggagtacagtggcgccatcttggctcactgcgacctccgcctcccaggttcaagcgaccctcctgcctcagcctcctgagtagcaggcgtgtgccaccatgcccggctaatttttgtatttttagtagagacggggtttcaccatgttcgtcaggctggtcttgaactcctgaccttgtgattcgcccgcctcagcctcccaaagtgctgggattacaggcatgagccactgcgcccgcccgtctcctcctttcaacaccatatttactaccgtgtgaaaagcaacaaatgttaatatggttaatgcaatacacagtactttaaagtcttgtttcttcctatgtgaagacttccgtttttggtgtattttatatgaggcagacatatacactcattagcaatttaagtacattaaaggtattaaaaaacagaattcttttttttttttttttttgagacggagtctcgctgtgtctcccaaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccaaaaaacagaattcttaggagcttgaggattctgtttcacaaaaaaagactgacagtactcgaaatcaatcttattatagattggtggggtttgtgattaagtatgaagaataagaaatgtccatgtctgcccatgaaatcattttctcactatgctctgattaaaactgacaaacatttaaactgagattaaaaataaattctacacattaatcatttacgcattcactttaaacttgcttacacttactgataatactgctttgtcttagtttatagatgtatattactcaaaatatttacagttcatttattgggaaccaggtaatgatggtattgaaaagaagttatgaacaattctcacttaataatacctacaatttattgagtgtttattatctgtcaggctctgctctatgttagtatctgtggacctctctctaagaaggtggtatttaatggtgccttgaaaagcaggtaggattttaataggcagcacacgaaaaagcacttaaggaagaaggagctacagaagctgaagcacggaaggctgggtaccaggtgctggatagttcaatatggctggagtttacacctgtccaggggaagaacaaaaggtgatgttactaaaaagctgagaaatctgtactttacttcaataacagaagatgaagagtctggatgtggtggctcatgcctgtaatcccagcactttgggaggctgaggcaggtggaccacctgaggtcaggagttcaagaccagcctggccaacatggtgaaaccctgtatctactaaaaacacaaaaattaggcatggttgtgcgtgcctgtaatcccagctacttgggaggctgaggcaggagcatcacttgaacccagaaggcggtggctgcagtgagccaagatcatgccattgcactccagcctgggtgacagagtgagactctgtctcagggaaggcaggggaggggaggggaggggaagggaatcagaaacacaggtatagaactgactgaaggccaggcgtggtggctcacgcctgtaatcccaagcactttgggaggctaaggcaggtggatcacctggagtcaggagtttaagaccagcatgaccaacatggtgaaaccctgtctctaccaaaaatacaaaaattagccaggcacgtagtggcaggctcctgtaattctagctacctgggaggctgaggcagaagaactgcttgaacccaggaggtggagggtgcagtgaaccgagatcgtgccactgcactccagcctgggcgacagagcaaaactccatttcaaaaaggaaaaaaaaagaaaaaaaaaactgactaaagaggctaaaactagacatagggagaccagttataattcttgaaatatctatacccatcaacactttgaaattacagtgcttgttagacctgctgcctgatcttgctatttacggcattagtaaagaagcacatataaagacttcttaatttttcaaaagtggtatttcagcataactgattccctttgtaatctcacattttattttattcatttaaaatattaatctgaaaaggagccacaagtttcaccaactgcctaaaggattcacgtcattaaaaaaaaaaaaaaaagatgagaactcttgttataagggcaatttatagattcagtggaaatggcagagacaggaaactagtacagaagtttgtattcaagagaaaaaaaacgtcagtttgggatcgtaaaggatgtgcatcaaataactttaaaaacatttgaatgttaaagttaattttatttatcaaataatcacctacattatgttaagcactgtggataaagcagtaaaaatataaagctctctgccctcataaactatgagaggagatagacatagaggctgggtgcagtggctcatgcctgtaatcccagcactttgggaggctgcggcgggtggatcacctgaggtcaggagtttgagacctgcctgatcaatatggtgaaactccatctctactgaaaatacaaaaattagttgggcgtggtgccgtgccatctgtagtcccagctactcgggaggctgagacaggagaatcgcttgaacccgggaggcagaggttgcagtgagctgagatcgcgccactgcactccagcctgggtgacagagggagactccatcacaaaaaaaaaataagagagagagacataggtattaataaacatatttgtcataaacatgactacattataaattatgataattgctaaggaaaatgcaagttatataattaatgttattaaggataactagaaaacttagtttaaattagaagcttacggaagactcttcttctctaaagaaattagggaaggcatttaaacagagaactgaaggataagccggaattagccaggttgctgggtggcaaaggcagcaagtattctacaagcagggagagggtagaccagaagtagaccagaagtagaccagaagccctaagaagaccactgtggctacagtgtaccagagagagcgtggctcacgatgaggcagaagaaatgcgcagtgacccagcagttatgctaaggatttatcttttaagtgtcctttcactttaaactggggaataaaagtatccaacttatattttgtaaatgatcttaccaaataagagaaaaactgaactgtaaaaaggaaaaagtggctgggggcagtggctcatgcctgtaatcccagtgctttaggaggccaaggcaggtggactgcttgaacccagaagttcgagatcaggttgggtaacatagtgagatcctgtctctattttaaaaaaagaaaataaaaataaaaaaaggaaaaagttaaaaaaaaaaaaaaaggaaaccgttccaagcactgccataataccagcaagaggtgactgacagtggcgtggactaagcaacaaggatgtaattggcatgttaagcaggtcagttcagtgttcagtgtgaaaccataccacccactgcaggacatctagcaacccagacccaaggtcactatcaatccagcagcactctcaagtcagtaaaataataatttaaaaaaaaaaaaaaaacacccaccacatctctgaagggagtagtaaagtccttggaatgcgtaagagcagtgacagtggaaatggaaagagacagccaagactgaaagggaaaggctgctgagtgggatccacgaatgagatggtgagcagagcaggccagataagatcatcaaggtcaaaaatgaattgtgcagagaggagaaaaaatttgcaatatgtaggacttgtatttagcatacataaagaactcttaaaacttcaaaacaagactacaaacaacccaatattacaaataggcaaaagaataaacacttcctttgtgacaacaaatatgaaaatatgactgatgagtcataaaggaaatgtaaattaaaaccaaatacccattagaatagctaaaataactgaccaataccaagtgttggtgaggatgcagcaaagttgaaactctcatatacagatgtctgtaggagctttattcctaacagccctaaactgtgtacgacccaaatgttaattaacaagcaaagggtaaacaaactgtggtacatccatacaacaggacagtactcagcaataaaaggaattactactaatccatgcaacaaggacaaatctgaaaaacactatgctaaatgaaagaagccaaacacaaagagaacaaacttttaaatcccatttatatgagattctagaaaagctgaagctaatctatagtgataggaagccgtggctgggtgcagtggctcacacctgtaatcctatgactttgggaggctgaggtgggtggatgacgaggtcaggagtttgagaccagcttggccaacaaggtgaaaccccatctctagtaaaaatacaaaaattagctgggcgtggtggtgtgcacctgtaatcccagctagtcaggaggctgaggcaggagaatcggttgaacctgagagacaggaggttgcaatgagccgagatcgcgccattgcactccagcctgggtgacagagctggactctgtctcaaaaacaaaaggaaagaaagccgtgcttgcctgaggcacaaactgactgcaaaggtacccaagaaagctttttgaagtgatgtaaatattctgtatctttattgtggtggcagttacacaactacatacatttgtcaagatttcactgaacagtacacataaaaagatacattttattgcatataaattatatctcaaaaggtgattttttaaaaatttagctgtgctacaaaattaaggggttgattctctttcatggttcataagctcatattcaaggaaattccaagggaaatgttccaaacaggttttaagtaatgacagtatcattagaataaatgcccagccttccacaatcatttcaaaggctttgacataaaatttctaatatttttaggttttcttcccatcctcttcatcccctgtcattatagtcatgtctcatagcagaggctcaatatttgtggataatatatccaccttatttagacaaacgttattatcatgcacaagcaccatatactgtagcaactaaaatgctacctaacaactgtgaatgggttatttttagggaaagctattaagctgttctctaagccacccattttggtgaactttaattatctgaacacgaaactacagcactctgtttcacagataaaaattatcttgtcttcagatgctaagtaagttagactgagccaaactcatgttccaaaaataaataggtagataatactaatgattgctttaaaagaaaatgtattccttactttagcttggttctctgacaattcactaaccaagaaaaacagtgcaaaggtttttttttttcagatgctgcaaaccattaagtgaactattaaaagctagcctaaggttatttaagcaataaaaccagtaatagcaaatgcttagcatttattcataattttttattattttaagagccaatgttccaatgtactataggtaccatggcttaaaatctagtcattaacaagtatgcaacttctctagaaaaggtgctctggagagcccagagcttgaacaagttttgttggttacatatgcatttgtcaatttcttcagtaataaaacagactaaaagacccagaaaaggtttcaattctggtcctatccctcactagctgagagacactggctgaattacttagtatctctgagtaatcacttgcttggctagaaaatgaggaaagcccggggattgtgaagattagaaaaagcagatgcagcctaaaagatagtaggccttcaaaaaaaagttgtatggtcttttaaaaattattttacttggccgggcgcggtggctcacgcctgtaataccagcactttaggaggccgaggcaggaggatcacgaggtcaggagatcgagaccatcctggctgacacggtgaagccccgtctctactaaaaatacaaaaaattagctgggcatggtggcaggcgcctgtggtcccagctatttgggaggctgaggcaggagaatggcatgaacccgggaggtggaggttgcagtgagctgagattacgctactgaactccagcctgggcgacagagcgagactccgtctcaaaaaaaaaaaaaattattttacttattattattcattacatttatcatgtgataccctaaaaaggaagtaacatcagaaaagaacactgggcttcaaatcaggaggtctgagttttagtcctaactcagctatgccctacatatatgctttgataatgctggccaagttacaaaaagaagattccattatttcatgttcaggctacatccaaacataagcagcacaaaataaaaaatatggataaagagacacactcagttatacaggtgtatgcgcagacactgacatagatgaagacttgtagtgacttatattcagaaaagtttccacaaatttttggtgaactgtggtacccaaattattaaagtatgaaaaacatttctctcttcatgaatgggaaaaatgtctattttacttgatctaagatatactaccaggatttagtactgcgactatccatcatcttaaaaatccataaccaagcagctctgttttacttaaagcatgctagggtagcccaaagtgagacttggtaacagatactatctaatgcaaagcagttactgcttagaagtgttctgaacttgccatgagaaagaaagggagaccctgatgaaatagatggagtatccacttcttgatcatttccctacatttcctttctcctcatttatttcctcccactttcactggaaaagaactttacaatggtctgggtgaggctagctggcagtgagttatgacaacagctagaagtagtatcaacacaaaccaagagcattaagtgacccctgaggtagagtgagaaaataaggaaggactacatttaatcataatgatcatagtcactagcacagtgctaagaacttaagaaaaatccttatatattatcttcaccacaaccctatgaaacataacccctactttatagatgaagaaactgaggcagagtggagggtcaactaacgtgtccatgattacatacctagtagttaacagaactgagattcaaatccaggtgtgctgacccccaaaacccatgttctgaaccatgacactttatataggccaacagtccttggccacaggctcttgtggtgatcaaccaagttcaggttcatcattgagccagattcagacaggtcaactgaaaagaagctgaagaaggcaggcagtaaggacaagaaaaataatcataatgatcatgatatagaaaatgtactgcttcccaaagtagcctatccatttggaaggttctggctatttagatctatttcctcaggataagtcaaaacctgtctttcctgaaataaggtgagtatgtgctgtaaatgaggtgtgggagtatgggagagcaggctggaaggcagaagatgtgaaggcaaaccaggcacagggaaggtgagaaagggacccgaacggggacaagttaaaagaaaacattgaagactcagcagaaagaatccagagatgtttagtgctgccaatcatgacaattaagtgactttctccagtatgtatcagcagtctgagcaagatcagacaaaataaacagtagggttcctatagagtgggagtggagagatcaggagaactgagaatctggtcagagtggggaggtcagcagacagaatccagagcgaggccagagaggaccagcacaccgggaaaacacaaaggtgagggtctcaagccaggggtcgtcagggagagagggcaggatagggagccatggtctagaaaagaggatgatctactttgtcatggtgaccctggcatgcttttgtaagctgtaccccaacgagtcaagtcaaaggaagagaggctcagatgaccacctccgtcactgaaatgtaagagtgaagaaatgcaaatattttctgaactgcctcacttttggaaatattaaacacctgtctcagaaatctggaaaatgactaagatggggaaaatgtttaaacttgcagtatccagtattattatctaaactgaaaagaactgcctgcacaactaagcaggtggtgagatgttacataacagatgctaaactaggtaaagtggaaaaatgtaatacataattataactttaaaatgccagtaagaaaatcttcagtcagctctggaaaactaattttacttcttttcatgaaaaagttgcagttagtttcttttgcaacctgtcatgatagaagaggaattgcagaaggaaaggaagaccctaaacaaaactgataatcattcatctgtatgtgttttaaaacatatgcaggtagttttcatatatggctggtgggaatgcaaactgtacaactcttctggaggggaactgggcaatacctaacaaaattatatatgtgtacatcttttaacccagcaatcctacttctaagaatctactctgaaggtacacctccaatgatatgaaaaaacatatgtacaagattatccacagtagcactatttgtaattgcaaaatactggaaacaatctaaatgcccacacattggaggagactgaagacactatgttatatccacatggagtactatgcagcagtaaaaatgaatgaaaatcattctaagatgtctaagaacagacacagaatgaattccaagatatattgttaagtgaaaaaaccaaagtacaagatttagactatgctatccttcatataagaaatgggcaataagaacatatacatatatctgcttatttgtacaaaagaaatacaggaaggataaaccagaaactaaagagatcagctacctacaggggataggtgggaaagggataaaacgaaatgggaatggatggtagggataaggaaggagtgatatttctctgagtatatctttgtgtatagatgactcaaaaccagagtaatgtagcgcataccaaaaaaattaaagaacccagaatacaaacagtaacaagtgaatctaactgcgttacaaaggaataacataaccacactgaagggcatgaggaagaaactttgaaaacctattttgactggatattgtaaagctaaaggcataaagaactgtaacacaaatgctgctacctagtaagtaaatttgtttctcacaaagatgtgagttagcaattctgacactaattcatgtagacagtggtactgactgaaaaagtaagtttaaaaaaatgaaggataatgacagccaggttggcaaaataattacaaataagagggaaggctaaaataaaccacacagtgttggattagaatgagatatcagtatgaactcataatttctaacatatacacagacatacacagaaataaacatagatacatgtgtaatatgtagctgagtatacataagcctattttcctagttctgtctgctgagaagacttagaagcagtgacacccagtagcaatgagcacacttaaaagcatattgacagccaggctgtaatcccactttgggaggccgaggtgggtggatcatttgaggtcaggagtttgagaacagcctggccaacatggtgaaactcctcttttactaaataaattcctttactaaataaaaaaattagccaggcgtggtggcgggcatctgtaatcctagctactcaggaggctgaggttcaagaatcacttgaacccgggaggtggaggttccagtgagccaagattgcaccattgcactccagcctgggcaacaagagcgaaactccatttcaaaaaaaaaaaaaaaaaatacaaaagcatattgaaagggcctagaggccaacctgaaagagcaaactaaagttgaaattgtaacaatctgagcaacaaaataaatcacagtattagactaaatccatagaataaaacacatatccatgcatccacacctatataaataagtgaataaatgagagggaggatagttcttccttacagatgcactccaattaatacagaaggaatgaaggaaattggggaaaaaaatcagaattaggcaaaaaccacaataataagtttcagacaagacccatggatggatgctaaaatcagtgagtaaaattgatcacagtctcagagtacatcccctaagatgtctacgataatagtcgtaaaaggataaacaggcagataccaccaccttaaccaaatgattaacatctaagacacagcaacatcatgaattctcagatatgatgtgctgagaagagcacaacacacttaaaaatgcataatctcattctaatcatgaaaaaactcagacaagtccaggtgcagcggctcacgcctgtaatcccagtgctttgggaggctgaggcggatggatcacctgaggtcaggagaccagcctggccaacatgatgaaaccccatctctattaaaaatacaaaaaactagctgggcacgatggcaagcgcctgtaatcccagttatttgggaggctgaggcaggagaatcgcttgaacctgggagacagaggttgcagtgagccaagattgcgccactgcactccagcatgggcaacaggggcaaaactccatctcaagcaaacaaacaaacaaacaaaaacaaaaaaatcagacgagccaaatgcagtggctcacacctgtaatcccagctatttgggaggctaaggcaggaggactgctttagcccaggagtttgaggaagaccctgtctcgaaacaacaaaaaaaaccctaagaataactgtcctagactgtgtgtatatgtgtgtatgaattgggattttattttgtaaaggaccccaggtgattctaaagttcaactaagatggagagtcactgcaccaacccttttcttctcagctcactttgtcctgggcccatatctcatggttttgggtctactgtggaagtaccttctctacagaacaaagacaaagcaatagaacccaaattcttccaattccctttgggatctattcccttcttctcctgcctaccagtatgaacttctatgggattatgctgatgagaaaaaataaattacatttaagtgactgataccaaaaactggaattacttcacagatgagaaacctggtcccagatacagtgcaccttctggacctcagtatcttcaattttaaaatcattgttttgaatctgatttctaattgttaagctgaagtgtttctttaaatttttaagttggttaaaatgtgtgtgtgtgtgtgtgtgtgtgtgtgtgtgtgaaagaacctgctccctcatcctcaacagcctcatcaatctccacccattacccatttttattagttgcttatctttccattatttcctcatgcaaacacaaatacatattaatttatttacacgtattagagtaaagtgatttctaaatctgaagaggcatcagactcatccagggagctttttaaacaagtggacacttagtttctattttatacctattgactgaacaaaacccctggagagtggagcccagaactttgacaaagttctctcaggcagttttctgtgacagacacctctcagggtacttaccccagcccacatcacctttacccaatagggatctgtccccttttgtctgtgctgttgagagtattgctcctggccacagctgatgaggtactacccagcccagacaagaatccattctaaggtagagctgggccaactagctcctcttctcagacagcctggagctggagcacagagactccaaggggccaggctggctggcagaagagtatctggttgcataactgggaatgctgggatgggccacatgcacccagacttcattctgcagagaggagccaagtagtagacagatctggactgcagaaacaaggcctgctgctccacagagaatgacagaggcactgccttggttctcagtgacttcccaattcttcaatctagtcctccattcctcaggtcttcagtaggttttctggagtgagtgaaggcagcaggagtttcagcagtcgtcctgcagatcatctgttactctgaatatgcagtgggtgagtgttgtgggcgtggctgttatctgggggcaggttgaaaagctgcaacactgccactgactctggcagttatttctctgtctaggtctttgcttgtgtttggaacagatgtatttactgctcaagagtgcaaatgaggagacaatatgggaagaaaagaaaagaaatttcagaaataagatttccactgtaacttgagaaataaaaaatttgagtaatttcacaagaactcataattctgcttaactagtattccgtaggatgacagtggcaatgtggcagcttttcaacctgcccccagatagcagccatgcccacaacactaacccacgatacattcagagtaacagatgatctccaggacgaatgttcaaacttgtgccgtcttcgctcactcccgaaaacctacttaagtgatagagtatatttgaagaaataaccttcaaactattcaacttttattttgggtcaagatacaaagccttggtcttggaagtcctgaaacctgaattcaagttcttgtattgtatcacagctctgtgcttgtaacctcgggcaattatcttaacctcactgaacctcagtatcttcctctgtaaaatgtaaagaatacttatctcacatataaggttacttggatgaacaggtacgtgaacttgtttcataaattcaatacaaacagtgtcactgccatctagatttttatcactttcatctccaatctcacttttttcattattttaatataattttaaataattacctttttttttgagatggagtcctgctctgtcacccaggctggaatgcagtggcgcaacctcgggtcactgcaacctccgcctcccaggttcaagcaattctcctgtctcagccacccaagtagctgggattacaggcaccccgcaatttttttgtatttttagtagagacagggtttcaccatgttgggcaggctggtctggaactcctcgcctcaagtgatctgcctgccttggccacccaaagtgctgggattacaggtgtgagccaccgcacctggcccttaaataattaaatttaataatcattatcattcttattctttttgttgataactgtaaactctgcattagttttccttatatttcttttcctttttttttttggagacagaatctcgccttggctagagtgcagtggtgcaatcttggctaactgcaacctctgcctcccgggttcaagtgattttcccccctcagcctcctgagtagctgggattacaggtgcccgccaccacactcagctaatttttatatttttcagtagcgacagagtggtcaggctggtctcgaacccctgtcctcaggtgatccacctgctttggcctcccaaaatgctgggattacaggcgtgagccaccaggcctgcccagttttccttatatttcattaggcataaaaattatgaagctgggtgcggtggctcacacctgtaatcccagcactttgggaggccgaggcgggtggatcacctgaggtcaggagttcgagacccgcctgaccaacatggcaaaaccccacctctactaaaaatacaaaattagccaggcatggtgctgcatgcctttaatcccagttacttgggaggctgaggcaggagaatcacttgaaccagggaggcagaggctgcagtgagccaagatcgcgctactgcactccagcctgggcgacagagcgagactctgtctcaaaacaaaacaacaacaaaaacaaaaaacaaaaaactctatctatctatctatctatctatctatctatctatctatctgcatgctaatttttagaacatgataactacataggactttaaaatagttaaaagtcctaccatagagtcgaggtgacttagccagtcacccaaaaacagagctaggattaacccttattcattcttctgaattctatgttctttccattatacaagaatgtgcccagaaaatcctacacaacagaactctgggaagagctaagctgagaaatggtacagaatgctgccttcaaaacccaagaaaataaacacattataaacaaagaacaaagataagactcaactgcaaggaacacagcaagcaaattttaaagggcagcccaggaaggagctgagagtgttaagtacaaaccatcaaggctcaagagaaaaggagatggcttcacagaatcaaaaacccacaagaagtcaggcatgatggctcgcacctgtaatcccagcatttggggaagctgacgcagatggatggcttgcccctaccagtttcagaccagcctgggcaacacagaaagcagtctccatcaacacgaaacattttaaaaattagctgggtgtgatggctcctgcctgtagtcccagctactcgagaggctgaactgagggaggaagggacccagaatcacccagctatgatcactgcagtctagcctgtgcaacagagaccctgtctctaaaactaactaaagaaataaatagcaggaagaagtaaaaagaaagatctaggatgcaggaagagaatgagaagacacatacccggacccagccaaaaaaataaaaatcaacaatgattactctcgaaattgatgttatgaaatcaatgccaaacagtaatacataaataaataaatcctgatacaaaatagtaaaatgcatgcagaaatgtaagcaaacaagagtgcaaaagaatacctgcacactcagagtcaagtagggctggttctacattgttaaaggacacagaggctggctgctacacgctgggggagggaagaaatggagagtgactgctcatgggaatggggttgctttttgaggtaataaaatgttctgggattagacagtggtggtggttccaaaactttgtgaatatatactgaaaacaactaaattatattctttttaaaggtgaagtttttcttttctctggtaggtaaattatgtccaaaaaaaaaaaaaaaaaaagcatggtcccttcaaacaaaaatcccttttctcagatcattatttcaggagctaacacttaaaagagagatcccttcactctggaaagctgacagtaatcaaaacagggcatgaaagcctggagcagggagacagatcagctctgggagttgggatggggaagaagagagaaatggcatcttgatgatactttttatcctggccaacccacttcaccagcgaaaagctgataagcactcaagacagaggccctacactaaagaatttaaaagtatacaggccgggtgtagcaatttgtacctgtaatcccagcactttgggaggctgaggcaggcagatcacttgaggtcaggagttcgagaccaggctggccaacacagaaaaacccagtctctactaaaaatacaaaaattagccaggtgtggtggtacatgcctgtagtcccagctacctgggaggctgaggcaggataatcacttgaacccaggaggcggaggttgcagtgagccaagattgtgccaccacactccagcctgggcgacagagtgagactcaaacaaacaaacaaacaaaaacaaaaacagaacttaaaagtatacatctggggggagaaaaaaaatgtaggggtggacgtggtggctcatgcctgtaatcccagcactttgggaagctgacgctgtggatcccttgagcccagaagttcgagatcagccctgggcaatatggagaaacccagtgtctacaaaaaatacaaaaaaattatctgtagccgggtgtggtggcacgcgtccgtaatcccagctactcaggaggctgaggcaggagaatcgcttgaatccaggaggcaagaggttgcagtgcgccgagatcgcgccactgcactcctgcctggacgacagagcgagactccgtctcaaaaaaaaaaattatctggggtgatggtgtgcgcctgtggtcccagccacttggggggctgaggtggtagaatcacctgagcccaggagatcgaggctgcagtgagccatgatcatgccattgcactctagcctgggcaacaaagtgaggctgtctctaaaaagttaaaaataaattaaaactaaaatgagggccaggtgtggtagctcacgcctgcaatcccagcactctgggaggccaaggtgggaggatcgcttgagtccaggagttcgagaccagccttggcaacatagtgagaccctgtctcttgaaaataaaataaaaaatttaaaaatttttaaaaactgaaaaaatgaagcaatataaatgcccaacaaatgggggcaacagttatataaataacctgtttttaataaaatttaacattatgttgatgttacatgttggagtcagatacatagaaaaaggaaaaaataggacacaatagtatgggataatcattacgtaggtttaaaaaaacaaaagaatccttgctgagaacaggtctggcagagcaaagtgagctttagcctgaagtgggagggagaaagtaaaacagtgggcagggctctggaggaaagaaggatggtagtgcttcaaagggaagcagaagttttggctttgttttatttttaggacagaagagtgatcagcccctaggaatttggatgagatcatccagagagtgtgtatgggacacagagggcccaagaactaagaacaaagagtcaaagacttgggaaaaccagaggtgtctcagcaaagtagtagatgtaactttttaaaaaggaaatggcttataacatcaagtgctccagaaaaaatcaaaatcttttgattttccagggagaatggcaaaaaaaggggaaaaagaatctttggtgaggaaggccttcaggaaaaagcaaccagtccagaaagatcaaaatcaagaaagactgtacatagagtgtgcacaccatcagttcagagtgcaagagtgggggtagggggctaaagtctggctctcgtgggcagaagaggtgggcacagaaagcagagcaagcagcacgaaccattcccgagagagcctgactatgaaggggagagaacaaatggcacttgtctcacagactctggggcagtgcccaggaaattaaatttaggactatatatcaatttaaaagtactggatagagtaacgaaagtgatgttttcagtaagtgttgtacagcagaaggcttgtttttgttgattttaaaaatctttcatgggagattggagagatgctggtaaaaaaaaatacagcattaaaataaaatctttcactataaaactagctagtacggccaggagtggtgactcacacctgtaatcccagcactttgggaggctgaggcggggtggatcacctgaggtgaggagttcaagaccagcctggccaacatcgtgaaaccccatctctactaaaaatacaaaaattagccaggccgtggtggttcatgcctgtaattccagctacttgggaggcggagacagaattgcttgaacccgggaggcggaggttgcagtgagctgagatcgcaccactgcactccagcccgggcgacagagcaagactcggtctcaaaaaaataaaataattaattttttaaaatgctagtgtaacttcagaaaacttagaatatgattttaaataaaaataataactaaactaaaaaagcaaatcctgtataagcccttagttacttgggaagtcatttaaaagttaagcccatatcatctcaaattccaaaacttattgcaaggtaaataatcaaaagggtggtgctggcacaaagaaaaaagatatagattgatgggacagaaatgaaaatctagaaataaacccatctatggtcaactgatttttgacaagggtgccaacaccactcagtggggaaaggaaaagactatcctttcccttcaacaaatgatgctggtacaactagacagccatgtgcaaatgaataaagctggatccttacacttcacaatatacaatggctcaaacacttaaatgtaagagctagaacaataaaactctacaaagaaacatagggataaatcttcagggtaaaccctgaaaatctggcaatggattcttacatatatgacatgacaggcataaacaacaaaagaaaaaaatagataaattggacttgaccaaaatttaacaactttgtgcttcaaaggacactagaaagaaaatgaaaagacaactcacagaatgagagaaaaatatttgcatatcatgtatttgataaggaatctgtatctagaatgtataaagaacttttaaaactcaatcacaggagctgggtgtggtggctcatgcctgtaatctcagcactttgtgaggctgaagtgggaggatcacctgaagtcaggagtttgagaccagcctggccaacgtggtgaaacctcatctctactaaaaatacaaaaattagctgggcgtggtggtgggtgcctgtaatcacggctactcgcgaggctgaggcaggataatcgcctgaacctgggaagcagaggttgcggtgagctgagatcgcaccactgcactccagcctgggcaacagagtgagagtgtgtctcaaaaacaaaaacaaaacaaacaaaaaaactcaataataggccaggcatggtggctcatgcctgtaatcctagcactttgagagactgagatgggaggactgcttgagcccaggaatttgagaccagtgtgggcaacatggcaagtccctgtctctacaaaaaattaaaaattagccagatatggtggtgcatgcctgtgatcccagctacttgggaggctaatgcaggaggactgcttgagcccaggagttcaaggctgcaacgagccgtgatcacaccactgcactgcagcctggatgacagagtgagaccctgtctctaacaaaacataattaaaagatcaatacttcaatttatgttcaagtggttaaacacagaattaccatatgacctggcaaatgaaaaccatgaccacatagaaacttgtacacaaatgttcgtagcagcattattcataataatcaaaaggtggaaacaaaccaaagctccatcaactgatagacaagcaaaaggtggtgtatccacacaatggaatattattcagccataaaaatggaatgaagtactgataaatgctacaacatggatgaaccttgaaacatgctaagtgaaagaagccacacatgtgatgccatttatacaaaatgtccagataggcaaatctatacagatagaaattagattggtagttactttacactgaaaaagaaggggagagagagagagagagtaaatagctaaaggatacaggattggtttctttctttcttttttgacacagggtctcgctttgttggccaggatagagtgcagtcgcgtggtcacaggttactatagccttgacctaggctcaagcaattctcctgcctcaccctcccaagtagctggaacctcagggccatgccacaattcctggctaacttttaaattttttgtagaaacaaggtttcactattttacccaggctggtctcaaactcctaggctcaagtgatactcctgcctatacctaccaaagtgctgaaattacaggtgtgagccactgtatccagtcaagggtttcttgttgaggtgattattctaaaaattgactttgatggttattaaacatatctgtgtatatattttaaaaagctaccctgggaggccaaggtgggcagatcacgaggtcaagatcgagaccatcctggccaacatggtgagaccctgtctctactaaaaacacaagaattagctgggtgtggtggcgggagtctgtgatcccagctactcaggaggctgaggcaggagaattgcttgaacccgggaggctgaggctgtggtgagctgagatcacgccactgcactccagcctggcgaaaaagtgagactccatctcaagaaaaaacaaaacaaaacaaaaaaacacgctgaattgtacactttaaacgggtgaaatgtttgtaaattatctctctctctcttttttttttttttgagacagagtctctttctgtcacccaggctggagtgcagtggcgcgatcttggctcactgcagcctctgcctcctgggttcacgcaattctcctgcctcagcctcccgagtagctgggattacaggcacacaccaccatgcccggctaattttttttttgtattttcagtagagacggggtttcactatgttggccagactggtcttgaactcttgacctcgtgatccgcctgcctcagcctcccaaagtgctgggattacaggcttgagccaccgtgcccagccataaattatatctcaataaagccttggttcttttgaagttaagtccctggggcaagaaatatactagatgaacttagaacatattgtagtgccaggaagtatggagctaaacatttttttacatgtaaataattaaggtatgtcaaagggacacagaagccaactgaaagagctcccaatgcccaaagctggaaaaacataagcaccaaaatcgaagtgccattgggattgtaacccaaaatgtaaaattaatattcacaagtccatagtgatatatacaaatggggagaagagacaatctcccaaatagaagaataccaaataatttatgttgatactacaccatcaaggaggtggaagataactccctactccttcagtgtgggatacacttaatgacttgcttccattgagtatattacgcaaaaaggagaaaacagtgagacacctggcaaacactttagccaggtgatcaaggtcaacaacaagagtgttctgttgacagtatatgcccttgatgtgatgtgatgagaatggcactatctttgtggtcttcctcccctccaaacccacaaccccactttaatcatgcgaagaacattaagcaaagctgggcatggtggactgtgcctgtaatccctgctacttgggagactgaggcaagaagatcacttgaacataggagcttgaggctgcagtgagctatgattatgccactatactccaccctgggcgacagagtaacaccctgtctctaaaataaaatttttaaataaaataaaaaatttattttaaaaaagttaagccctttttagtatttaaatatattgctaacaagtaaaaaaaaatgcatgaataatgatatggtttaaaatttttttttttgagatggagtcttgctctgttgcccaggctggcgtgcaatggtgcgatctcagctcactgcaacctccgcctccagggttcaagcaattctcctccctcagcctcctgagtagctgggactacaggcatgtgccgccacgcccagctaatttttgtatttttagtagagatggggtttcaccatgttggccaggatggtctcaatctcttgacctcgtgatccacctgcctcggcctcccaaagtgctagaatgataggcgtgagccactgcgcccagccggttttaaaattttgactgttggccaggtgtggtggctcatgcctataatcccagcactttgggagaccgaggtgggtggatcgcttgagtccaggagtatcagagcagcctgggcaacatggtgaaacctcgtctctacaaaaattacaaaaattagctggctgtggcacacgtctgtagtcccagctactaaggaggctgaggtgggagaatcacttgaacctgtgaggcagaggttgcagtgagccaagatcgcgccactgtactccagcctgggtgacagagtaagaccctgtctcaaaaaaataaaataaaatttttactgttttcaaagactgattagtggtctggaaaatgattatactactgtgttggatcaaagattcagaataccaaatgatatgatgtatataaaatgtaatcccaattttactaggaaaaaaatgtgccaggatgttgacagcagatatccctgggtagcagcattacaggtgaatgctttttgcataaatgtgcctttctgtgttttccaaattttctctaaagaaaaaaaactgagatgattatcaaactatattatttggggattacaaattgtagcaagttcaggagaagcacagattcattagcccttggaacaaagctgtttcagaattcagtatttttcagattttagaaaggtaatacagtgcatacatatgtgcatacatccctggcgaggtctggtgtgtaccaaggaatccagcactgatatttctgcagcaaacatacaaataatcacactagatgggaaaaatacagactatgaatagtctcgtggcagtccacgtcaggttttgccccaaatgagcttacaaaagatacccagaaaggtctgaaaccctgagctgcaaataaagcactgtggacctgtggaaggatcctgaatgaggaatgagtttcaaccgttagaaccaattccagtggcgacgagcccctccctatagttttgctgaagtaagaacacttttatttgtggtgtgaggggtacagaccatatttagagatgagaagacatcagaggcagaagaaggggtaaagagaactcacttcttcagcaaagggtaaggctgagctctcctgtcagagaggagagtgcaggggtcaccagacagcactctgaggatcactatatctcaaccaagcccatcaagtttgtacttctgatatgtctgataatttacttgagttatgtcatttaacaggtcggccaagccttggagatctagtcagaatgcctgcatgcatatttttaaaatttagatgtatacatacttataatggagagtaaagattcaaaacccaaagaattactaggatatttttaaagaacaggtgagatttattaggaatagacatagtgatcaaatggttatagaagacaggaacacaacattaagctccagtgtacttatcccctttataatgttgatacttatgatacagtatgtaaataaaatattacctacccttacattgtagcaataggcttaccttttaacatggctttgctacaaccaacaaggtggtgtccactctaggtagtccacattcagtttccaaccatcccattaaaatcccttcgtctgttttgtgttgccataacagaataccacagactgggtaatttataggaaaagaaatgtatttcttatagttccgtaagctgggaagtccaaggtcaagaggcctgcatctggcagaggccttcttgctgtatcaccccatggcagaagggcaagcaaaggcaggagcgtaagagacagagagggcccaactcacttttagaccaacccactctgtgataatgacctaaatccattcatgagggcagaacccccatagccaaatcaggtcttttttttttttttctttttttctcagatggagtctcactctgtcacccaggctggagtgcagtggcgcgatctcagctcactgcaacctctgcctcctgggcagtgtgttggcaaggttgtggagaaactggaatccttttgccctgttggtgggaatgtgaaaaggtgcagccactttggaaacagtatgggaggctgagttgtgaggatcacttgaactcaggagtttgtggttcctcaaaattaaacacagaattaccatatgatccagtagtgcccttctgggttcctacccaaaagaatcgaaagcagggtcccaaagagatagttgtacacttatattcatagcagccttattcacaagaggcaaaagcaacccaagtgttcatcaacagatgagtggtgtgtgtatttacaatggagtatattgttccaccttaaaaaggaaattgtgacacatgctacaacatggatgagccttaaggccattatagtaagtaaaataagccaatcataaaaagacaaacactgtatgattccacttacatgaggtacctagagcagtcagacttcatagagacagaaagtagaatggtggctgccaggggcttggaagaaggaaaaatggagagttatttaattgctatagagtttcagcattgcatgatgtaaacagccctggaggccaggcacggtggctcacgcctgtaatcccagcactttgggaggccaaggcgggtggatcacgaggccagcagatggagaccatcctagctaacagggtgaaatcccgtctctactaaaaacacaaaaaattagccaggcgtggtggcgggcgcctgtagtccccgctactcaggaggctgaggcaggagaatggcgtgcacctgggaggctgagattgcaccacggcactccagcctgggcgacagagcaagactccgtctcaaaaaaaaaaaaaaaaaaaagagctctggaaattggttgcacaatgtgaatctacttaatgctacagaacagtacacctaaaaatagttaagatggtaattttttttttttttttgagatggagttttgctcttgttacccaggctggagtgcaatggtgcaatcttggctcaccgcaacctctgccagccaggttcaagtgattctcctggctcagcctcctgagtagctgggattacaggcatgcaccaccacgcccggctaattttgtattttcagtagggacagggtttctccatgttggtcaggctggtctcgaactcccgacctcaggtgatccgcccgcctcggcctcccaaagtgctgggattacaggcgtgagcacctggccaagatggtaaattttgttatgtgtatattaccataattttttaaaaaggctccatgaaattatctatgtacataggtatctagcctatatcccacagtcattcactccaatactttattctctaccccattctgggatgcataaagattgctcttaggattacatagtgatttagttaatacagtcatttcaacactcaaaagacatgatccttgtttcaccagagtaaaatgagactctgagaagttacaggacatgctctaagtcacccagccataagtgtcagagctgaattttcaaatgcagttactaatttgataaatgagatatgttaccttgctgttcttaaaaaggcttgtaacttcagtgaggaacttattcctgtcttcattcatgtattcaactaatatagagaaatgaatgggaaagtgaagagaagatgaagactattacggagatggcacagggttagccagccttatttgtgttatgcagatggggaaacagacctaggcaggaatctgcctgattcaacaaatatttactgagtacctactatgtgcaatgtgtatactaggtgctggggatacagcagagaacaaagtccccactctcaatgaaaggggccagtctttttattcatctttagttaattttaagcacacaacagctatctcaaactttcttcacactttccaagcccctgatcccttatgtactcttggcagatgccccaccttatctcttaccagaacctaaggccaactagcataaaatcccttgagcacacttagattggcatgcttttactgtgacatctgttcctacagcacccttactttcttctcttgagctgagggtgaagatctctttctttcccatctgtaatctcacaatatgcacaactacaccagagacaatggaggcacaatacaggccagaggtctgttcctcattccttctgcggggccttcctccagtgaatatctcttctaacattgtcaatcatatccaacagaaaaagagatctctccattggtacaaaaacctacagctcctaagaagattttgactctcactgctcaacttctcaaataaaaattcctccactttagttctaattatcactcaaatgctgttagacctgtgggcaggtcactatatccctgcctaggtctgtttccccatctgcgtaacagagaaataattgtgctttatctgtcctacagaagtgtgaagaggtttgatgtgacagcagtgaaagcaatttaaaaagtacaaagtgctgtataaaagaagacgttttcataattattctgttttcacatgctatctttattccaatgatctcaaagtacctacccaagcacagttctaactctagtatatgtaagcaaacgtgcaagtctgtcaccttccacacaaagagtccccccacccccgccaaacacaccactccctctccctctccttctccctctccctctctccttctcccgctttccacggtctccctctgttgccgaagctggaccgtaccgccgtgatctccgctcgctgcaaccttcctgcctgtttctcctgcctcagcctgccgagtgcctgggattgcaggcgcgcgccgccacgcctgactggtttttgtattttttggagacggggtttcgccatgttggatcggctggtctccagctcctaaccgcgagtgatctgcctgcctcggcttcccgaggtgccgggattgcagacggagtctcgctcactcagtgctcaatgttgcccaggctggagtgcagtggcgtgatcttggctcgctacaacctccacctcccagccacctgccttggcctcctaaagtgccgagattgcagcctctgcctggctgccaccccgtctgggaagtgaggagcgtctctgcctggccgcccattgtctgggatgtgaagagcccctctgcctggccgcccagtctgggaagtgaggagcgtctctgcccagccgcccatcgtctgggatgtggggagcgcctctgccccgccgccccgtctgggatgtgaggagcgcctctacccggccgcgaccccgtctgggaactgaggagcgtctctgcccggccgccaccccatctgggaggtgaggagcgtctctgcccagccgccccgtctgagaagtaaggagcccctccgcccggcagccgccccgtctgggaagtgaggagcgtctccgcccggcagccagcccgtctgggaggtggggggcagcccccgcccggccagccgccccgtccaggaggtggggggcaccccccgcccggcagctgccccgtcggtggggggcgcctccgcccggccgccccgtctgggaagtgaggagcccctctgccgggccgccaccccgtctgggaggtgtgcccggcagctcattgagagcgggccatgatgacaatggcggttttgtcgaatagaggggggaaatgtggggagaggagagagatcagattgttactgtgtctgtgtggagggaggtggacatgggagactccattttgttctgtactgggaaaaattcttccgccttgggatgctgttgatctatgaccttacccccaaccccgtgctctctgaaacatgtgctgtgtccactcagggttaaatggattaagggcagtacaagatgtgctttgttaaacagatgcttgaaggcagcatgctagttaagagtcatcaccactccctaatctcaagtacccagggacacgaacactgaggaaggccgcagggtcctcctctgcctaggaaaaccagagacctttgttcacatgtttatctactgaccttccctccactattgtcctatgaccctgccaaatccccctctccgagaaacacccaagaatgatcaataaatactaaaaaaaaaaaaaaaaaaaaaggaatattttcacgtgcaaatgaaaaagccctaaacaaatcttaaaatatataaagtggttcaaaaaatgtttattgttattattttaatagaggcctatacatggagcatttatttgggaaagttttaaatgaatgttttcccctgttttggttgttatcaatctacactttaccaattttcaataatgatcatgcctaattaattcaaattaaaaggtgtgtaatacaaaaaaaaaaaaaaaactgcaaccaaccctcgaatcagctcaatctctcactgaattatggttatctgtcaccactgtatctgcctatcagtgattagggagagctctctctggagaaaaatgtcacctagagcatcaacaattttcatacacagtatccagcattcacttgaacgttaccaagcatacaaggaaacagaaacgagaaaaaagagacaacatatccacatatccacagtgacccagttactagttactgaagatgatctttaaaatagctgtaattcggccgggcgcagtggctcacgcctgtaatcccagcactttgggaggccgaggctgaggtcaggagttcgagaccagcctagccaacatggtgaaatcccgtctctaaaaatacaaaaattagctgggcgtggtggggcgtgcctgtaatcccagctacttgggaggctgaggcaggagaatcacttgaacctaggaagcagaggttgcagtgagcctagggtgtggtggggcgtgcctgtaatcccagctacttgggaggctgaggcaggagaatcacttgaacctaggaagcagagattgcaccattgcactccagcctgggcgacaaattgcgactgtatcaaaaaaaaaaaaaaaaaaagaggtaactcttggaaaggagaaaatatctgcagcacatgaatctaaaaaaagactcatcaaaatctacaaagaactcctataatttaatgaaacaaaaatctccacagaaaaatttgcaaaataacccttaaatacttcacgagatagccgaatgtcataaacatacaaaaaagagttaaccaccaaaaaagagctaaaatatcagagaaatgcaaacaaaacccacaatgcataccacttcatacccactagagaggctaaaaatgataccaagtgttgttgagaatatgcactggtctgaactctaatacactgctaatggaaatattttaccactttggaaaacagtttggcacatctactaaaatggaatctatgcacagactgacacagtcattctgctactaaatatatacccagcaggacaatgtggctcacgtctataatcagcccaggctggtcttgaactcctgagctcaaagtgatcctctcaccttggcttcctaaagtgttgggattacaggcatgagccaccacatctggccacttttctttatgtatattatacatcaataaaagtaaagaataaaaagggagaagagtctgaaaagaacaattatcacaaaattaaggaacgtactcaactcttaaagatttgagaaggcgtttctaaggtactagcaatgttccattttgcaatctgcacagtgatgacaagtatttaacttattctgtaaacagtaccttttttttttttttttttgagacagagtcttgctctgtcgcccaggatagagcacagtggcgcgatctcagctcacggcagcctctgcctcctggggtgacgtgattctcatgcctcagcctctggagtagctaggattacaggcaggcgccaccacgcccagctaatttttgtatttttagtagagacaagattttgccatgttggccaggctggtcttgaactcctgacctcaagtgatctgcccgccttggccttccaaagtgctaggattacaggcatgagccactgtgcccagccacaaacagtacttatatcttacctatgtttaaatggatattcaaaataagattaaaagaggtaagaaaatacaatactctagtaaatgtaaaaataagtgagaagaataaatgccaagagaaatataattaccaagaagaaattcaaagtaggaacagtcgtataaccatttttaaaataattttgaatcagcttaacatgttttcaacaaaaaaccaaacacataccaaaaccaaaaaaccacccaggtccagacttgtacaggcaagttctaccaaactttgaaggaatcattctaattttacagaaataaaaacagaagaataggaaaagaaacacttgccaattcattttgtaagggtagtctaattttcataccaaaccacatgagaaaaaccctattatttattaacaagccaaatccagcaatatataataataatacatcatgaccaagttgggtttaatcccaggaatgcaaaattgattcaatattagaaaatctattagggtaacatgaaacttaaagaaaaaaaacaagaaaatttctatacatgcaattaaaaagcatctgtagaaattcaatcattcaggattctttttttctttaagtttaaaaaaacttgacaaagaaagctttatgaagccaggtgctgtggcatgtgcctgtaatcccagccattcaggagggtaaagtgggatgatcacttgagcccaggagtttgagaccagtctgagcaacatagcaagaccctgtttccggggagggggtgggtgggaagtaagccttatgaaaaaccagtagcccctatcactcaataaaagctttccttttaacatcagaacaagtcagggatgccctctgtatcaccactgctcttcaactttgtaatggagagtccggccagcacagttaagacaagataaaatatatctaagtcatgaaaagaaacaaaatatcatgattttcagatgatatgtttgtccttaaaaaatttaaagagggattactggaataagagtttgttggacaatctttttattccagtaattcatcagtttacaaaagtcaaatgcatttctataaaccatctacagatatctcttagaatatagccgggcatggtggtgggcgcctgtaatcccagctactagggaggctgaggcaggagaatggcgtgaacccaggaggcggagcttgcaatgagctgagatcgccactgcactccagcctgggccacagagcgagactctgtctcaaaaaaaaaaaaaaaaaaaaaagatatcacttagaatagcaacaacaaacataaagtatcaaggaatcaattaaacacatgatgtgcaataataataacacaaaactttactgggaaaacaacttaggaaaacaatgtggaatacccggtgaatgtacatatgccctaccatccagcaattccactactggggaatctgtctaaagatctgtgaaactcttgtgtatcaggagaaatgtgcaaggttacttgcaggaacactgtaataacaacaaacctaatgtccattaatactagaatggataaattgtggtatatttatacaatggtatataaagcagtgaaaacaagtaactatactatactcaaaaacataatgatgaatgaaaaaagctagttgaagaatacacacagtatgatttcacttatatgaaattcaaaaccaggaaatactaagtactgtattgtttaatagaaagataatagtccagcccgggtgcggcggctcaagcctgtaatcccagcactttgggaggctgaggcgggcggatcacctgaggtcaggagttcgagaccagcctgaccaacatggagaaaccccatctctactaaaaatacaaaactacctgggcgtagtggcacatgcctgtaattccagctacttgggaggctgaggcaggagaatcgcttgaatctgggaggtggaggttgcagtgagtcaagattgcaccattgcactccagcctgggcaacaagagcaaaacttcatctcaaaaaaacaaaaaaaaaaacaacagaaaaacaagaaaaaaacaagaataaacacatcgagccgtgatcatgccactgcactcaagcctgagtgagagagtgacaccctgtctcaaagaaaacaaaagacaaaaatacataacaggctgggctcagtggctcacacctataatcccaggattttgggaggtagaggtgggtggatcacttgaggtcaggagttagagaccaccctggccaaggtgatgaaaccctgtctctactaaaaatacaaaaattagccagatgtggtagcgcacacctgtaatcccagctacttgggaggctgaggctggagaactgcttgaacccgggaggtggaggttggattcaagtgacagcgccactgcagtccagcctgggcgacagtgagactttgtatcaaaacaacaaaacacataacagtcattaattaccacacataaaggtgcttaatggataataagtgctcaaggaaatggcagtcatggtggtggttgcagagaacaactggaggggattaagagtggtggtagaaaccaagcagaaaccagtctaagaaaaccaaaaaaataccaggcaaatagtttcaaaggaaaattataccattttaagataaggtagactggtggctggcgcctgtaatcccagcactttgggaggccgaggtgggtagatcacctgaggtcaggagtttgagaccagtctggccaacatagtgaaaccccatctctactaaaaatataaaaattagttacacgtggtggtgtgcacctgtagtcccaacttcttgggaggctgaggcaggagaatcacttgaacctgggaggaagaggttgcagtcagccgagatcatgccactgcattccagcctgggtgacagagcaagactctgtgtcaaaaaaaaaaaaaaaaagacaaagtagtcttaatgctatttcagaacacagaaaaggaaagaaaacttccacactcattttatgaagcaagtgtaatggtaaccccaacctgacaaagactgcacaaaagatactacagttgaatactacttacgaatatcaacacaaaatctctgaatattagcaaacagaatccaatggcacattataaaaaggaatacaaataaacaagcacagtttattccaggtatgagagattccatataaggaaatctattgacatgatcttcacattaacaatgttaaatgtgatgaaatcatatcatcttcacggaggcagtaaagacatctgacagctgggtgcggtggctcatgcctgtaatcccagcactttgggaggccaaggcgggtggattgcctgagctcaggagttcacgaccagcatgggcaacagggtgaaaccctgtctctactaaaatacaaaaaattacctgggggtggcaatacgcgcttgtagtcccagctacttgggaggctgaggcaggagaattgcttgaaaccaggaggtggaggttgcagtgagctgagatggcaccactgcactccagcctgagagacagagcaagactccatctcaaaaaacaaacaaacaaaaagaaacaaaaaactaaaataggaaatgatggatactgccttaagtaaacaaaatacacctcggtccaaagccagcatctgacttcatgtgaaaacattagagacttccctgctaacatcacacaccacataaggctaaaatattttccaatttacatttttagaggtaagcattaaattctatgatgccagacaaacatttaccagatttttttttttgagatagagtttcactcttgttgctcaggctggagtgtaatggcgcacaatctcggctcgccacaagctccgcctcccaggttcaagcgactctcctgcctcggcctcccgagtagctgggattacaggcatgtgccaccacacccagctaattttgtattttttgtagagacggggtttctccatgttggtcaggctggtctcgaactcctgacctcaggtgatccgcctgcctcggcctcccaaagtgctgggattacaggtgtgagccaccgcgtctggccaaaatttaccagttcttgaatgctgaatcctgctgggataactggaaacactcctaatgttactataaactctcacactgccttgttggcaataattaaatagctctttctagcagttgtgttcaagtggacagataatcacaaatgtcttttctttctagctccctttggacgaaagaaagaaagaatttacaacacgtctaaagattgtcacttttatcatccctttgaatgataagtgatcagggctgtcccaaaagaatgcctgaaaacattacaaaatgttatcataagcagaatggctcactaaggggatgaacattctggcaagtcttaatctagcatcactaccaactgttttttcactggtctaaaacataacatctaatatttttatttgcctatatagccctgcagtaataattaacttgtgaaaggtctacactgatttttttctttataaagtatttgcttcaaccatggaacagaaacaaagttgatttaatgggaaaaatgtaaatttatttgaggataggttcagcactgctaaattgaaaagggaaagaaaatttcaaacaaaccccaaaaagaaacattttcacatctgtagtgaaaaagctaaatagcagtacactaaacttggttactgacaaaataaatccttgtggccaaggtgaggcaaagatattactctctactttgctagcctaccttgtgttcagtgaattcaaacattaattggggcaatgtattgtttttgcttcattttctttagctgtgcagtaaagtctttgctttcatagaaagattgtgccaagttctttctttttcagaattgcttttaaatcagttctatttaagtatttctctctctctcaaacttgacatttttcattacaccttttttttccaatgccaaaatagcagcattaacattcattccagtcactaggtaaaaactctcttcagtcaaacacacatgaataatctaattcgtgaggtaaacgactactgtcatacagtattacgaagttccaaccttacttgcagagcaaaaaataaaaaataaaaatagtcattttcctcaagggtttaattgtgggcttttaatgttgaagtaaatcaatttactagtttttaacctcaagtttttccctatttcattatatctcaataatgattatccagagatttctgaggtaaattacattaaagacagcgctagtaactgggaaacaatccacacatgaatcttaatatattgcatatatgctaatttcatgtaatgttcctgagggcggtgacaatattagagctgtacgagaccctagagaccatcccaatcccttaactccacagatgagaaacacaaaaacttgcagaagcagagtgacgagcacatgcccatgtgacatgtcatcagaagcagggaccaagactcaggtctcttgccttccaggccagtcctcttttggtaggctaaaagctgcctttcacagcttcccacaaatttcaacacatcctcactcaagtacgtttctgaaagggactcaccgacaactctttagagaaaaggaactatatctcaaaccataggaaaagttctatatctagcttatcaaacttttagtctctgaagcatgtgagagtaagtttgccagtatttctttctcattatcccccaatactttagtgactatttccaacaaacaaaactagactattctcccatacaaacaaaatgctaccatcaaaatcgtcaacgctcacctgtcagattatgaccaaaggcctctaagtcagaatcccgcccaggcaaaatgacatggcagccaactgtggagcctcggttggcctcggatagctggtccccccttcattcacaccacatatctgaggaccagatatggaaagcctctcatgctggaaaacttggcacagtagaaaggcggccacacttttgcccgtcacacaatgcacattcacgggggacctgtgctaaaccattcacagacaacctgtttctgggtcagggtttcgtatacagcagagcagtcagctatcgacacaagggtttgtaacaaaaaacaaaaaacaacaaaaaaaaggaaggacaaaccaaaacaaaaaagaaaataccaaaaaaaagaagagttaaaaaaaaaagaagataaaaataaaatcattaacacagatacacgactacaatctaattttcagacattctagttttgccaatcatgccgattcagaatcatgaaccacatggagttgccatgtttctgcacacttctttagtgtggaacaattcctcagtgttttcttggttccatgatcttgacttaattttgaggtttacaggccagttattttgcagaatatccctaaactcgggttaccttgatgttgcctcctgaagatttggattatgcatgaaacacttgactgtccctattctaactatataaagatgctccttgacttactatggacttacatcccaataaacccttcataaatggaaaacctcataaggtgaaatgcttgttttttttgggaaagtttcttgctctgttgccaggcgggaatgcggtgacacgacgacggctcactgtagccttgaccactcaggttcaagcgatcctcagccccaggctcccaagtagctgggactataggcacgtaccaccacacctggctaattttttttttttttaatttttagtacctttagtacagaaaaggcctcactatgttgcctagattggtctcaaactcctaagctcaaggaatcctcatgcctcggtctcccaaagtcctgggattataggcatgagtcctgcacccagcctagctgaaaatacatttaatacacctaacttaccaaacatcacagcttagcttagcctaccttaaacatgttcagagcacttacattagcctacagttgggcaaaatcatctaacgcaaagcccattttataataaaagtgttgagtaactcatatgatgtatgaaatactatactgaaaatgaaaaacagaacagttgcgtgggtactcggaagtaaggtttctactgcatgtgtatcacttccataccattgtaaagtcatctgaccaccaagccaaatatttgtacttctgcacatgctgctttacatagagaccgagacaaagggggattcacatcttgtcaaccctgtttacttcaaaggaataacagagcattaactaggtaccaagtgctcaggacttcaagtatactgttttatttaatactcatgacaatcctttgaccccttacttgtgactggcaagttacccaacttttgtttcattttcctcatctgtaaaaaccggagagtgatacacactccctggagaatgacagggaaaacagtaccaagaactttaacctaacaagtcagaaatcaatgagaccccttttgacaattcccaccttgccctttagacattccgagatatgcagctttatttaataaatgaccccaccttgggcctcagctgactagaccagaggcagacactctcccaggctggaaaggccaggtggagtgagctgttctgtgcagaatgatctccctaacagtgtttttacacattctgttccacttggaattggattcagagtgttctcagcctctggtcatcaaaaaacctgaagacacataccttcagggagctagggtcagctctcctctgctgagtgcatggggaagtgacaaaagagaaaagaggggggaaaatccagctgctgagagatgtagggtacaagaagcttttgtaactgtaaagagggagggaggtagctacgttggtctattttccagttcctggttccaactatacctaaagctttaactgcactttctatccttgcagtaatatgacaaaggcccccagatcttaatcataaacttttcattttctataatgcagtctctacaaagtagtgcctaaaacattccagcactctaccctaccttttacccagctagctctaagtcttccttcaggtcccagcttaaacaccacttcctcccggaaacccttcatgactactcagaatatcttatatcatccagtggcactccacacctcaccatactcagtaaatgttattactgccctgttggactgtaaacaccaaagagtaagaacaacttttgttcactactttgttcctactgcctagcacataatccggtacgtgtttaataatattaaatgaatgaaaatcaagaaactggtagaggtaactagaaggaatgggaagaaatcaatactgcttcctgataaaaattaagttgctagatgacagatcctttggagataaagaaaaaacaaaaacaaaaaacaaagttactttaactctaatcctttctagcctcttcttcaggtctgtctgcaatggcataatcattttatactttagggctaatccattcaggaacccaggctgtaggaagtacgtttctaggtaactcggtataacagagaaaagcctatagtagttaaaagaaaaaaggtcacaggatttggggtctgcataaatctcaatttacatctcagttctgcaatatacttactggctgtgaaccctgaacgagttacctgacacccagttcccttatgtgtaaagtgcaaaatataatacctcaaagacaaggatgacggtcaggcgcggtggctcacacctgtaatcccagcactctgggaggctgaggcgaatggatcacgaggtcaggagttcaagaccagcctgggcaacagggtgaaagcccatctctactaaaaactacaaaaaaaaaaaaaaacttagccaggtacagtggcaggcacctgtaatcctagctactcaggaggctgagacaggagaactgcttgaacctgggggcagaggttgcagtgagccaagatcgcgccactgcactccagcctgggcaacagagtgagactctgtctcaaaaaaaaaaaaaaaaaaaaagacaagaatgagaatgaagcttaaaccagcaaggcaggcttgcaactaacattagtcagttgatcatggcatattatccatgcagacacctgctatccagctcctactggccataggttcaaaccccagggcctgccttgagtctgagaatctgggagggaccttggagaccatctatcctgtgggttgcccaacatcattttcaaagcaatcaaatcctttttccaaatgggatcttgccctgctaaccctaatagttactacctatgtgaactgaagatgataatgactaaaaggaaattaagaaaaagaaaaaagactaagggcagaggaagaagggaaacgggaggggaaggaggtagataagagaagagcaaagaatagaaaaaacagggattaggggagagaatgctgtatgtgaagtttccctatttggggtgaggcctgaagcccctaagagaggaggagatttgaaaaccacagacagagcccagtcctttcatgttatagcaggggaaatagaaacacataaattttgttcagctgcctatagctttctcctcctgtggttctgctcagtttccagaaagcctgggtaacgtctgaatcctcctggaatctctcttcttccttctggtacggtgtgggccatttcaaagctcaggcaggtggcctttcctagagggagcagagacagcgcagctactggatgagctcctaggcacctttcagtgtgggagcctcaagaagtgaaagaaaaaaagcaaatctaaaggggagcaaaatagcatctcaggattaggcaagagggtgggtggagtaggccggaggcaaggagctctagatgtttgttggggaatgaggtgtttttcaattaataggtatataaattgtgagcaaggtgaggaataaattacatacagttttggggaaaagtcaacttgaatttacacaaatcagattatgggaatggtgtaatggttatagctaactaccaggaatacatcattagggatgctattaatataaaaattaattttgttttgacttatccttttactctaaactctgctcagaaacactagattcttctgttactcatgtaagctgctgtccttgcatctttgagctccaaaagtgtagaggagacttcttgattaaaaaagttaagtaaacaatgagcaagcaaaattaagaatctcaatatctctgtctccaggtctagagtttttatatatgatatatgttattgctgttcctgcctttcaaacaggtggtacaaacacccagcagagatccatgaagagagtgcattaacaggaagcaatagggcaaagttcatagagatgagctttagagaaaagcgggacttaaatagagcctgatgtttcttggggcaggctggggtgctgtactatgggcatcttggcaggatgattctccagtggagggagtgtaccgtgcaatccagaccatttagcatgtctgcccttgacatgcctactgacggccaataacaccccctaatcaacgtgacaacacaacaaaaagccgcccccctatacatttccaaatgcctctgtagcagggaggtaaaatcacccccactgagtaccacgagataaagtaggcacaatgcggccaggtgcaatggctcacgcctgtaatcccagcactttgggaggccgaggcaggtggatcacctgaggtcaggagtttgagaccagcctggacaacatggcgaaatcctgtctctactaaaaatacaaaaattagccaggcatggtagcacacacctgtaatcccagccactcaggaggctgaggcagaattgcttgaacccaggaggcaaggttgcagtgagcctccaagcaaaactctgtctcaaaaaaaaagtaagtaagtaggcaaaatgggcagaaagcataagagataaagtgggagtggaactggcagacagaaacagggccatcctttaatgactccgtcacccacaagatcaagtccaaagtccttaccaaataatgcccttcaggatttggccctgcctacccccagctgtctcaactcccaccttcttactaaggcaccctacactccagccttcccaagtaatttgtggttttcctgacctgatgcactgtgttcacggtctgtgcctttacatgcacacttcgctttgcctagaaggcatttctcaaggcaaactcctactcacacatcaacacctagctcagaagtctgggaagccaaagaaagacagccccaagtcactcagctcttctcttcctctcagcacttcacaaactcctgggtaacactggtatcttctctgtattattccccaattccatcccattatttggatgaagagttcaataaacattttctgagtaaataactctacatgaaaggttttaaaggctaaaaagtgatacaagcaaaagcagacaacagatatttcttgttactgaaataatctattttctcaactctgatctttggtggagcactacttaggaaccagaaaaactggggttgcttcatcacttcctagctgtgtgtcattgggcaagttaactaacctctgtgtgcctcaagtttcttcacttgtggggtaaaaaacaaacagaagttaccacttttgctgtacagttatatggcttagcattaatgtatgtaaaatacaaaacaagagtgctgaaaaagtggtagttctactagtctgctataatcacaataaccttaacaagacaggaggacattgtaccatcaggaatgtgatcacaatgaaattttagttgaaaccatccccctcttttttcttttattcattcagctttcccaagttgaacatccccgctttaaaaaaaaaaaaaaaagaggccaggcacagtggttcacactgtaatcctagcactttgggaggctgaagcagggggatcacctgaggtcaggagtttgagaccagcctggccaacatggcaataccccgtctctactaaaaataaaaaaattagccgggtgtggtggcacacacctgtaatcctagctactcgggaggctgaggcaagagaatcacttgaacccaggaggcggaggttgcagtgagccgagattgtgcaactgcactccagcctgggcgacagaacaagactctgtctcaaaaaaaaaaagagctgaaagtcaacaaatataatggcttgtcagctgcattctgtttccctcctatagtactcaataccaatcccttaatgagtaccatctcccttggctcctttgataacgtgcactcccagttctttggtctctctggccacatttcctctgtcctcttccataacttgacctttattgacacagtaaaggcaggcactcctttggcttagttctcagatgtcttatccactcttaaggcttcaattaatatctctatgaagatgaccccatgagctctcttgtcgcattcagaaacagcatttcaaactcaattaaaccaaaatagacacttgctatcttagtctaagatgaccaagcatactaagagtgtttcaatctctcctcctctccctcctccccgtctacactgttcccttatacatctgaccagtcatcagtttcctcttctttgccagagttacctggttggtcctctgttctacttcagtggttcttaatgtttccaggataatggactcatttgaaaatctatcaaatgctatgtattttttaaccaaaaagataaatatagaaaacatataattacaatttcttttttttttttttttgagacccagtcttgctctgtcacccaggctggagtacagtggcgcgatcttggctcactgcaagctctgcctcccgggttcacaccattctcctgcctcagcctccccagcagctgagactacaggcgcacaccgccacggccggctactttttttttttgtatttttagtagagatagggtttcaccatgttagccaggatggtctcgatctcctaacctcgtgatccgcccacctgggcctcccaaagtgctgggattataggcgtgagccaccgcgcctggccatgattgcaatttcacctaaccaatgacccagataagaatctgtgctcatccactcaagattttaactaccatttacacaaattttcatctccagctcctgctcccctcttacaaattttaagatggtttctggatatagcctgaatggcctacaggcattacaaacttaagttcaaaccagaactatttccccctgacaaatctgctctaacagtattcctttacttggataatggcaccaccatctcccaggctcccaacctagaggcctcagaatgaacaaccgcccatagccaatcaaccagcaagccttgttctatctcagaaatccctccaaatccaaatcccacctctcttggtctcttaccctttaaggtctcataatcctttgattccactcagacttgccatgattaaaagtctttttaccactcttcccacaagggtccctgttactatttctgtcaatacaaaactcctcacctccatctgctaccttccgctgccactttattactgcacctctaggtggttaggctttcctaatttattcctccactccggttcttcttccttcattcccactagtgttgatttgtcttcccaaaaaatttcaaaattgaccatgtatgactgcctctttcaaaaaaaggccgggcacggtgactaaagcctgtaatcacagcactttgggaggctgaagtcagggggaccacctgaggtcaggagtttgagaccatcttggccaacatggcaaaacgctgtctctacaaaaatacaaaaaaaaaattagctgagcatggtggcacgcgcctgtagtcccagctactcaggaggctgaggcaggagaatcgcttgaacctaggaggcagaggttgcagtgagccgaggtcatgccactgcactacagcctaggcaacaagagtgagactccacctcaaaaaaaaaaataaacaaataaataaataaataagatgcttcctccactgaacaaatatacagtcaaacttagttttgcctttggagtcctctacagtttgccacctaagtacatttccaagattagattccacagctcaagctgtcacttgttcctattatctgcatatcaaaatcacacccactcttaaaggcccaactcaaatcccactcttcatctttacatcctctacataatcattaggaaaggactctaaacaaaatagtcacaattcctaatgaactgataaggaaacagaagggggtaaatctaaaaaatggctagaaatccataaatccttttggaagcattttttaaaagatcaccattcaaatattagtgaatatttcaacgagccctccataaatccagcactgttagccaatatttattaaatgctaataatgtgcaatggagaaggttaacagcagggtatttcatcaacctgataaaaggctataatctggatcttggattcaaattccaattacatttgtatttcacttaggaaacgacaatcacaaaaaggggacttagcatttcaaatggagagtcagaaggtcaaacaagcctacagcagtgacagaagtagttcccacatctaaacaacttcagactagtaaaaaccttatcagacaggagaaatcttatcagatgggggtatcttttcaattgacatgtcctaaacgtaaaatacttttttcagtccacattttagataagctaatcttgttaaaagggccaaaggatgtgatgggaaattctgagcctctcataatgagacatgttcactggcacacttcccagtgagtgcaacagcaatgcgatgtgtggtggagaaatgatgctactggcaatactttctctccattactttttagggccttatttctttcaggctcgacctaatttaaattctgtcttggctcctaagcctgtgagttcacattaattttcacagttgtattcagcattttgctcctaaacaaagtgaaaacattaaagattcaattaaaatctctttaaaaagaattttaactaatctttctatctagctacaatacttggtaaaacataccttctatggcatttctaaaattatgattgaaatttgaatacatttccgaaacagacttatatttactttataacagtaagatacagaaaattctgcaagtattaattacactaaggaacgcagagtgttttcctaaaaacagctgaaaagagctacagtgtgtctagtagaatctcagtctacaatcttaataactctagttctatgacctcaagaattggcttcacctcgaaatactttctcacctgaaaaaaggaataacaccatcttttcctccctcaatgtggctgctcaaataaaatgaaataatatatgtagcacagtacctgccacgaagggttcaataaattattagtttactttcttcagtcaacacaaaagacacattcacaagattcagatttaaggaaatctatttccacaagtcctcaccagcacaaaatgctatcgctagtttgctctaataaaaactaccatcagccgggcgcggtggctcacgcctgtaatcccagcactttgggaggccgaggcgggcggatcacgagatcaatacatcgataccatcctggccaacatggtgaaaccctgtctctactaaaaaatacaaaaatgggccgggtgtggtgtcgcgcgcctgtagtcccagctactcgggaagctgaggaagaagaatcgcttgaacccaggaggcggaggttgaagtgaaccgaggtcacgccactgcacttcagcctggagacagagcgagaccccgtctcggggggaaaaaaaaaaccgtcactatcatttcacttttctaagggacctgaatcaagatgagggagtctacgtgtgattctgcaagaactccattaaggctgcatacataatgaccactaaatcattaacaggagtccatagcaattgggctaaaacatctgggagcatttatgctggtaaaagagctcacttgggggctaaaaaaaaagtcaaattaggcccaactctaaacggatctttaacaaatcaagagagtaatgttagtttatccttcctgaaacgccagcagtacgatattaaaatccacttagaagtaaaaacttcaagacggaaatatgccaccaacactggcgtcagtaatccattttagaaagcctgcgcggagaccaccattagcaccgctgaggatatttaatgaaagccgttggctgcaaacagaggcgaagagagaaaaacgattatttcggtgttctgcacacacgcggaggcaaaacgctttcaggacctcagcagccaccgccgccaacaccgacaagcatctgatggaattcacagttttacaatcgaaagtccaaaagaaggccatgatactagcaaattgaggggtggggacccttccgttgccttcccgagggtccagactttaaaggccgcgctgcgcccggggccaagggtccactagtaccggcctacgccccccgcgccactccctgagccccttcccgagcgaccgaaggcccgggaaccgcgagcaacaacacctaaacctcaaccggcccggggccgcgcccgagccctggcgcgcggaccgcggtgaagtccgggttcgaggtcgccgcggcgcctgaggccgaggcgcgggcgaggccgaggctgcgtccgctgcggccccgggcggtgggggggccgggcgtggccggtcgcggacactcaccacaccatgccgtaggcgccctcgccgatgtacgagaggttggtgtagcgcggccccacgtcgaacacctgcccgcggaccatctccgggcccgcgcccgccgccgccgccgccgccatgttggctgccgggccgccgccgcctccgccgcgctgagctcgacgctcggcggccgccgctcagctcttgtcgcccctcccgcagggactgcgccgccgccggtgcagccgccgacgctgaccgggaggaggaaggaagacgccgagcgggagagctgaagagccgacagccactcggaccgattgcctgcctgcctgccagactgacgggcgggccggcgggcgggcggagggaggggc

SEQ ID NO: 1860 - DNA, 9205 bp, Homo sapiens
tcagccatagacacatctctatatttatatattagacgggtcagggaggtggcaggggcgccgggctctccacgccccccagctccacttctgctcaccacacacagaagcagcgagggcacgcgaagtgacagctttgacagggaggggattcggcccggcctggctcctcagggatgctagcccttgagactaaggaatgttccttcagggaaactagggtggggtttgaatgagatgaggggggcaggcatggccctgagtccctactcagcgccccccaccctccacctctgcccttcagcaggttggggcagccagaacccttccattccagaactgccagagactgggacgctggggaaggtaagggcgcagcagcagcagcgggagattgaactggggccacctgaggtcccgaggccccgtggggagggcgggtggggaggagaaggccttggcctgcctgaagctggaggcctcagcaaaggagagaggtggccaggcccatgctccaccccggcctgggctgccaaggtccgggctgggcacagtgtccattttctaacagtctggcgggagaggggcaggcaggaggcaggtcctaaagagagaagcaggcagaagaggagtcgttagcaccccccgggcagacccactggagccctgacctcaacatctctcatttcaccctcacagctggataggctgggtctcagtttccttatctgtaaatggagataataatagtacctagcttgaggtactgctgtaagattaaaggaattaatacatgtaaacctcttagaacaatgcttagggctttatgctttcattattagaactgtctcggccgggcacagtggctcacgcctataatcccagcactttgagaagctgaggtggtggatcgcttgagcccaggagtttgagactggcctgggcaacatagcaagaccccagctccacaaaaaaaaaaaaaaaaaattagccggttgcaatggctcgtccagctagctgggaggatcccttgcacccaggagttttgaggctgcagtgagctatgattgcaccactgcattccagcctgggtgacagagcgagacactgtctcaaaaaaacaaaaccaaaaaaaaagataaatagattgactccggaaactgaggcgccgagaggtgaggtgccttgcccaatatcacacagcacttactaagtggcacagctggagtttgagcccaggtgcgcatgccttctttctatcaggccacacctggctgaagacaggaagagaccggaggaggcaaggaggcagcgtgggtgggggcaggccagtggggtccccacagctatgtgaactgctgatctggcagcaggtgtgaggaggcctggcaatctgggtcaggctgggcgctgctgggcccctcccaaagcaatcatggccccacctgcttctgccacacccagagctgaagcttggctcaggtcctcacctgggtgacagaggccctcagtgacctcttgcctctttgccagttctgttcctagaaggagattagaatggcttgtggggctggaggatgcaaggtgttgacaggcagagacatttggggctggaggactcggtgggccaccagtctgggcagccttgggcatttttttttttttttttgagatggagtcttgctctgtagtccaggctggagtgcagtggtgcgatctcggctcactgcaacctctgcctcctgggttcaagcaattctcctgcctcagcctcctgagtagctgggattataggcatgtgccaccacacccagctcatttttgtattctttacagtagagaccgggtttcaccatgttggccaggctggtctcaactcttgaccttgtgatccacccacctcggcctcccaaagtgctgggattacaggcatgagccactgtgcccagcccttttttttttttttttgagagagtctcactgttgcccaggctggagtacagtggtgcaacctccgcctcccaggttcaagcagtcctcccaccacagcctcctgagtagctgggactagaagcgcatgcctacgtgcccggctaatttttgtatttttagtagagacagggtttcaccacgttggccaggcaggctggtctcggactcctgacctcaggtgatccacttgcctcagcctcccaaagtgctgggattaccagagtgacccactgtgcccggctaatttttgtatttttagtatagatgggatttcaccatgcaggccaggctggtctcaaactcctgaccctcaggtgatccactcctctcagtctcagtctcccaaagtgctgggattccaggcatgagccaccacacccagccccctgggcacttctgttgtcaccagacacattgaccatgggtgtggggtaagcttgctgctgtatggaggcatgtacagatagatatagatatagatatacagatatagatatttagtatcagggtgtccatgtgtgggccatggagacactcaccaggccccagggtgcagagatgtctgtctgggctagggggcctccagcactccgggctggaagcgtgctgtctcctggaagatgagctccttcagccgctccttaggtaggtcatccagctccatggcgaaggtgaagggctcctcggccactggctggggtggtagagacagcaaggctcaggcctggcatgggggatgcctacgtgcccccctgctcccctgcccccagccccactgctgctggggactggcccacctcatccgtcgggtcatagtactgctccaggtaggggtgagccagcgcttcctccactgtgatccgtttattggggttaaaggttaacatccggtccagcaggtcaagggctatggaagggcaggagtcaggggtcacagggaagactggaggagctccgagaagcattgctttgcctgtctcctccagcggctgctgggctcacacaccctccacgacacccaaggtttatcccacacccaccctcatgtctctcgaacctttggagtctgacttggggaaaagcttggcccaagccaccttggtcttggagggcagagactgtaggtagtttcgggccttcatgttgatgatacaattcaggtcctcctgggatggggagcccaggatgcctgtggataaggaggtgacttggtaaatgatcacctctttctttctgggaacagaataggcaacaaggcaagaacaagaccccccagcccagcaacccatgccaatccctcagtcacctcctagtcattagcatggtggtgcagagcaagggggctgggttcaggcagaccgaggctcaaatcctaggtctggtgcctcctcaggtgtgggacttagccttgcttttcccatctatccaatggggataatatctatacctcattgagataccatgagatgctggaggcaccccacacgtggtggtatccctgacttggactctcgagaaatctcacctcggaaaagctaatcatccccaactcagccagccgggcctccctcacccagaatgtggttgagctgatccaggtagtgcttgccagggaagatgggccggttagagagcatctcagccagaatgcagcccacagaccagatgtcgatggacttggtatagccctgggggagaggaggaagtggtgagctcctgggccagcctcaacagggtcctgttgtctgcgccaggccaccacctccaagttagatccaacaccaggcagaaggcagaggcctggagggctcaatgctcagcttccttgcagagcccaaggcccagagggtagaattcctgtgtcatgggggtcagtgtctggctcagaggtagctccagggcttcctgggaactggtccgttcctttcaggagtgggcagcccctcctaccttggagttcagcatgatctctggggcccggtaccagcgcgtagccacatactccgtcaggaagccggtgtggtcatgctcaggatcggcaatccgggccaggccgaaatcacaaatctggaatcagacctagctgctaagctcggcgctcaaggcctctgcagcctaagcagtcacgcccccttgtctttgcctccactgttccctttgcttgcaatgttctcctgcccaaggcttcttctactggtcactggaagccccagaccctgggggaggaggggacaggtgcccaaccctctgaccttaaggtcgcaggtggtgttgatgagcaggttggagggctttagatctcggtggagcacgttggcggagtggatgtacttgaggccccgcaggatctggtagaggaagtagcagatatggtcattgctcagctgctggcttttcagcaacttgtacaggtcagtctccatcaggtcctgcacaatgtagctgaggatggttccgcagacccccccaggcagggggcagtgggaggcacttggttaaggaaaacaggctctgaaggcgaggctgcacacctcctccagccagggcccctgggactcaatagatctgccaacctgcaccaccagctggggaagctgctgccattacccagcggcagggctctgagcctctgttgcatcacagttgctgatcctgagcaaggggcttcatttctgaggcctcagtttccctaccggggaaacggggataataataaactgtgggaggcaggagaacttcacagttaagagcagcaacttgggccaggagtggtggctcacacctgtaatcccagcactttgggaggctgaggcgggaggactgcttgaggccaggagtttgagaccaccagcctgggcaacatggcaaaaccctgtctctactaaaaatagcaaaattaactgggcacggcggcatgtgcctgtaatcccagctactcaggaggctgcagcacgagaatcacttgaacccaggaggcagatgttgcagtgagccaagattgtgtcactgcactgcagcccggatgacagagtgagactctgtctcaaaaataaataaattaaaaaaaaaaaaaaacctacaaaaagagcagcaactctggagttaacccatggatgtctgaaatctcctctctactactcactggctttaggatctcaacctgtctgtgcctcaactttctcatctggtatgtaggggaaataatgtttttttgtttgtttgtttgttttctttttgtggagatgggctcttgctctgttgcccaggcaggtcttgaactcatgggttcaagtgttccttccacctcggcctcccaaagtgctggaaattacaggtgcaagccatgaaataatggttcttttgagggtggttgtgaagactagatgagatggcgcatgtaaagctgtcagcccagtgcttggcaagttgtgagtgctaggcaaacatgaactattattactaatatgaatgcctgagtcacatggctgttgagggagttaaatgagataatgtatgaacaccatctggcatgcaataaatgtttgcttaaaaataaatgcctgccttatgggaatggtttgtgcaagaaaaatgaggagacactcccaacagcacactcccactcaaaggagagtgcttggccatacctcagaagatggaggagtaaaatgtctttttctatttgaagatacaaaaaagcttatgcgtaaataaataaataaatccacaaatgctgtttggcttgtctctagaaaaataagtcagggctgtcttttagaatctgccttgagaccaggcatggtggctcatgcctgtaatcccagctcttcaggaggccaaggtgggttgatgacctgaggtcaggagtttgacgccagcctggtgaacagggcgaaaccccgcatctactgaaaatacaaaaattagccgggcgtggtggcaggcgcctgtagtcccagctacttggaaggctgaggcaggagaatagcttgaacctgggaggtggaggttgccgtgagctgagattgagccactgcactctagcctgggcaacagagggagactccatctaaaaacaaacaaacaaaaaacaaagaaaacaagaatcagccttgaaagggtcttcagagaatatgtggaccagccctgctgttttagggctggggaggcccagcgagacgcagtgacttgcttcagatcacacagcgagctgggggtgagcacggagatttcctgtccacagtttgtggtgggggttgcagacacctcagtacaaatccccactcttgggtggagggctgggactgagagtgggtgggtggggcagggaagaagtgacaggtgtcataagttgctaaggagagccagacaggaagtggacagcaaactaggaaagcagtattgggggaggacagccaaggctaggctgtccctccctgggcaaggtgcaagtccacaggtgattagggtgtggctctgagtgagaagtcctaagaagaaggacaagttcccatctgggggaggagaggaggagacagcaacagaaacacttgattttaggttttctgagccttagcttcctcatctttttttttttttttttttttgacagggtcacgctctgtcccccaggctagagtgcagtagcacaatcatagctcactgcagcctcgaactcctaagctcaagccatcctcctgcctcagcctcccaagtagctgggactatagtcgtgtaccaccaaacctggataatttttaaattttttgtagaggtggggtctcactatgctgcccaggctggtcttgaactcctggcctccagtgatcctctggtcttagcctcccaaagtgttgggactacagatgtgagccattgcactccacccctcatctttgaaatgaagctgaaaagcccatctcatagggtagttgggaggtgtaatagaaaaaaaaaagcattgggcatgtatagtacctgacacacagcaggccctcaagaaaggcagttttttgtttttgtttagttttgagacagagtctcgctctgtcacccaggctggagtgcagtggcacgatcttggctcactgcaacctccagctcctgggttcaagcgattctcctacctctgcctcccaagtagctgggattacaggcttgcaccaccatgccccgctaatttttttgtatttttagtagagatggggtttaaccatgttggccaggctggtctccaactactgacctcaggtaatctcccacctcagcctcccaaagtgctgggattacaggcgtgagccaccacgcccagctgacagttttctttctccctgtctcccttccggtctgggcaaggaggaaagagaggaaagaatcatccattccttagcaagaagtgactgtgggcagaggccaggtcatgtctcagaactgccgacgtcagaagacaccactcccatagagaccatcctgcctagcccttccccctggggcacagagcagagaacccacttgctcgaggccatactgcctgggccgctgcaggcctgggttcatcagaggtctccaagtcctgttacactgtggcttcccctctgcaggaaagtttattttactgggtttgttttggagggtggtgggtaagatggaaacagaaaccaagcaacgggtccccagcccagctgcgaggccgtgcctgaccagccgactggccaaggtgaaggatacacatctctcatggcttccagggtggacgcccgcagaatgtctcggatgccgatgacattctcatggcggaagcgcagcaggatctggatctcccggagcgtgcgctggcagtaggtctgatgttcgaaggggctgatcttcttgatggccacgcgagtcttgcgcacgtggtcataggccgagctgaggggaccggagagaggctgctgctgtggccttacaaagggggagtccgggcctggtggccccacccaggccttggcagggaggggagagagcaggagctggctctggtcaaatcataaacaatgctggttccttcctgctgtggaggcctgggatctccagagagaaagctggggaccagccaggcggcccttcggtgactttacaaacagaggaagagactgaccgctcactgacttcccctctcctcaatccccttccattctactggccctgaacccttcgcccccattcccaggaaaggctccttaacccaagacaggtccgggggtgcagatgctggggacacaccatggggcaaatactgggaaggtggcagccaggggaggggcaggagagaatggacagggcaggggagggtcccagggtgagggatccgggcagcggggctgtcccagagggatagaggcccagagcacacggtggggccgggggcactcacagacccctcccaaaacatgcaggtggcactcctggccgcctcatctctctctgggcccctggggtggtggggccaaagccctgccccaccctgatctcggctcttctcccccaggctccctggcactgcctcacagggggaatccaagacaccctttcccccaaaacgggccctccactgcctcttcactaaggatgtcgcctccccgagagtactcatcctctgggcctcgccccgtgtcactagggtccccgcgggcccccacatgcactcggatgcccctcccatcattacagaagggtggactcaaagcctccaagcctgctcccctgaggacgtaggcagcgccccctcccccagaaagcactcaggggccccctccctgggacgctcccgatcatcccgagtctcctgcctcctcgggacgctccgcgtctccacgtcccggaaagcgctcggcgcctcctcctcctctcccgcgaagccccctcccctgagggcaccccctcccccggaacgccccctcacctgaccatgccgtacgcgccctcgccgatgtactgcaactgcgtgtagcgcgggcccacgtcgaacggctgccccttcaccatctccacctcccccgggacccccgggccgaccccctcggttctacggggctccccgcccccgcccccctgagccgccgccgccgccatctccactcctcccctcccaccgccctcctccccacggcggccccgcccgaggccccgccccttcccgcctgcctgtcacccgcagggccgcgcgcgccag

SEQ ID NO: 1861 - DNA, 9205 bp, Homo sapiens; identical to SEQ ID NO: 1860

SEQ ID NO: 1862 - DNA, 9205 bp, Homo sapiens; identical to SEQ ID NO: 1860

SEQ ID NO: 1863 - DNA, 29325 bp, Homo sapiens
acatggccaatggccgcgcgctctgcccgccccgcctcctcgctgcgggaagggtcctgggccccgggcggcggtcgccaggtctcagggccgggggtacccgaggtaagatcgcttcccgggcgttgggtcctttcggctcagcacgcacggacgcctttagggaaggtggctgcagcggcaggacggagtccgccgggacgccctgggtctggggtgcgcggggggcccaggaggggacaggacgcgcggggatccggaagagcgggccctgtcgcaagagtttcgggaacactgagggctccaggcgccgcatccagcatccggggaaaagggggtaggtggcgctgggcgtctgctcaggctgggggaaaggtagggccagaaggggacgggcagcggccgctgacctcctcctgccgcccgcgggcccagggtgacgctaaggtggggccgagcctcgaccgggtgcgcctagaggtcgagtgctgccgccctccgctgggtctggacagttctcggcggcgacaccagctcaaaacggcctccccgccctccgcggacctgggtcgcgcccaggaatccgatccaaggctgtgaggcctgtccctttgggaagggtgggtgtttatttccgggatgcactcagagcctctggacagtcaggtcggaaactttgctgtattgggaacactctgtcacctacttccttctcagttgggaaggaagtgccaagaaaacatgaaacaaaccaaaaacacgaaaaagggattctctgtatggaagccgtgaagcctcaaaaatatctaggaggacagccagcgacctgggacctgtggcagccatgtgaaagcagggttaatgtctggactaaatgttgcttccacctaagtgcaccctcagcctccctcccgccaagtgaccttgggtcctctttgggcttgaaggcaggtggctgtgtgggtctcgctgcaggggtctctgtgccctgcaaggtgtatgaccagttgcagtgaggcagcaggttttgggttcaaatcctgtgctagcctctggccagctgtgcaccttggcaacactttccctgtcacgggattggggaaggattaactgaaagaaccttaggatgtgcctgtctacaatgggccctccataaatgtgaacaaatgtgggcttcctttccttttgtttgggccacatcatcccttcccctccatctgtggctgaagctggaatgcagaagagtgcctcatctgactgccttctggtacctggctgatgccatgagaaaggaaggagaaaggggtctttttttttttgaaatggagtctcactctcttgcccaggctggagcgcagtggtccaatcttggctcactgcaacctctgcctcctgggtctagagattctcctgcctcagcctcctgagtagctgggactacaggtgtgtgccaccatgcctggctaatttttgcatttttagtagagacggggtttcaccatgttggccaggctggtctcaaactcctgacctcaagtgatctgcctgcctcggcctcccaaagtgctgggattccaggcgtgagccaccgcgcccggccgagaaagggatctattaactcccatagagttgttctttgctaatttcttgaaggctcagaggacccccgcctcaccttcctgattctcctgacctgtcattagtacttgccccacgaggaatgtagcagggcctgctggctggcaaagcaactcatgcatgtgaggctctgaggccagtgacaggactgcttcccctgtgaggaaggtctggtggcccaacagcttttaggtgctgtctgctctacagcactgcctcctgagagaggtctcatgcctgcctgatgcccacttggtcctctcctgcctccttccctccctgacaacccacttggaatccaatagcatctcaaacttcacttgttccgaactgagttctggagtcccttctgagccactgctcctcccctggcttctctggcctggtaaaagggcaccttccatccacccagtgcccaaggagtcatgcttcttttctctcccttatctcctacaccctcaaaacaccaggaatctggctgcctcctgccatctctgtggttcccatcctgaccatagtcatcctgtctcctgggctgtggcctccttactggtctcccagttttcatcctggcccctccaaagtcctcacaaccaccagagaagtctttaatgtaaatcagatcctcttctttccctgccggaaccttccagtggttccctgtttcactccaactaaaacccagagtcctttcctacagcactctacatgagtggcccctgccacctccttgaccttgacaatctctgcccctttccctagcttgcttgcttttttttttttttttcctatgatggagttttgatcttgtcacccaggctggagtgcaatgggatgatttcagctcactgcaacctctgcctcctgggttcaagcgattctcctgcctcagcctcccgagtagctgggattacaggcgcccaccaccatgctaatttttgtatttttagtagagaaagggtttcaccatgttggcgaggctggtctcaacctcctgagctcaggtgatccacccgcctaggcctcccaaagtgctgggattataggcgtgagtcacgcagccagccatccctagctttcttgacctagaccacactgacctgctttctattcttcaaacatgccaagctcattcttgttttaggacttttgcatttaccatgctctctgcctaaaacaccaatcttctcagagcctgagaacagctcagctgtgttctgcacgctagttcagaaaggcttctttgaccccctagttcaagtagcatgcctgtctccaggggctctgtctcattacctgctttactttctttagagcctttattgctatctggaactcttatttgggtattaatttactgatctgttatttgtcccaccccattagaatataaattggatgtggcatagaccttgtctcttttattccctgcagcactccctgatgggggcggcagaaaagtaacgagcaaatacatctataactgcaaattgtggtaactcctacataaacaactggcagcaattgcttatatttgaggcacttaaaaatttttaagctggctgggcgcggtggctcatgcctgtaatcccagcactttgggaggccgaggcgggcagatcacgaggtcaggagatcgagaccatcctggctaacacggtgaaacctgtctctactaaaaatacaaaaaattagccgagcgtggtagcaggcgcctgtagtcccagctacttgggaggctgaggcaggagaatggtgtgaacccgggaggcggagcttgcagtgagccgagattgcaccactgcactccagcctgggtgaaggagcgagactgtctcaaaaaaaaaaaaaaaaaaaaaaaaagaaatttttttaagctgctgggcgcggtggctcacgcctgtaaatctcagcactttgggaggccgaggtgagcggatcacctgaggtcgggagttcgagaccggaacatggtgaaaccctgtctctactaaaaatacaaaattagcggggcgtggtggctcatgcctgtaatcccagctacttgggaggctgaggcaggagaatcgcttgaacccaggaggcagaggttgcagtgagccgagatcgcgccattgtactccagcctgggcaaaaagagtgaactccatttcaaaaaaaaaaaaaaaggccaggcgcagtggctcacgcctgtaatcccagcactttgggaggccgaggcaggcggatcacgagttcaggagattgagaccatcctggctaacacggtgaaaccctatctctactaaaaatacaaaaaattagccgggtgtggtggcgggcgcctgtggtcccagctactcgggaggctgaggcaggagaatggtgtgaacccaggaggtggagcttgcagtgagccgagattgcaccacagcactccagctttggtgacagagcgaaactccgtctcaaaaaaaaaaaaaaaaaaaatttaagcttagaggccggccacagtggctcagcactgtgcaggccaaggcaagaggatcacttgaggtcaagagttcgagaccagcctggccaacatggtgaaaccctgtctctactaaaaaatacaaaaattggccaggcgcgttggctggcgcctgtaatcctagcaacttgggagaccaaggcaggcagatcacctggggtcaggagttcaggaccggcctggccaacattaaaacatataaaaccccgtctctactaaaaatataaaaattatccaggcatggtggcgtgtacccgtaatcccagctactcgggaggctgaggtaggagaattgcttaaacccgagaagcagaggttgcagtgaaccgagattacgccactgcactccagcctgggcaacagagcgagactctttctcaaaaacaacaacaacaacaaacaaacaaattagccaggcatgatggtgggcacgtgtaatcccagctactcgggaggctgaggcaggagaattgcttgaatgtgggagatggaggctgcagtgagccgagatcacaccactgcactccagcctgggcgacagggagactctgtctcaaaaaaaaaaaaaaaaaaaaaagtttataaggctgaattaccgtactgtcaaaacaagctgctatctgagccgttttaagggtgaggaagtctggaaactgataacttgcccaggacacacagtgagttcaaggcatggaactcagtctcctatcttaagaatgtatgtgggccgggcatggtggctcacgcctgtaatcccagcgctttgggaggccaaggcaggcagatcatctgaggtcaggagttcaagaccagcctgaccaacatggagaaaccctgtctctactaaaaatacaaaattaaccaggtgtggtggtgcatgtctgtaattccagctactcaggaggctgaggcagaagaatcacttgaacccggaaggcagaggttgcgatgagccgagattgtgccattgtactccagcctgggcaacaagagtctggaactctgtctcaaaaaagaaaaaaagaatgtatgtgtagcaggctttttttttttttttttcccccgagacggaatctggctctgtcgcccaggctggagtgcagtggcgcaatcttggctcactgcaagctccgcctcccaggttcacgccattctcctgcctcagcctcccgagtagctgggactacaggcacccgccagtacgccgggctaattttttgtatttttagtagagacggggtttcaccgtgttagccaggatggtcttgatctcctgacctcgtgatccacccgcctcggcctcccaaagtgctgggattacaggcgtgagccaccgtgcccggcctatgtgtagcaggctttaatggtgggcctgcagccatgtcatggaaagaagctgacctgaagatctcagttctttcttcttctactaactagcaagcatacctcagtttcttctttaaagcgggatgatccgattattatcatgttggggttcactttttattttttcagtgtgtcccaaagcagcagcacgtttaggtatagccctcttgctatcagcttgagggccttagagccaggaagggagccaggacatttataggcacagaaactagggtcacatacagatccccccaccgcatgtgctaggggtacatgcagaccttcccagtgctgaccaacctgcagagaagaaatgggccctaggtattctggatctgattctttttggtcttcaattatttttatttttatttttttagagacagggtctcgctgtgttgcccaggctggcctcgaacagctgggctcaagcgatcctcctgccctagcttcttgagtagctggtggtcatcaattcatttttagcaaattctgcagaatttttttttttttttttttttttgagacggagtctcactctgccgcccaggctggagtgcagtggcgtgatctcggctcactacaacctccgcctcttgggttcaagcaattctctgtctcagcttcctgaatagctgggactgcaggcgcccgccaccatgcttggctaatttttttgtattttcagtagagacggggtttcaccatcttggccaagttggtattgaactcctgacctcgtgatccatccgcctcggcctcccaacgtgctggggttacaggcgtgagccaccgcgcccgggttctgcaggaattttggagagactcaggcagtaataaaataggatgtttacagaaattaaagatggcggccgggcgcggtggctcacgcctgtaatcccagcactttgggaggccgaggcgggcgcatcacgaggtcagtaaatcgagaccatcctggctaaccccgtgaaaccccgtctctactaaaatacaaaaaaattagccgggcgtggtggcgggcgcctgtcgtcccagctactcaggaggctgaggcaggagaatggcgtgaacccgagaggcggagcttgcagtgagccgagatcgcgccaccgcactccagcctgggcgacagagaaagactccgtctcaaaaaaaaaaaaaagaaattaaaggtggctggacacattggctggtgcttgtcatccgagctacttgacaggcggaggcagggggatcgcttgaggccaggcgtttgagaccagcctgggcagcatcatgagaccctgtctctagaaaaaataaaaaaattagctgggcatagtggcgcaggtttgtagttccagctaccggggatgctgaggcgggaggattgcttgagcccacgagttcgaggctgcagtgaactattattgcaccactgcacccaacttgggtgacagagaccccatctgtttgtttgtttgtttttgagacagagtttcgctcttgttgcccaggctggagtgcaatggtgcaatcttggctcaccgcaacctctgcccccaggttcaagcaattctcctgcctcaacctcccgagtagctgggattacaggcatgcgccaccatgcccagctattttttttttttttttgtatttttagtagagacgggattttctccatgttggtcagtctggtctccaactcccgacctcagttaatcccccaaattggcctcccaaagtgctgggattataggcgtgaaccactgtgcccagcccgagaccccatctcttaaaaacaaaataaaacaaaacaaaaacggccaggtgtggtggctcacacctgtaatccccaaacttgggaggccgaggcgggtggaccacttgaggtcaggagtctgtgaccagcttgccaacatggtgaaaccccatctctactaaaaatacaaaaattagctgggcatggtggtgcgcacctgtaatcccagctactcagaagggaggctgaggcaagagactcaattgaacccaggaggcggaggttgcagtgagccgagattgccccactgcactccagcctgggtgacaaagtgagactcgctctcaaaaaaaaaaaaaagaagaaattaaagatgaaagaaaacaaacattccaaaaagttgagaaagaattgccttttgtccagccccactcccaaccccccaaccctgttgtaatgtgtgatctgttttcttccagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggtgagcaagggaagtgacagcccgacactggcctgggggcagggctgtggaattcaaagctcagccccatcctagttcctcacccaagcctgggctggctccttccttcttcctcttgctgtgtcttgctccttgtccttgctgcttttcttttttttttttttttttgagattgagtctcgttctgtcgccaggctggagtgcagtggcacgatcttggctcattgcaacctccgcctcctgggttcaagtgattctcctgcctcagcctcctgagtagctgggattacaggtgcgtgccaccacgcccagctaatttttttgtttttaatagagacggggtttcaccatgttggccaggatggtcttgatctcttgaccttgtgatccgcctgcctcggcctcccaaagtgctgggattacaggcgtgagccaccgcacccttgctgcttttctaacttttggatggagtgtggctcagggtggcgttgctgacttcgccgagctcccccttgtgttgcttttgtgcactgctcaaaaatatggcgctggctctctgagatttcctggctctggtccacttgcccactttttttggaacctcctatttccttcatctctcttgcccttccttgtcctgctcagttttgattccattctccttgtcatggggccctgtcctggcacggagctgggactcaggtttgagagctggcaggatcagggtcgctctagccccaacagaacttgctgcaggcccctggcactcactagctggtgaaacgggcacaacccctccccgttgtagctgctgttctcagattggacccctgtgctccagagggtacctgttggctcttttggggcctcctgtcctcagatttctcaggagccccattgttgtctccgctgtcctcccacacagatcgcattagtatgcaggtctgtttggagtttgctcctccctcttgtattttggggtttatagggatatcttgttttatagtaaatattttctgtgggttttctttattttctttaaaaaatttttttttgagacggagtctcgctgtgttgcccaggctgcagtgcaatggcatgatctcagctcactgcaacctctgcctcctgggttcaagtgattctcgcgcctcagcctcctgagtagctggggttacaggcgcatgccaccacacctggctgattttgtatttgtagtagagatggagtttcaccatgttggccaggctggtctttatttttatttttgagacagagtcttgctctgtcactcaggctggagtgcagtggcacgatttttttttttttttgagacggagtctcactctgtcgcccaggctggagtgcagtggtgtgatctcggctcactgcaagctctgcctcctgggttcacgccattctcctgcctcagcctcttgagtagatgggactacaggcgcctgccaccatgcccggctaattttttgtatttttaatagagacggggtttcactgtgttagccaggattgtctcgatctcctgacctcatgatccacccgcctcggcctcccaaagtgctgggattacaggcgtgagccactgcgcccagcattttttttttttttttttttgagatggagtctcgctgtgtcttccaggctggagttgcagtggtgccatcttgggtcaacctctgcctcctgggttcaagcaattctcctgcttcagcctcctgagtagctgggattacaggtatatgctaccacacccggctaatttttgtgtttttagtagagacggactttcaccatgttggtcaggctggtcttgaactcctgaccttgtgatcctcggccttccaaagtgctgggattacgggtgtgagctaccgcacctggctattttcctttttctaaaaatctagctcctgcaggattctgtgggtttttgtttctgctgtctggttgcttgtttttatgtgagaattcaggtagacataaaaactctagggctgggcacggtggctcacgcctgtaatcccagcgctttgggaggccaaggcgggtggatcacctgaggtcaggagttcgagaccagcctggccaacatggcgaaaccatgtctctactaaaaatacaaaaaaattagccgggtgtggtggtgggctcctgtaatcccagctactcgggaggctgaggcaggagaatcgcttgaactcaggaggcagaggttgcagtaagctgatatcacggcactgcactccagcctgggcgacggagtgggactccgtctgaaaaaaaaaaaaaaaaaagaaacaaaaaaactctgcagccactgtcatctgcccacaatctccccagcattctcagcttccttgtttgttattgtcggccccctctctttccgtcttttgcccctttcatcatacttttgctatctaccttttccttctctcctaatccaaacctttctttttgccctgggggccatattaatccaaggcttttgtatcagattaactgggtttggattcctgccccactgttttaggatctttgctacagtactttgcttctgctaagcctcagtttcctcattagtaaagtggagataataatggcattaaataaagatgatacatgcaaagcccttaatggagagcccaggacatagttaattgccagtttccggcagctgcctttattgatgtggctgctaattgctcttcctcactccatacctggccctgtcctgggctccgatccagtttcacgtggctgccttgcccttgtggctttcttggcacccctccccccgctgtggcttcattctgggtggggaagtggcaggggccacctggcttgagcaggacagtggcattgtgtcttccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcgtgagcgtcctgcccttgccctcctggacccccagcctgctccctggcctccgctctccttttctctctccctgtacttcctgcctttctctgtcatcctctttcttgtcactgtgaagcgatgaataaacctgggtgtagatccaggctgagccacttaccagctgtgtccctttggccaagtcccttaatttccctgagcctcaggcctctcttctgtaaaatgaagctcatggcagcatctgccgcggggagctgcagtgggtgatactgcgggacgatgcgtgttgagtattgagctgggctgggcacttcctgtatgcccagcacatggagtctcccctaactttcacggctgtagcattcgcctcccacccttcctcatttcttctcccccacctactcattcaccctccctctctcctccttctcttcccctcccctggtttaccctgagagccttcgacgccctctatcagctgcccagttattctttaagtccctctcagtgtccctgccactctgagtgctcggaggcgatttgatgagattgagtttgatcctgagtgagatcaagacatgggaggaggctgggcgcggtgtttcacacctgtaatcccagcactttgggaggccgaggcaggcggatcatgaggtcaggagatggagaccaccctggctaaaacagtgaaaccccgtctctactaaaaatacagaaaattagccgggcatgttgtcccagctactcaggaggccgaggcaggagaatcacttgaaccagggaggcagaggttgcagtgagctgagatcgcgccactgcactccagcctgggcgacagagtgggattccatctcaaaaaaaaaaaaaaaaagacatgggaaaaaaaatcaagccagccctatttatatttcaaactagaggtaacccccgagaccctggtcacatttatagctgtgggacatccatgtttttcttttctttctctctcttttttttttttccttttagagacagagtcttgctgcgccacccaggctgcagtgcagtggtgcaatcatagctcactgcagccttgacctcctggactcaagtgatccttctacctcagcctccagagtagctgggactacaggcatggacaactacacctggctaatttttaaattttttgtagagatgacatctcactatgttgcccaggctggtctcaaactcctgggctgaagcgatcggcctcccagagtgctgggatcataggtgtgagccaccgcgtctggctctcatgcttgcttttctctcctttttcccttccttgcttttcctccctccctccctcccttcctctcttccttcctttttttccttccttctttttaaatatgtctcttcatgtgtggagattaatagtgatccctggctgggcacggtggctcacgcctgtaatcccagcactttgggaggccgaggcgggcggatcacaaggtcaggagttcgagaccagcctggccaatatggtgaaaccctgtctgtaccaaaaatacaaaaaaattagctgcgcatggtggtgcaagcctgtaatcccagctacttgggaggctgaggcaggagaattgcttgaaccggggaggtggaggttgcagtgagccgagattgcgccactgcactccagcctggatgacagagtgagactccgtctccaaaaaaaaaaaacccaaaaatagtgatcccctgaatacaatggctgtggtagggcctgatgaggggtgggggcaaaggggaggggctcaggtggcagcatcagggcaggggtcagtgagcaatgatagtcatgtggaggagaaagccactgggtcctaggatgcctggggacagagaagagtgactgctgacacggcgtgggtgactagagacccacgaggcccccccatactccccttcctcccttgctaccttgtcctccatctgctctcaccctcccactcctgcccccttgccaagtgatgcttgtcactccttttttttttgaaatggagtttcgctctgtcgcccaggctggagtgcagtggtgccatctcagctcactgcaagctccgcctcccgggttcacgccattctcctgcctcagcctcccgagtagctgggactacaggcgcctgcaaccatgcccggctaactttttgtattttttagtagagatggggtttcaccgtgttagccaggatggtctcgatctcctgacctcgtgatccacccgcctcggcctcccaaagtgctgggattacaggcgtgagccaccaagcccagccctgcttgtcactcttgaggagtgggcccacatcagaacagcttttggacctatgggtggggcggggggtgtacccaagagcacccaagcctctttaatcatgaggagaacccccaattcctttttttttgagacagagtcttgctcagtcgcccaggctggagtgcagtggcatgacttcggctcaccacaacctctgcctcccgggttcaagtggttctccttcctcagcctccctatagtccctgattccttctattttttttttttttttttgagacggagtctcgctcttgttgcccaggctggagtgcaatggtgcaatctcaggtcatggcaaccttcacttcccaggttcaagcaattctcctgcctcagcctctcgagtagctgggattacaggcatgcgcctccacgcctggctaattttgttatttttagtagagacagggtttctccatgttggtcaggctggtctcgaactcacgacctcaggtgatccacccacttcggcctcccaaagtgctgggattacaggcgtgagccaccacgtctggcttctttttctttttttcccccgagacggagtcttgctctgttgcccaggctggagtgcagtggcgcgatctcagctcactgcaacctccgtctcccaggttcaagcaattcttctgcctcagcctcctgagtagctgggattacaggtgcttgccagcacgcctggctaatttttgtatttttagtagagacggggtttcactatgttggccaggctggtcttgaactcctgacctcctaatccacctgccttggcctccccaaatcctgggattacaggcatgagccatcgtgcccagcccctgattccttctttttttttctttctttttttttttagacggagtctcgctctgtcgcccaggctggagtgcagtggcgcgatcttggcttactgcaagctccgcctcccgggttcacgccattctcctgcctcagcctcctgagtagctgggactacaggggcccgccaccatgcccggctaataataatgttgtatttttagtagagatggggtttcactgtgttagccagggtggtctcgatctgacctcgtgatctgcctgccttggcctcccaaagtgctgagattacaggcatgagccactgtgcccagccctgattccttcttgatatcactacatctttgtcctctagggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagaggtctgtcctcatagtctaccttgagccaccacttttgtgttcctatctgcccacttctgcccattgagccttccagaaaccctctcccgtcccctataaatcacgcctaatctctgctcagaaccctagggcttcctcagtggggatctgccccagaccagcttccaggctgctgaccaggtcttcaccctgtggcagccctaatcctctgtcagcaaccagctgggagaccacagttttgtgtgtgtgtgtgtgtgtgtgtgtgacagtgtctcattctgtcacccaggctggagtgcagtggagtgatcttggctcactgcaacctctgcctcctgggttcaggtcattctcctgcctcagcctcctgagtagctgggattacaggcacccaccaccacgcccagctaatttttgtatttttagtagagatggggttttgccgtgtcagccaggctggtctcgaactcctgacctcaggtgatctgcccacctttgcctcccaaagtgctgggattacaggcgtgagccaccgcacctggcaatgctgtgtgttttctgtgaggtagacgtaaggacacctgtggacagagggtctgggaattaccagaacccaggcaagggctcccctggctcctgtgctccatggtgtgggctgaggcctataggagatgccccaagagcacaagctgccctttgtgagctcttgggagaggcaactgccttattcatattttccctcattgcagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtatgcatggaatctggaattatagggtccttctgatctctcaagtgagggtaagaattagagttgccccatctggcttccttgaacaggagacaaggtgggaataaagggagttcaacccaggaagcaaaccagttccttagtgggtgtatcagttagcatttgctgtgtaacaaatagtccactccagttttccaaattttttttttagtagcttaaaatacagccatttatttagcatatgatcctgtgggtcaggcatttgggctacctacatgggcatttcttctggtcttggctgaatttcctctcaagtactcaccggtatatacataagttctgcctctggctgtttgctgagcaccttggttctcttctatgtagtctctcatcctccagcacacaaacccatcatggcagctgggcagagttctcagagagggctcaaaactggcacagtgtcccctgtgctccattctgtgggcaaaagcaagttataaggccagcctagattcaaggagtagggaaatagactccctccctagacgggaggactgacaggcacagtgcagtggggctgggtggagatgagcgagataagtagggccatttttgcgctctgccaaagggactgtagggaacagccagggcctatagggcagtgggagagggacagtgaagggctgcatcagctgttggcaggggaacctttaggcactgtcttaccgcagagatctccagttcccagtgaatcatgaaaacttctcagtccccagaggaagtaaggtcttcatcatccagtggcctggactcaactccagatgtcagtgctccccctcagaaatatatagttgtccatctggacctctcaggccagcatgtctctttcctacttcccaaactattccacatgacgctggtgcccagtcagccctcagtgccctgggacagccacaagacacatgagcagttagaggctgggagacgtcatcttagtacttttgtcatccccaaactgctccaagcacctgtctgctttgcagtgtcacctggccacgggatgcctttcaggagttgctgtagaccacagaggcagagggcgcttaggtttcagtacgtttgtagacacaggtcccatgagattctgtggtattagattgtggtgggggagctgtacatcagaatcaccctgacttttgccagctgtggggcttggcatgtgcattccgagttccgtggagagtcctgctgcaactgcctttacagaccatcaccacctgctatcctctgcttcccccacccaggtcaggcagcctcccaggggtggctttgtccttgtcccctctcttcccaagcctccgggatggccaggcctctcggctggtgtgagctgttctgcatgagccatcctgccaccccttgccctgatccatggctgctcccactcatggtggtaggagagggacagcagtgggggaagtgtccaggattgcatgaggctaaggtcaaagtagaaaaggtagacacaggagaggggaggtttcccaggtgggagaggaaaaagcggagagaataattaataatggtcttcaggctcctaggtaccatttcactgtgtgccaggacagacctggggctacaggtcaaggactgagggcagctgttgggctttcaggccaggaagcagtgaccaaagggactgtggcatctcctccaagggcaggagatttggaggcctagacacagtagggaccatgagatctgggccagagggacccttctccaggcctcaaggtaatggtctttgggtctgtgtttccacttgtgtttttccaccggcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggtgagtcctcgcccttcctggcagggatcctggccccttcccccgggacagcttgcccacctggccctggccttggccccttcccagtctgcattctgtgtccagcctgtgctgctctgtggcctctccttgagggcatacagacagttgagaaccagcctcatgcaggccccacaccatgttctccaggaggaacagtcattgagcttctaagtctggacacctcaggagggtcagccacagggggcacccactggtcaggtgtataagttcatttagggctcgtagttcctagtgaagccgagcggtgccgttttgcacataaggaagcagtgacggggacagcacagtggcccatctgcctcttgccttgctcttcaccaggatgcctggtgtgtccctccatggccaggctttacagaacgcagtcccacctggagcagccactcggacccagcagccccccattgttgcctgctccaagcctcacatctaaccctagctgcggctgtctgctgggaagagccaagtccatagggccctttgggcacatggccaggcctctgaccctgtggctgctctctagttctcaggcccaggcaggatgtcagtgcaggatggagccccgccctaccaaaggcttccaggtgggcatgagctcacaggcaggccagggagtagggaaaggctgccctggaggaggccaccattggtgcagattcttggtcccctctacccccactgctccaagaaaaggtggcctaggggcattatagattgggaattgaggggttggagtgttagttcatgccctggcctgggaatgggaccgccctaccaggttcgtctccctgccaaccccagtcccttccagtgctctcctttctttcccaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtacacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcacgcctgtaatcccagcactttgggaggccaaggtgggcagatcgcctgaggtctggagttcaagaccagcctggccaacagggtgaaaccccgtctctacaaaaataagaaaattagccaggtgtagtggcagacgtctgtaatcccagctattcaggaggctgaggcacgagaattccatgaacccaggatgcggaggttgcagtgagccgagattgtgccactgcgctccagcctgggcgacagagtggtattctgtttcaaaaaaaaaaaaaaaggcagtatgtagccccgaagactgttgcccaagtggtagaatgttagcacactaccagcctaggtaaaaaatacaaaaagtaactgggcatggcggcgcccatctatagtcccagctacatgggaggctgaggtgggaagataagtcacttgagcccgccaggaggcggaggttgtagtgagctgagatcgcaccactgcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctgtcaccatgcctggctaattaaatttttttttcttttttttttttgagatggagtcttgctctgtcacccaggctggagtgcagtggcgcgatctcagctcactgcgacctccacctcctgggttcaggccattctcccgcctcagcctccagagtagctgggactacaggcgcctgccaccacgcctggctaatttttttgcacttttagtagagacggggtttcactgtgttagccaggatggtctcgatctcctgaccttgtgatccgcccgcctcggcctcccaaagtgctgggattacaggcgtgagccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaagccgaggtgggaggatcccttgaagccaggagtttgagacaagcctgggcaacaaagcaagaccctatctctaaaaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggtcatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctacttcttcagtgctgtttttatttaaaaaaaaaaaaaaccagccaaaaccacaactttttactgaagtgtaatgtaaatgctgtaaaaggcagtgaaaggcacaagggaggtggaggggtaggaagggtggaagtggcgggaggaagtggcagggcaggcaaaatgaagggaagccctgggttcttgtcctgcatccgcagccagctcccactttcctcaccctccaggacctgtaaactgtgaggctggaccagttatgtcaaatctgtcctcccccagagctcagtccctctgcccttgggtgtccttggcacaaggcaggctaggctgcaccagcttcctccatctccgtcctgcctcccccatccccaggtgccattcccacaccatctgaatcactgatttcctcgcaatcagacgctatcttccagttaatcacttcgcttgtatttaacataagaaagaaaaaccctttcattatcacatacagctggaaatcggcttcttgcaggaggcgtatccaaaggaattggagaagagataaactggtaattggtgaaagaattactttaattttttttcctacttgctgtcatgatgatgtccttagaattgtgagcccgtggacacttctgtacaataaatctgctattattacttctagaactaca

SEQ ID NO: 1864 - DNA, 29325 bp, Homo sapiens; identical to SEQ ID NO: 1863

SEQ ID NO: 1865 - DNA, 29325 bp, Homo sapiens; identical to SEQ ID NO: 1863

SEQ ID NO: 1866 - DNA, 75925 bp, Homo sapiens
aaatttataaggcaaactctttatataataaataggttacagggattcagtggggggggggtgtttttgaaacgtatacaggtacattcagacaggtttactgaaatggtacaaatttccttaataaattgccttttgtttttaaatatatcagtgctttcagtcatttggctatacacaaagaaccttttttctgaacactacaaaaaagcaatcaataatttttgtttttaaaacgacctacttattttctaaagtaattgtcccaaaacacaaaaactgaaggtgaatacgatacagggcttttagagacatctccagctaagtgtgtcccggcctctccctgtgccccaagtgcacctctcccaacctcagacaggtttccaggctggagccagctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggaggaagggaaagaagtgaaaggatgaaatgaacaaaaggcagaaatggaaggggagaagagaaaccaatcaggaagtccttataaaattgcagcaaacacttagagtttcggagcttcgtgggaaccctatgtgctgagcccactttaaaacaagcgcaggtatatatacaaatccaggtagttctcaacactgtcacatctggtggcttgagggactaaatgtcaccaattcaagccagtttgctctcagagcatctgtttgttttgaagtgggaacatgaagactcaatagtgcaaataattctaagctgtccctaaaggagaattggaaagtaactggaagaacattttcttctcctccccctttgccccctcccctgtccactaagtcacagactgctctgagtgattaggaatccctctcaccccgctgtgctctgcccggcctgaccccaggccagcctgcctgcaccttgtcctactgcctccatggcctctagcgccacccgttggaggacgtcccttgagaatggaccatgccacctcaccctgggccatcctctcctgtggttcaggccagtctacacccagtagttcaagggactcccccctcctagccatgccagagctggagcagacaggtgccactttcctgtcctgtgaagcgtccttgccagttttggattggggctggtgtggggccagacttgagccaccacgggtgggatcgcacaggccatagccactggtcatatccatcttctctaaagaatccaactgtctctcctgcctcacacctccctgtcccaacgtggttgggagtgggggaggtggggggagctgggggagctgtagacggggcactgatggcaccgaaaacgggagtgtcctctcaactgctctgtcgctctgtctctaacgaccacatgggggaaaggtttgggcgggaggggaggtgcctggtcaacagcttgtctggtcagtagtatctgcagcaagccttgttgaaggagcctagtttagaaaagtgcaaagctacttctggccctggttaggtcttcaacctgactgtgcttgtcggtaagaaaaacatccccaatgctccaactactcccaccctgaagccacgaaactctaagtttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg

SEQ ID NO: 1867 - DNA, 67503 bp, Homo sapiens
ttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg

SEQ ID NO: 1868 - DNA, 23132 bp, Homo sapiens
ttcaagttaatggaaacaagtctttattaagtaacttttaatatcagaaaaataaaactcttataattctctttacagcaaatatataatatcagtgctttggccatcttaagttaaaggccctttatcataaaatatatggttttaaattttactcaaattgaatttataatccctatgacttccctacatatacataacaaaagagtgtagtaaaattagcaaatactaaactatattgataatttatcattcttagtttgtggtttttagaaacagtacacgcacctaatatatgtcgattccttggcttattagttgcagtgtacaatgcaacaaaatacaaaatacatgcttggtgaacattcgttcatatctacaagacggcagctagagattaggtttcaatactgaccatttactatcctacaagcaattagcattacatcataatatgccatcaaggcaactttttttatactgaaaaaatcaaaataaaaaccgttatttgtaaacttttatacgaaatgtaactcttcaagtggaaataaaaaataaaatttgtctatttactattgaatacacataggatttcaattttcattataccgagaaaaaagctcttttgtgttgggaaaataatgcttcaaaaaataattagtagaaaaacccactagtataatgttttgtcctttcaatgccagcacagatttgggaacatactgaggatgaagttatagacatccacaggtgaaatgtacgagtatattttaaataaatctttccttgtgattggaaatagttttgaaatgaagtaaactgattggaggttgtcacagctgcttttgtgaattatgccaagggcatcattatccctttctccctcctccctcccctaaattactaaaaaataaaaatatatttataatgtgcaagacaaatatggattgaacataaaatgtttcacattttgatctatagtctaaaaattaacagctcgatcacactaatgaatggaatgtttgcatcctcaattatcagccaatataggtgccatcccaaagcccttcctgatatgggaaaacccaggtggccatttccacattcaccaagagaggcaatgggcaggaattcacaattgcattcctgatccactgatcataccagccttgagcactctgggcgagatgaaagttgatgtagcagtttttgtcccaaattataaccagtgatctagtaaactgccatcagccctatcattaccaataagtaatcacaatgcattaaaaagttacttgcaatcctgcagaattaggcatatgttgttgtaaaataaaaaacaaacctgttttgtcaaaactggcagtgtaaagaaggcagcactggaagtgtatgaatcgtctgtaatgccaagtaccctccataaactcttaaagtggttaggctttgggacccattgttttgaaatcttagacgtatacactttttcataggctcacacaacctatgattatcttcactcagccaagttgaacttcagctttagcaattcttatataaactatgtctctgggtctacaggatagtactaataattcaaaccaaactaatagacaagagaccacttaggtttagtgttaccatagcagccttttataagtttactaacaactttagcctaatcccaataaagcctgataacagtcataagaaatcattaggaagtttactggggggtaccattatacccatgcctttacgagtccatatagagatatagtatttatgtatatatatatagttaagagtgaatttggattgcctgagtaacagctgtctggcaaactggacatgatggcgttctcttttcacagatcttgttggcacattccatgcagaagaggttgtggccacatggaactagggcagcaataacctcattctcaaagcaaatcacacagtcgtgctttcgtcttgattctggaggtgagctagaggtggaaccaccattggaagaggagtaactattggtaccattagaaaaagcagggatatatattggaaggccaacatggttgcctgtactaggtgggtcgctcctaaccctccgagcaagtggatgttctatgctctcaggaaatgtaggagacagacgaggagtagatggctgacttcctctgcgctgagtcttcatgttaccagaaggatcactcccaaagccagagagtgggttaactggttcaaatggagtccagatagtttgagcagatgttggtaaagagtcaaaggcaggagagtcaactgctaggtcttctgagcctacagatggtagtgtatctccaaaccagaagtttcctgtgctaaatgggcttgttggactaaagtcagccagcctattgcttccaaagtaggaatctgtagagccacttcctagagaactggaactatcatttcgataattggatatcattcttgcgcggctaggaggaacaggattggaggagagccacgcagagccaagagtgccaccttcaaagcttacatcggtaccattgtaatggaaatcattctcttcattgagctctatatagtttcctgtacgcatggcaatatgcatttctatttcttcccgtgctcggtcaacattttcaggcatccctgtcacttcaaagacaggttccttatctctgctcggagttactatgtaggtgtgggtctgctgctgaattcttttaatagttgctcctttgggtccaaccactaatcctaccacacgataagggaccctgacttggacggtggtttgaccgggcagattaggactacatgataatcctcccagggcaggcccatttttgtttcgagatgcacgaatcatggagaagtgctctgcagctgagaggatctctcttttggccatggcaacatcttctttccttccagtgacaacaaaaatgggctcttcaccacgaacaggagtcttgatatacgtgtttgtcttggctctcagtgctttaattttacaacctgttagaaagaaaacatttcataagaatcaacatctacttcaatgatatatataaagacaaatcacagaatgcaccttttaagctaaatatctggttatgggttaagttttagagtttttcacatagctaggaagtggcagagccagaagtaaacctagtttgacttaaaatctgtggtctttttgctagtccaagaacctcgattttcacaattatctgacagaagttattaaactgacttccacctaattatcttaccactttaacttaacattactctttcctctgtaaaactcaattgatgacaaaaacaccgtgctcatggctagtaggtcatctcacttctgctcccaccagttaaattctaggcctgctatgattcagttttgtttattcccatgttgtttgtggtaggtgtactcacgctagtaactaaattatctaaattactgcataaactagtgaaacatgaatgcaaaaaagatgagtatcttaaagaaaaagctgctactgaattatgaataggtgagacagctgtaaagggctggaataaaaaaaaaagtaatatagaatgattttgtaatcattgtaaagtcctgctccatttaaaagaaacagatactgcagattgtatggaatgtgggtgctgggtgtggttttattcaaggactgctctgattgacagacacaatttcaaataaaaggccatgaccccaaatcctaagtatatttaagttaaaataaaacatctaagacacatatgtataactttacgtaattctccactttaaccaacttttttttttttttttgagtaatcacagattactagtgccaactatgtgaagattagagggcttcaaactgtaacttaaaatgtcaagtacacaaccaaggaataaaactctggggttatacttttcaaagaccctaacttgagcttgccagcatagatgtgttctcatgaatatatcatactattcttagtttgtcaaaataaagaagctaggtgctgtaatcccagcactttgggagggtgaggcaggtggataacctgaggtcaggagttcaagaccaggctgactaacatggtgaacatggtgaaaccccgtctttactaaatacacaaaaattagctgggcgtggtggtgcatgcctgtaatcccagctccttgagaggctgaggcagaagaattgctcgaacccgggggacagaggttgcagtgagccgagattgtcccactgcactccagcctgggcaacaagagtgaaactccatctcaaaaaaaaaaaaaccaaacaaacaaacaaaaaaagaagctaggtgctactgaagtgtcacaatctgagcatgtctttttcttaaatgctcccttccttttttgtcctcaataaattaatattcctatatcactttagtcagatgatgctttttttctttttgagacagagtctcgctctgtcacccaggctggagtgcagtgatgtgttctcggctgaccgcaacctccacctcccgggttccagtgattctcctgccccagccacccgagtagctgggactacaggcatgcacaaccacacctggataattttttgtatttttagtagagatggggtttcaccacgttggtcaggctggtcttgaactcctgacctagtaatctgcctgcctcggcctcccaaagtgctggattacaggcgggagccaccgcacctggccgatgctttctaataaagcacatgacctgatcacttttttgcacaaagtggaacttgtttgtttgcccttccaaagcattcccaagccactaggtgttgactacacaggttgagttatcccctatccaaaaacacatgggaccaggaatgtttgagattttggagtatttgcatcatacctgccagttgggcatccctactctgaaaatctgaaatgctccagtgagtattttctttgagcattatgctggtgctcaaaaagcctcagattttggagctctaaaacaaaatcggaggctttttgagcatttaggatttcacattttcggattagaagtgttcagcctgtatgtgcttttgttctacaacagaaaatcagttagaagaacagagagtacaatgaaacttccacatctacgtatcatttatacaggctaaatgtccaggagattccctcatttagtgcagcaggtgcagtttggtgtgcagaattgagatcactttctattgatgcttaagaaattctgaaaggggtgtataaacacagaactggtcatattctatactcaggggagttactatttggatatgtaagttcacagtgggctacaacttgacaaggtggcaagaaggcagtcagccacagttacattcctaacaagagacagacaatattctgcagaaaaacactgggcaaattgcattaaggacaaagggagaattagtctaagggtctagggttggtccctttcatcccttactaatattgaccattagaaaactgaaaataaataaaagaaaaaaaaggaaaacagaaataaaagagaaaaaagaaaactatgtaaaaatcccttaatcaaatacttttgatactataagcaactgtcagtcacacccttagtagaatattttctgttaaatacctaacaggtatattattaactgaggaaatatgcttgagggtccacagaacactatctagcctatggttggtattaataaataggtgtttaatgtatggttcattgggtacagagaagacaaatggtttgagcatgggccactcttgagacaggggagaaagacaggcctggtctacacccaaaagggtcatgtgtttattaggttttgcagatcagggaaaaaagtaaaaggaagacagcaaagccaaccctggtttttttttgttgttgttttttgagatggagtctctgtcgcccaggttggagtgcagtggcaccatatcggctcactgcaacttccgtctcctgggttcaagcaattctcctgcctcagcctcccgagtagctgggattacaggtgcccaccaccacacccgggtaatttttaaaatatattcttagtagagacgggttttcaccatgttggccaggctagtctcaaactcctgaactcaggtgatctgcccgcgttggcctcccaaagtgctgggattacgggcgtgagccatcgtgcctggccaccaacccagtttaagccactgccaataaagacagaggaaactatttcttcacttccctaaatcttttgattatagtatcctaaactcagattagggattatagggaagctcaccaatcataccactgtttctgtaggaacacatattctgagttccaaacaactaacatgatttctcaactacaaatacattctaatgttggggactactcgaatagatactttttaaaaggtgacacaaactaaaggagaaaaacaatcttgttttgtaattttgcaggtgacgaaggtattagcttttttgagtactttgagtttttatttgaaaactcgaagatatttttaaaaataatagaatttataatctcagagtgaaataaaattcagaagccgtattatgatatattagcctgtattttttaagttgctacatggcacaagtcaccaaaaacaaagtaaaaaaacctaaaatatttataacattattagaaatggctaatttctcactttcttacacacacacaaacacacacatacacgcatgcacacacacatctctcccctacaaatcaaaacaacaaaaacccaataaaagggtgaaagaaacagctaacatcaaagtaaatatacaaatggctctgaagatggaaattcccattttcaagggaactgacctattattttctacctataagattgtcaaataacaaaaaccttacaacaatgctagtaaagagtggggaaaagaactctcatatttagctgtgagagtataaactgccctctaagagctatcacagttataagcccatatattcttacgcttctacaatcttcttgtacaattgatcctgtagaaatatgtgcacaagtgcaaaataacttctgtattttataattattgtttgaattagcatgaggctggtacagctatataatggaatgctatacactcataaaagtggttgacctagggggacagggaaggagggaggcagttttcactgtatattcttatttattttttttaataaattttgagtcatacatacacattactttttcaaataaatatgattaagttagaaaagaaaaacaaattaaatatacagaaatgatacactttactagtcttagcatattgattagacgtttggttagtgctactgatattattttaaattacagtagcccccctcccttatctgcagtttcactttctatcatttcagctcctttcagtcaaccatagtccaaatgcaggtgggtacagtacagaataaaaagatatttgagagtgagtaagaccacgttcaccaacttttattacagtatattgttataagtcttctattttattattgttaatctcttactctgtcttgtttataaatcaaatgttatcacaggtatgtacatataggaaaaaacatagtatgtatatatagggtttggtactctgcggtttcaagcatccacttaaggtcttgggaaggcatccctgttggataagggggggactactgtacaaacagcagggtaaatgatttcgtagcctcaaagttgaacaaagttttgaaatttaaaaatgtgaggactacacttcttatagctacagataaaaatccacatatggcaagttgtattcaaggtaatcaatgggcagaagtctagactagactgtttagaggtcaagaactaattttatcttgatttggaagtaaattccctaaaaaaagagtctccaacttaacctcactggtgtaggaacccattttcctttcctacatcactgttgctggggctatgtttcaccttaaaaccctttagctgcagctagaactctggtcctctcactccctaatacagcaaaggattctgccttgcttctccagggtaaataaagagagcttttcctagccttagaaattaagacggggaggtcctctgccgctgggaaaggggttgaaagaaaagaaattaaaatgaaggtaatcttcagtgtttttcaaaccatgggttgcagtatcaattcagtaggtgcagtcagcatttaaaaaaagaactcaatatgttccaaatgtttcagtgaaatatataatgggctgcaaaataaaatgttctttttcctgtcagaaaagtttaaaaccactagacaacatcacctttaaggccactttctagttccattaacacatgtgaaatgatgtacttacaactaagaaccagtacagtgatagtgaaaaggagggagtgtggcattattgagaaaacctgggtttaagatctgactttacagatgaaatttccatacagttgaaaatggtaatactatagttctgctctatggtcacctaaagtagcttgtggaggccagacagctcagacatatttgtaacaccaaatttttaaaaacccattatttattttctagccaccagcaacatatcttggatactcagagcaggatttttcaagttttgtttttgtttttaaaccacggttcatttagatggcagcaaaaagaccacatggcctatccataccatttgttcccacttcccaacagaaaaagcaccatgtgataaagaattgagttaatatttaggtcaccagtagtgtacaattaagcagaaaatgaaagtccatggagctgttcatcattcaccactaaatcctttaaaaagctatagtagacagtatgataggcagaatcctaagatggctcctcaagattcctgggcctagtatgtacacatactttcagttaaacaaacactaacctaggtggcccctgtgaagggactttgcaaatataattacaatccaaatcagttcagcttaaaatagtaaaattatccagattatctgggtgggcctgacctaatcataagttttttaaaagcagaggttttggctgattgtggtggctcatgcctgtaatcctagcactttggaggctgaggccagaggactgcttgaagccaagagttaatgacaggctgagcaacatagcaggacgctgtttctacaaaaaaacaaacaaaaataaaaacaacaaaaaaaattagccatgtatggtggtgtgtccctggagtcctagctatatgggaggctaataaggtgaagaattgcttgtgtccaggaggtcatggctgcagtgggttatgatcacaccaatgcactccagcctgggcaacagagtgagaccctgtctcttaaaaaaatttttttttttcctagcatgactcagaagagaagtcagagagatgtgctctggctaacctggaagaagaaagcaaacaatgtatgttgtaaattgcctatggtgaccccaaggcaaggaacttcaggtgtcttctaggagctgtgagctagaaggaaaatggaggtagaggtcatcatcctgcaacacccacctcccactccctactcaaaatgaattttatcaaaaaccagcaagcttgggtgaggacatgagccgcagataagcactgcagtcctgcccaataccttgatttgaacacagtgagaccctgaacagacacaccatgcctagacttctgacctacagaaatggagataataaatttgtgttgttgtaagctgctaaattagcagtaactgttacaaagtaataaaaactactagagattctcagagcccttaaaaactccacaatcactgccccaagagaggagagactaaaatgttagatatattacattcttattcaataccctacaagacattctggaagtctctcaagaattattgtaagaagtagcttttggctgtgtgtgatgcctcaagcctgtaatctcaacgctttggggagctgaggtgggaggatcacttgagttcaggagtttgaaaccagcctaggcaacatggcaaaaccccatctctacaaaaaatataaaaaactatctgggcgtggtggtgcacacctgtggtcctagctacttgggaggctgaggttgggaggatcacctaagcctaggatgtcaaggctgcagagatccgagatcgtgccactgcattcaagcctgggcaacagagtgagaccctgacccaaagaaaagaaaaaaaaaaattaagaagcagttttcaacataaaatactgtattaaggtgttacagtaaatatggaattgccaatagttcaattaaagtccaaaaatatttctgtcctttaattccctattacctgctttagtttcctaatgctgccttaacaagttaccacagtggctttaatgacaaaaatttattgtttttacatatatttgttattttacagtttggtgggtcagacatctgatatgggtctcaacagggctaaaatcaaggtgtttgcaagggctatgttccttgcaagaagcttgagggatccagttccttgcacatgcaggttgttggcagaatttgattgcttgcagtgaaaggactgagtgtccttgctggctgtcagctgagggtcattcccagcttctagaggccacctacattccctggcttgtgactcatcttcagagcgagcaatggaggctgagtccttctcatgcttcacatcttctttttcagatctcagacccaactgggaaaggttttctgcttttagggtctcatgtgattatacccagatgatcatccagatgatctcaagctccccaaagcaaggtccataccctcaatcacgtctgcataaacacctgcaacatcccttttgccaaatgaggtgacatattcagagttcctggggaattcggatatggacttgttgggtgggtgggattactctgcctatgacattacctttctcctttccttcaattattttccttttcttccaagtacctagcttttaaatcccaattcaggaatagtaacccaaaggccagggcagcgaatagacataaggtagggtcaggaaaggtttgaggaatcacgggcattggaataggtgaagggataaatctaaaaatcaagtaagggctgagtgtggtggctcatgtccgtaatcccaacactttgggaggcagaggtgggaggattgcttgaggccagaagttcgagaccagcctgggcaacatagtgagacccccccctctctataataaacaaataatattaaaataaaaatatcaaatagggagaaaatatagaagccaagtgtttacaatgacttttactaggagattatgtttatgttgggagattagtggtttggtacgtgatacacagtaaaagtggcttccacttatcctaggcgttcccagcaaaatcactgcttgggtgaactctaagagcattttatcaattgtgagataaagtgcagcctaatacctgaacttacccattcacatgttaaattccctataaagatgctagtgctacttccaggtggtataaatgaaccagcatcatttctgctctcaagcttagtctagagggaaaaaagtaaagcaacactgaatacagtaaccggtttaaaggtacctacaaagcagtaggtacatacaaaaggagatgactttactacttacagtaaataaaagaaagctttaaaggcatctgaactgaggcttaaagaaaatggttttgccagatgggaaggagagcagagggaactgcaagtgcaaaagcaaggaatcaagagtacaggatggcacagtcagacaactgggttcagcagtgtgagagcttcacgtcactggaggatagaatggcagggataaagctggatggggagacagaagtctctgatgtcaggcaagggaatttcgactttatcgtgtagtagaaaaaactggagatagacagtaacataaacagatatgcatgttaagactagtgggtgcataaaagatgcaaaagagacaagacgggggactcaccacaaggcctatcacaataatgaacagaaaaatgctgagaacaaaggacagaatgcaaggctggggctatgtatgaccactgttatgaacatcaagtacttgtgttgtagattttgcaaaaaggaacttgttttctagaaactaaacgcattatgttttccattcatttcatacattagctacaaatacaaggtgactaaagaaagctcaaacccttacaagcaaacatcacaactgcattatgtgtatattttcacttttggcagtccttggggtttttcttcaaaaatttcccaagaggttttgttttgaagggtaaagagagaggggagttaaacatcttgagtagctcttcttaccttcaagaaaaataaaactctttggcctgaaattaagtccccaccccttctgcatattaagtggccacaacccaccttctcccagacttcatcccccaaacatgtcttgttcctcttctatctctgctcgggtatttccttacataatctggaaaaccctcctagtattccttttcctccctgagttatctgaataacaaacatggccatttggaaaagataaaactgtatgtgtgaaaggctccacgaacttaagaataatacaaacataggcacaactcattattatagctatcatgtatgaatccattaaggtccagttcaagggaaacaatataagcagcaaaaaactgactatctgcaggactcggaacctgctgtttcaacgttagggcaaactatgattaaagatacttccttcgtttgttttttgcaaagattaaatgaaataatgtattaaaaatgcttactacaatgcctgttattaagtgcttagcccaagttgtcttaagtccacactcctttcatcacactattttcccctaaaaacacatcattttgggaggctgagacagaagaatcgctcgaacccgggaggcggaggttgaggtcagcagagatcacactactgcactccagcctgggcaataagagcgaaactccgtctcaaaaaaaacaaaaacaaaaacaaacaaaaaccctaaatcatctcacgtttcatgatatataagaatgaatgaaggggttgtattaataattttatacaaaataaggtccctttccccttggaatagtctagacagaatattcaaaagctcctttcattttatagaaacacataaaatactgtattaaggtgttacagtaaatatggaattgccattagttctattaatcaattctagtattctatcttcaaagactaatgagtatcaactaaatcccagtaagaatgtttcatgtacacaacattaattcaacattttaagtaataatttaagaatgcaatgtattcctaaatgcataatataaaactaatagctttcctttctagggttcaagtggcctccttgtagctattttaaggcaagaatactgtttgtctcactttagggattactatgacaatacttcaaacaccttcatttatgtgattttagtttcattatcagtattcatataaacatttaatgccttcaatcaagtagcatctactgtacttcaaacaaaagtgccaaacaacttgaggttgactgggtccttacataaaaagctgtttggccagttgtggtgacttatgcctgtaatcccagcactttgggaggccgaggtgggtggactgcttgagctcagcttcagctcagaagttcaagaccagcctgggcaacatagtaaaaccccgtctctaccaaaaatacaaaaaactagccaggcgtggtggtgtgcacttaccgtcccagctactggggatcacttgagcctgggaggcggaggttgcaatgagctgagattgctctactgcactccagcctgggcgacagagtgagaccctgtctcaaaaaaaaaaaaaattaaaaaaaatgctgggaataaaggcaagagggaagaaaaccccaattaaaacaatatggaaagtacaatgatataaacaataaaatggcaagtttataagaaaaaaatttagttcaataaaataaaaaggaagtattccactttgttttaggtactttaaccaatattaataatgcaaagatgactaagattcagttctaccttcactgacttgtattaacttcaagcactgaaagtatttagtgatacatgttcatgtacacatagtgacctattttcttttcttatactgttggttggtgacagtagtcagatcttctacaatatccttgctgatttttgtctacttgttctaccacttactgagataggcacgttgaagtctcaaacaataatggcttgagaccttggataagttgtttgtaactccatagacttgtttatctgttcggtggaattaagaatggattaaatgagatgacacatgtagtttttgcacagtgcctgacacaagtttgttgttattaaaagacaagtgaactgatttttatagggagttaaaaacatttaaagaaactcctaaagataaaacatatcataaactttgcaaaattgagaagattttgcaaagtcaatctaactggtaatatgaaatctggtttacttttacctcattttagggactctctttggacaaaaatcagaatataagaaatgtgacagaccacctagttaaatctcattttagacatgaggaaaaccgaagcctaaaattgtccagttataaactagtgacccctaaaccaatgttctctcaagctgccttattttcctaaatcccaataagaatatttctagtgtatttttaggagtggagaagaattccctgcatgtacaaggtattttaaaaaacagaagttaaattaaatctaaaacccctcttttttcacttattttagacaagacaataaaaaatatttaatgaaaagttttattatttggcctttcagtaaacctgaaagaaaaaaccagaagagggtgtaaattagagatgaaaggcagaagttttcctaactggggagcttgaaattatgttcatgctctttggagaatgttaacagaaaccttagaattatctgtctgggtaccatacaatggaattagattcatttgtaaatgattctcttccagacttgcttagttctttgccaggaaatacatttccaaagctctgattttaaataaattttaagacatattataaatttaaaaaatataacttacataatttattggtatagcctacgaaaaacttactaaaatgacattttttggctttaactagcatttgttcagagtataaaagaaatttagcagtaaaaatttaccttatctgatatataatttatcatctctgtactttcaattgtactgtcaatttctactaatgctatcttctcagacttgatcctcacaacaaatgagggagaggggagagagaaacctggaagaacaagtagatgaagtaggttttttccagaagagaaaacaggctcagagaggttaagtgatttatccaaggtcacaggcagcaagtgcaaaacacaaggtttctaactccaagtccaatgtcctttcctgcattatactaaatggcactggtagaaaggcagaagagaaggcaaagggaaagggaggcacagagaagggaaataataataaaaaggtcagccccaaatgcaaatatatacttttacattggtaaccattttgggagatcttttctagttgtttgaagccattccctccccacttccccttcaatcatgttcaagaccaaattacttatgcttaccttcaactacatctgcagttttcattaaaggattttcttttattattttaaggcttagtcttattattccatgatagactttacttgtgaccaaaccaggcttctctgcatgcaatgaggaattgtagtccgtacttaccggacaagggcaacaaacacttgaagtgtccttacatctcaaacactggcatggaagaggtcctatagttagtgtaacttaaaattctcaaagtcagttatagaataaagacttgaactactcaaacagtattagactatgcatacattcaatttagtatatctgggtttggtaatcctaacattagaaaattattttcaaggcttaaatatcagatttaatctttgtaagtctctatatagtaactaatggtagcatggggaaaatgttaaaagtaaatccacaaattatggcatataagctacttgggaagcattaagaatgcagtttaataaaaaaggtatcacttaaggatcacctgaatatcaatggagatttaaacataactatccatgatctacttggagcttcttaaaaagctttttttatttttaagtgcaaatacactcctttagtatcttatgaacattatctactttctcatcttgagtttggttacaaattctacatggcaggaatgacactgtttagaattctataacaatcctataaattataaaatagtactgtagtagtcatcatggctctccttgtgggcacatagttgtcatatactttctcagccttttgaagttaggtgtggccagatgatttgctttaatgaaatatgagcagatgtgataagcattacttccggatctaacattttaagaccagtatgtgctatgctgtagtctttcatcttctggcacaacagaagatcagtaacactggagatggtggctgctgttggcctgtgtccctgaatgactaaaatgagcagagcccctatgaacaagaaataaaccatagttgttttaacactgaggtgtcagagttctttgttaaccacagcataacaagcccatcttgacagaagtgccaagtatctaaaaggcattcagatatccgttggttctagttctattacattggaagaatataatgagtcaaactatctgctaaagccaaaaaaggtggacatgattaaacggtggttccaaattaatttcagatttaccttaacaaaagtaatgtgcttagcacttacagtttcatatatgtcgatttctttatcttccagagtctctacaggaattgtagatatgattatgcccaggtgcaaaagaggaatctgaagcctagggagtttaagtgacttgttcaagattacacagtgagttattggcacaggaatatctatttctgatttggttctttccaatataccacagctgaacagagactgtcacaggcagtttggtgtagctacaataggtatttttacatattgtataagctacgatattaaaatacacatactaaaacatttttatgtttaaggcaaaagtattcaaaaccaaatcagcaatatattaagcattcccttataactaaatgctacctttccttaaaaacttacgctgtaaagaaccacctagaattccaacctataaacattgtttgaaaattttctagatagaaatctctaacagactaacacaaatacttggttccctggatcattttcaggttgttggtaaccaaggggtacaaaatacacccttgaattaccacttcatttcccatttcctccctagtgaatcagaatagttcattagctgaataaggcaggaagaaaggcagtagattccccacccatttgcaaaaacaattacagtaactgaacccttctcaagggtcccagaactaatacaaaccattattaacgaaatttaaattttaaagcctagaaaaattgtaatatttaatttttaaagctagtgtctatatatatacgcaaattaactttctgtactacaaatgacagtaaatttttagctggacacattagaactatattacaattaaaactgtgccttgtgggtagtacagacaccaaaattttatcaagtaaactaatttggatagtggtattttaaattatgcatattagaaattcagtatcctacgattagggcacaagttaatccaaaatactaaccttccagagcagaatgcttcaatactgaagtggcaatgtagagtacaaagaattttatttctgatgtcaaactatgctaaatccaatctcaactatttgagcaagttagctctcagaacctctgtttctacctctctaaacggcagtaaccacctagcagggttaaacggcactggtgaagcacctaacatagtactaagcaaagagaagtccaacaatgcaccctcatccccataaaagaaaaagacactgtgctgtagcatcattctgaaactatttattctcatgaaatatgtacttctccttgaagagaaaatttatgtacagcaagaccaagctttctctttttctcctggtcacagacgtataaaccctatttcagttgtgttagagcttgaagggtggttccaccctaagaaattgggaagacaaattgaaacagtgtaaagtattaattgttaataaagaattttgttttataatgtgtaatatattaagcacacttactattcatacataaatatccagatattgggagtatgcacattttttttggacagggtgtacaataaaaagaagctagagacgacttttctagactatgtggctagagaacacacatagaccattaattaaagtctaatgaaagatacacatttatcctaatagtaatacaaaatcttgggttacaagtctctaaacaactgaatttatgacatttagtattaatttataatgtattaagaatgggtatacagttctattttaattcactttttagtctaaatggatataaatgactgtacaaattggaacaaaacctgctgactaaaattagacctgttaatcactgttaatatgtcttgcaggtactatacttaaaaacagagacgttctaagtttataaaattaggtcttaaaatctgttgtcaggtttatttttgatgtccatattctaaaacttctttgattatatcaacaagcctcttcagttcctggctttattttacagtattgttgtttcacaacagatgcaatgctttaaaaaacaaggccaatttaacatttacaaatgaccatatgctactggggagtataaattcgaggtcaaacactctgccaactttcatcagtatcaaaagcggtagtttgtgttttagaaaaacactggaactcagaggccatctacatgagttgctagtctatgtgactcagaattccatttgtcctgctctttgcttcagagctgaagtcataaatgtctccatctgtgacataattatttccaaaatcaattaagagatgtcaaatagaaaattatggcttcaggtaatacataaaatggcagaaatggataatttaatcttaaggatgaaagtttagctccttcaaagcaaacaagaaaatgaaatgatttgccctgttttacttacttaggacagattctctcccgtggggaaatataatactgtaaaagaatgtgaacattagaagtcacttcgttctccatacgagtgagcaaacactttacaggtttattactatgctgctgggacatgggggtggcaaaggggtcaatgatccacaagttgtatggttcagaacagcaaaaggaccagattttctgcttttaagatagaggatgatgacatacttttaacagtattgtcaactctgggaaaatacaaggtttaaatggaagagccagcaatttgtctccatgatctaagacataattaaattcaacatttccttattaaccaaataaacacagccctcaaaagaaaaactaaggctttatctcatttcctatcacgtaatagctggtacaaaataaaaacttggaattcactttacttttaaaaaactgatttctataaagattaacaacatacacaagtaagggccatttagcagtgctttaaggggtgtctactataatgaaggactaaagtttgtattaaactaaatctataaaatatgttatcttgtccttcagtaaaactggcacgtaaatgttttcttcctttgttaccctagactgttaccataagcacacggaagcaacttgtcctgagaagtggcatcttcatatggcattcaggcttcttcacattctggtgtgaacgcctgccttcccccttttccaccactcccctttacagacctcaagtatcaaaacaacactacttggcaattatacctaggctagtcctccacacccctcctcacattgttcctccacagtttttcaatctccatttgttagactccttcctacccattttccaaggccctctccatagatgttctcttacctgagactttgtcatactaaatacactatagttagtgccattctactgtttattagactgttatcttcttaagggcagaaagtctgaattaacttcacattctcaataccacaaactcaaaacctggcaaaatacaagcttggtacatagcgattcctcagtgttcttacatgaatggtcaactcattctgatccaaattgagatgttgtaattttatcccatgtaaacaaaagttttctcctggattattactctaagtatcgccaaaaccaaacaatccaggaatctgaaactcattaaccagaagaacgacaagcataagctacctttcaattgaaaggtccagctttgaacagtgtctgtaagtgccaatcatcaggcagtctgaactaagctatctcctttatccagatttcagatgagtttttattaaaatcctacagataggaaagaaataagccaagtctgatatgtgaaaccaccatttcgacagagctcttatttatgtgtactttagaccacctgggaaagatgagatcatttaagcggcagcgccatcatctctctttatttgaccccaacaatgctctcaacctaacagtaaagaggcatgcaacaaccaggctaaaccacattgtcatgcggtggcagcaggtaacatctgcccctttcataaaggggaaatgctaccataaagaacttaggaccttccctaaaaatgtcggatacagaggtaccccaggcatccccttcccccaccttcacaaatctactcctggaatctgagacacaggtcctttgtctgaacaatgtgggaggagtctgtctgcagtactggtgtgctggcaagtgaagaggagaattaactgaaaactgtataaaccgatgaagtttcttaattaccttagtgtccattttttcttcatcctgcacactgaacagttttaaaagacagccagtgtgtcagtgtgtctttccgagagttgaaacgtaccgagagaaatacagttaagataggcggcagtgagttgggctgcttttccaaagctaagtttctcaacagcggaggggcaggggatggcggtgataccgaccatttgaacaccccttccctccccagtgagctctgtctacaggcctccatttctgttcttttctccatctgaacaagttcttgtaagggaggctgaacgcttttagaagacactcggcggcgcaaacttgcaatctcgaagctttccgtacccaacagcgaacccacaactcctcgagcccgaccttttaccacctcactgaggtttctggtgccacgccagcctggtgttccacgaatacagcccaagtaacgtgaacaccaccggactgggtcgcccgagaaacttcacactttttaccaggcaagacgggcggaaaagcgtgggttttcgcaaggtgacccatcttcacatctggtcgaccctcggctcctcccagaccccttcgcggtggacttgggggcctcgccgggttcgccttttccgtcccacgctcctttctctcgtctccccacccacgcccggggccatgcccagctggacctccccacccctgcactcaccctggcggccgacgatctcggcgacgtgctcggagctgggcaccgggacgcactcggtggtgttgacgctctttctccggagcagggccgcctgctccccgttcagggcggccgccgccgccccacaaccgccggggccgtaggcgtgggacagcatcgccgccatcatgccctgggcatcgtcccctccgtacagcacccccgccgccgccgccgcggccgccgcctcccgggcatcgaacctggcggctggcagcagcacagaccccagggacccgcccgggatctgctgggtctgagaggcggtggccgcgggcggcgacagcagcagcagcgacgaccggtcctcctcctctgcttcctccagctcctcctcctccagcaggtctccgtccagctccgcttcctccccctcctcctcgtcctcttccagctccagctcggccgcctccggggccccgggccggccgggcggagcccgctcctctggagacagctccgccgcccgccgggcctggccctgcgccgccgctgccggggcccgaagcgccggggcgccgggctccgccgggctggggtcgtcgaggcctagcgcggccaagcgctccctcagcaggagcccgtccccctcgagctccgggccgcccgagggcggcggcagaggcggcggtggcggcggcggcggcgggggcggctgcggcaggggggccggggccgccgccagggccagggccgcggagctgccgctgggcatcgcggcggcgcgctgtcaatggcggcggcggcggccgggtcaggcgcggcaggcggcgagccccatggcggacagggccagggccctgctcagctcgcaaacacctttcctctggggaggcggcggggctggggacccgggccgaggagcgccagggccgcccggagaccggagagggcggggtggaggggcaggggaaggaggcagaggtaggtaactaggtgggtgggtggggacggcggcggggcgggctggtggaggtggcagcggctcccctctcagtgtttcttttgtttcatggccttaaccagcccccggcgcgcgcggcggcggcggctacgccccacgccgctctccgaat

SEQ ID NO: 1869 - DNA, 76574 bp, Homo sapiens
ttttttctaagaatggattttcctctttatgaaaacaaaatattccttttctttataaaactttataggcaaatttatcaagctggtaaattccataacaggctgaaccaaatgaaatacctaagtaaagcaaattacatgattagaaggctaattatggtattactgcataggtttagtattaatgcatatgttctaagtttattgcaactacactaacttcgtaattttagatttgcagttgcatcctcctaactgcgtctaatggcagaagcaccaccttgtggcaaaagtaggagcttttaaattacagaagttagggcttgttacccagaaaggagaaaacaatataatgggcatccaggacactgcgctatttcttgacctgtagagggattccatcagtgctcaatttataattatttattcaaccatatgacttttctgtatttattgtatttcctacttttaaaagtttgggaaaaaagtcttttacatacctgaattaaaggtcacattcctaaatgcttgaattttctaagcaccacttatattttcaagaatttcctagaacttcgaggaatctttaaccttgtaaatgcactgttgtatttttatgataggaaataaaacaccagaaagacacttattctttggtaagtaacagaagaattccctacagatgtcttcctctgaatgttttcattcctgctctcccaaagcctccaagagcaaatgcagctgctttcaaatcatctgaaagacttctacattcctataccaacaggtctgaaaattgttagaaacaaaaaacaaaactcccctaaaaccaacagattttgcaggatcaatataaaatattaaggatatatagcacatttaactatgtaacaatattcaatcaaaaaaaggtttccctgtcacgttttatttaccatattttcagggcttgatacatagtattcacaaaatgacctgaattagctggagagatttatcaccctctgtaactgctatgtcatcactttccttagcggtgaactgaatcgcatttagtacctcttttcacagccaagagcaatttttttttttttaaggaaaaaaactttattccttttttcctaggaacttgtcaggatactttagtgaccattccctcactataactctcacccagacccacctaactgatgcatgagaagagccactagctgatgtggcccacagctcagactgagccagcatggcttgtgcaggggtaggtagcacagcatcatccagacactgcctcccctggtagcttccattacatcatggacagcactgctcttccctgacttaaccttctgctttgttcaaatactagaaatattagatttcaagttcaataaagatgtgggcagatctgcctaagaatatttcacaggacaatgccttccactgagttaatgttacttgctcaaataacccttatgctcaagttaggtacagaaaaaatatttttaagaaagtcaatagaatgttatattgcaagttttgacttaggcctcttcaaaagtgctatatgaggcagccactaaccaagtgtctgtctcttataatttgacacattccaggtatgactattctaatggtcatgagtatcactgagtcaagtatttgtttctacctatgaagaaatgtcgggccattgtactcccaagatgtataacttgaattttaaagtaaagctgtcgcataaaactagaagaaggaataatctcagggatctttttacagaggattataaagaatgggattatttaacttaaatctgaagatgtctaattcttatttctccccgaaaacaagtaaaaaatagaagcttaacatgggctactaagatttctggaattgcccattcagaaatgtatcacaggaaccaaagttgagataaaatattgttaatgagaaatcctggcattgacattccacattaaatatatttctatactttactgtaaggttcaactgaccactctacctaaaacaaattcttcaatattttcaagatgtagtttaaaacaatttttaacccgtttcctcctagaactaggcacgcatatatgtatgaaagagaagaaaaagcaaaggagaaaggaagagtggggaacgggggggagagggagagagagagagagagagagagagagagaacaccattaaggatacagaataataaaggaaattactaccacttaatgggaacacaatcttttgaaatctttgctacaactggaataaaaaactcagtaattctgaaaggttattctactcttttaaataaaaacatatctgttcaaactattaggtacttctaatcatttagtcttataagaagcattggaaaaaaacatacatagtaacaaacagtgaatttagacataggttcgcataaattgttttactttcagaaaacccagaacctctaggaaattactaaaattatgaagaagttaaattttataagctctttccctcaactttggctaaatgtaaccatattaaaatactgacatagtttttcattatgaaatagaaatgtaaaatggtagctttattttaatctttactcaagagtgatattgaaacaaagctcttactacaacaaccaggttaaaaaaacaaggtgaatcaatgctattgtatgtctgtgaactagaaatttcttacttatggagttatgctcaggaaacaatacttaaaatcttaaactgtaaactcttagcttgtaacattttcatttttcctgtatcttgcatgtttctcagtgccattaaatatattatcttctatttcttcttaaagaactagtgttcataaaaggatcatcatcatcatcctgaaatgagatacaaatgttgtattagtgattgttccctgcttcactgaaacaagacagaagttcttatgggcaaaacaataccagtgagagtcatttcacatgggatagactttatttttctatttcctttataactgcaaaatatattaagtacaattaaattcttaatgagcattaaaatgaaaatttatcctgctgtgtgtgcatgtatctacaatataaaccacacacatttcccttactaaccttaataaagataaatgaagtataggtaagccagaaaaataattcaagtcattttatatttggtttttgaatatattttctcatttacattttattacagttgtatctactcttctggaaattcacagcgaaaaaataatgaagccacatggagatccaactcagaaacagctgtaattttatttcccattaccatttaatactagaaatagctagctactctcacacttatgcaaaaaacaacctagcaaagcaagctttcaaatagttttttggataaaaaaagaaatacatgcagttatttcaagagttcccatgctggccgggcgcggtggctcacgcctgtaatcccagcactttggaaggccgaggcgggtggatcacgaggtcaggagatcgagaccatcctggctagcacggtgaaaccccgtctctactagaaatacaaaaaattggccgggtgtggtggcgggcgcctgtagtcccagctactcgggaggctgaggcaggagaatggcgtgaaactgggaggcagagcttacagtgagctgagatcgtgccactgcactccagcctcggcgacagagcgagagactccatctcaaaaaaaaaaaagagttcccatgctattgggctatagattgtatgcatggtaagaataaataggaatatcagatattaactaataatttaattaaagagaatgaaaacaaacctcagataagcccaattatataattttatgaagataaaaccaattcttacgtattctataaatattcagaaaataaagcaaatttgtttataagttttttatttgtgtttaagacattaaaagaaattaaaagaaattatttgatgctaggctttgttggtggtatcagcacttccaaatgttagctaaattaactatctctgatgagtaatggatgccttaagaaatataaattcattttcatttattgattcattttctgctgctatcaaagacaaaacttaaataaaccagagacaaatccaaatgaagtctaatagataatttgctaatagtttgtctttgcagttaacatgaactagtatacaaatttttaactgtaacatataaccgcatatatatccagatgttttggaataaacaataattgctcacttccctcctggaagcaacatgttagtatttaataggtagaatgagctcttgctgccatttttcttggcagcctgagttgagtcctctcaagctgttttaaaccacagcttaaatacagggaacatggcagcagcagccaaagctaaaaatgaaaggtgtaagtcacaggctacaacgtagataaaccttcaggtacttacgctatgtgaaataagccagtcacaaaaaggcaaatactatatgattctacttctatgaagtacctagagtagttgaattcatagaaagagaaagtggaatggtagttaccaggggatgaagaaggggaaacagagacttgttatttcagggatatagattttcagttttgcaaaatgaaaaagtgctgaagatctgtttaatatggatctatttaacactactgaactgtacacttaataatggttagttttatgttatgcttttgctacaattaacaattttttaaataaaaaaataaatgaaaggggtcatgggcctaagagaaacactttcaagcaaatcaacaaaaactagcaaaggcccttcaaatggcagccttgaaggaaaggggaagggcagtatccttcagtcatgtagttttatttaaacttaattgaaacagcaaattaataaaggcaagaggtaagtcctgacttataactcttcctcttcctcctcctcctcattcatggtggggagatttcatggttgcagacgcgatctggaactggagttttttccagacatcctcccagagaacatttcggacaatgcctgaatacctgtatgtcatgaaatcaccaccatgcgccaccctctacatgacacatgtagagcatatagtgagtacttaataaatattcattaaagtaatattaaaagctcttgggatatcatcatcatcatcatcatttctccaaatataagtaaatggtagaagctaaaaaaaattccgatcccactgttaactgggcaaataagaactgagtgaatatcatattttaaaaatctacaggacttttatatctgaggtattacactgatgggcactcaacatatgttacttgttaactcttaacattaactatagttcaaaggaaggttatcaatgaaactattttttttttttgagatggagtttcgctcgtgttgcccaggctggagtgcaatggtgcaatcttggctcactgcaacctccacttcccaggttcaagcgattctcctgcctcagcctcctgagtaggtgggattacaggcatgtgccaccatgtccggctaattttgtattttcagtagagacggggtttctccatgttggtcaggctggtcatgaactcccgacctcaggtgatccgcctgcctcagccttccaaagtgctgggattacaggcatgagctaccgcgcccagcctgaaactatttttaaaaataatttttagtggaagaaggacaagatggccaactagacagggccaagaagcaccactgccactaataaagaccaaaatatcgagtaagccaacatattttgagcagatctttggagaaaaagcaccaagagctgatagagaggtgatacaaactggaagctgaagagggaggaagctggtaaccttgtgggggttgcccaatgccagggctggttcttggccttgaaaggctcctagaaaggggtgagtgaatggatgatggggcagcacactctcactatggacctcagagatcctagctacaagattccatgccccctggagacgtttcaactggcagggggattggcccaaacagtaggcagagacagagctccagaatacatggagcccaggggttttcatatctaaggcagctgcagcagaaggtggccataggcgcccatcccctaagacttcttatttcccctggagtaggactagccccacctgaatgctggggcaggccagcctggggccagcttccctgtgggacagaggaacatctgttctgcaggccctcctcccctacagccccttccagggcccctgccaagctgccctgcaggaatgtgtgcacagggcagcctctgctgcctagccttgttttttgctggtggttccacctgagtaccttcctggcagcctgggagcatttcagattccccagcacagctggtgcctgaccctgagggtccagacgatggagccacaggctggtcccagtgctacagggctacagcacacagctggggctgtcgagctaagagctggggctggcactcaagtaggggagaaatcccactttcagaacactgaaaggagtgagacacgtgggttcgtgggccagtgcaggaatgggacatgccttcctccacagtgctggtctgggaagggtgtggcctgtctggcagccatggcctctgtctaagggagccctgcaacccaagacaccaaacaacagtaatgcaggtacagtgccagtgataggagggacctcacccatggtccaggagtggcccttatgagtggtcatctctctccccaaccccaccacagagcacggctgtgaacacacagaaatacaaaagaactatgcagctgagtaagagcctatccactggacactaatgttaaatgccagctactggatcacagccaaaattacaacaccaaaataattctgccaatatacatctctgtgacacccagggcaagaatctaggcacagtaaagatctatatagagctgtggccctctgaaagcacccagaaacaaggccagttgactatactcgacttacactgcagttaaaggaacaatagccctctaacatgagaaagaatcagtgcaagaattctggcaattcaaaaagccagaatgtccccttacctccaaatgagcctgctagctcaccaacaatagttcttaaccagattgaagttactgaaagacagacatacaatttagaatctggatggcagggaagctcatcaagattcaggagaaagttaaaacccaatccaatgaatccagtaaaacaattttacaaaggtaaaatagccattttaagaaagaaccatactgaacttctggaattgaaaatttcactacaaggatttcataatacaactgaaagtattaacaacataacagaccaaactgaggaaagaatctcagagcttcaaaaccagttcttcaaatctacttggtcagagaaaaataaaggaaaaagaatgaagaagaatggaaaaaaaaaacctctgagaaatatgagattatgtaaagaggcaaaacctatgactcattggcattcctgagagagaagagagaataagcaatatggaaaacatattcgaggatacagtccagaaaaatttctccaatcgtgctagaaaggttgacatgcaaattaagaaatacagagaattcctatcagacattatataagatgaccatccccaaggcacagtcatgagattcaccaaggtcaacatgaaagaaaagatcttaaaggcagctagacagaagggtcaggtcacttacaaagggaaccccatcaggctaccagcggacatctcggcagaaaccttacaagccagaagagactggggacctattttctgcatccttaaagaaaaaagaaattctaaccaagaatttcatatcccaccaaactaagcttcataagcaaaggagaaataaaatccttctcaggcaagcaaatgctgaggaattcattacaactagatcagccttacaagaggtccttaatagagtgctaaacatggaaacaaaaaaccaccacctactaccacaaaaacacacttaaggacatagcttagagacactataaagcaactacataatcaagtctacaaaacaaccagctaacaatacgatggcaggatcgaaatctcatatatcaatactaactctgaatataaattgtctaaatgtcactacttaaaaggaatacagtggcaagttggataaaaggacaagacctgactgctgtcatcaagagacccatttcacatgtaatgacacacacaggctcaaagtaaagggatggagaaagatctaacatgcaaatgaaaaacaaaaaagggcaggagtcacaattcttttatcagatatagccgattttaaaccaaccaacagtaaaaagggacaaagaaaggtattatataatgataaacggtttgattcaacaggaagacctaactatgccaaatatatacatgcccagattcataaatcaagttctgcttaacctaaaaaaagactcagacagcaacagagtaatagtgggaggcttcaacaccccactgacagtgttagaaagaacatccaggcagaaaactaacaaattcaggacttaaacttgacacttgaccaatcagacctaattgaaagctacaaaatacttcatccagtaactgcaggatacaaattcttcccatctacacacagaacatattctaagatagatcacgtgttcagtcaaagtaagtctaaataaattcaaaaaaatcaaaatcataccaagtatactcttggactacagtgcaataaaaagagatatcaatattaagaagatctctcaaaactacacaaatacatggaacttaaacaatttattcctggataactcctgggtcaataatgaaattaaggcagaaataaaaaaattctttgaaattaataaaaattcattcattaattaatgaaattaatttcattaatgaaaataaaaatagaatcacaacttacaaaatcttagggatgcagctaaaactgttaaaaggaaagcttacagaactaaatgtcttcattaagagaatcaaattaacaatttgttaatttaaatcaaattaacaatttgttaatttaaatcaaattaacaatttaacattgtacctggaggaactagaaataaaagaacaaaccagcccccaaattagcagaagaaaagaaataaattagagaagaactgaacaaaactgagatgcaaaaatccataccaaagatcaatgaaatcaagaattggttctttaaaataataaacaaaattgataggctgctagctagattaacaaaggaaaaagagaagatccaactaagtacaatcagaaatgacaaagatgacattacaattgaccccacagaaatacaaaagatctttagagactactatgaataactattcacacacattagaaaatctagaggaaatggataaatccctctaaacacacaacctcccaagattgaaccaggaagaaagtgaaaacctgaacagaccaataataaattctgaaattaatcagtaataaaaaactgaccaaccaaaaaagccctagactacatggattcacagccatattctatcagacatacaaagaactggtaccaatcctacagaaattattccaaaaaaatcaagggaggctcctccctaactcattctacgaagccagcatcagcctgataccaaaatctggcagagacacaacaaaacaaagaaaacttcagtccaatatccctgatgaacacagatgtaaaaatcctcaagaaactagcaaaccaaatctagcagcacatcaaaaagttaatataccatgatcaagtatgctttattcttgggatacaaggttgattcaacatatgcaaatccataaatgtgactcaccacaaaagcagaattaaaaacaaaaacgatatgatcacttcaacagacacagagaaagcttttgataaaatccaacatcccttcatgataaaaaccctcaacagactaggcactgaaggaatatacctcaaaataataagagccagctatgaaaatccacaaccaacatcatgctgaacaagcaaaagctagaaccattctccctgagaactggaaaaagataagaatgcccactctcaccactcctattcaacatagtactggaagtcctagccagagcaatcaggcaagagaaagaaagaaaagacatccaaacaggaaaagaagtcaaactctctctttgctgacgatatgattctgtacctggaaaaccctaaagaccctgcccaaaggctcctagaactgataaacgacttcagcaaagtttcagaataaaaaaaaaaagtgtacaaaagtcagtagcatttctatacaccaataacgttcaagctgagagtcaaatcaagaacaacacaatcccatttacaatagctacaaagaaaattaaatacatagctatatagctaaccaaggaggtgaaagatctctacaaggagaactatgaaacactgctgaaagaaatcacagataacacaaacgcaaaaacattccatgcttaggaactggaagaatcagtatcattaaaatgaccatactgcccagtgctacctacagattcaacgctatccctatcaaactaccaacgtcatttttcacagaaattagaagaaaactattctaaaattcacatggaaccaaagaagaacccaaatagacaaagcaaccctaagcaaaaagaacaaagccagaagtataacactacccaactttgaactatattataaggctacagtaaccaaaacaatatggtactggtacaaggacagacacacagaccaatggaacagaacagagaactcagaaataaagctgcacatctacagccatctgatctttgacaatgctgacaaaaacaagcaatggagaaaggactccctattcaataaatggtgctaggataaccggctagcaatgtgcagaagaaaatggatccctacctttcaccatatacaaaaattaactcaagatgaattaaagatttaatagtaagacctcatactataataatcctagaagaaaaccaagaaaatacccttctcaacactggccttggcaaataatttttggctaagtccccaaaagcaactgcaagaaaaatacaaatggacaagtaggacctcattaaactaaagagcttctgcacagtaaaactatcaggctgggcacagtggctcacacctgtaatcccagcactttgggaggccgaggcaggtggatcataaggtcaggagtttgagaccagcctggccaacatggtgaaaccctgtctgtactaaagattcaaaaaattagctaggcgtggtgatgcgcacctgtaatcccagctactcgggaggctgaggcaggagaatcgcttgaacccgggaggcggagattgcagtgagctgaggtcacaccattgcactccagcccaggcaacaagagcgaaactccatgtcaaaaaaaaaagagaaaagaaactatcaacagagtaaacaaaaagcctacagaatgggagaaaatattcacaaaatacgtatccaacaaaggtctaatatcaagactctaaaaggaatgtaaataaatcagtaaggaaaaatcaaataactgcatcagaaaatgggcaaaggacatgaacaggcacattacaaagaagaagacacacaaagcagccaacaaacaaaaagtgcttatcatcactaatcatcggagaaatgtaaatcaaaaccacaatgataccatttcataccagtcagaatggctattactaaaaagtcaaaagacaacagatgctagtgaggttgtcagaaaagggaatgcttatacattgttggaatgtaaattcattcagccattataagccatttggaaatttctcaaagaacttaaaacagagctacgatttgacccagcaatcccattactggctatataaccaaaggaaaagaaatcattctaccaaaaagacacatacactcatgtttactgcagcacttactcacagtagcaaagacatggaatcaacttaagtgcccatcaatacggattggataaagaaaatggtggtacatatgtaacatggaacactatgcagccataaaaagaacaaaattatgtcctttgcagctggaggccactatcctaagcaaattaacaggaacagaaaaccaaataccacatgtcctcacttacaagtgggagctaaacactgagttcacatggacatgaagatgggaacaacagacactgtggactactagagagtggaggctgagagtaggatgtgtgttggaaaactgcctactgctcactacctgggtgatgggatctgtaccaaacctcagcatcacgcaattcccatgtaacaaacctgcacatgtactccctgaacataaaagatgaagttatttatcaaagaaaaaaaagttcagcaactagctggcagtctctatttaaattttataaagttaaaaattaattaaaatttaacaatattacttatttacctcacttgattcaaaatcaacccctttcgatacttgactctgggacatgattttgctggatgatgtgctggaccacctgaggcaaaacaaaaacaaaaacaaacacaatgaactacataattcatcaagtgtgcctttctggctaagtttttcaatccagcagctgccacgaatataaataacacacaattcccttaaaatctacattagcggcaataaaacttaactgtaaggaaaaggactctggggccgaggtttgaactctggttttgccctttactacctatgtggctttgagcaagttacttaacctctctgtgcttcaatttcctcatctgtaaaacggggataatggttttataaagactaaatgtgttaatatgcttaaacacttagaacagtgcctgacacatattaagtactacaacaatacttacttatattattatagtacttatcatgtaccaaaatgtatacattaccatcttccacttctgaaaaccatgggaacattgaaatattttctattcaaatctcagttaataagaaaatcataattcctactctttttactcttttttttttttttgagatggagtctcgctctgtcaccaggctggaatgcagtagcaccatctcggctcactgcaacctccacctcccagttcaagcgattctcctgcatcagccccctcagcatgccaccatgcccagctaatttttgtatttttagtagagacggggtttcaccaggttggccaggatggtctctatctcctctatctcttgacctcgtgatccgcccacctcggcctcccaaatgctaggattacaggcgtgagccaccacgcccagccgattcctactcttacaaagcttaacttgcagtaaattcctatgtcttttaattaataagaaatttaagtcactttagatcggggccagtaagcaaatctagcccaccaccaggttttgttttttttatggcctataagctaagaatggttttcacattttgaaatggttacattttaaatggttatacaagtgtctacctacataatatccccggttttgcctcttgacctgccgagcctaaaatactccttatctggcctgttaagaaaaagtctgctgattcccgtcttcaataaaagtagtgtttataaattcttagtctacaattttattaacatgctttgggatgtcattatagcaaaagaaatatgtccaaaggttttatctggaaaaaagaatgagaatcacgagatcttatgtcagaagtaaatagaaaaattcacaggtcctttgcactaaaggaaaggacagaaggatttatcaggcaaacttgaagagcaactaaggttcagaggtagcagattagcacaattatcaaggtccactctggtaagtggcagagcttaaatagtttaaattataaataaaacaccatgcataacctgcaattactaaaacattctgcaaaaacagtctaaattatcatttagatgctgtaattagaaacaccaatctgccaaagctgatttctgatgtgtttccaaaatgtcaattttggaaattgcctctaaaatgttaaacagcctctcaaaacttaaatgattcttattgcttgcacaatggtcagagaagttagttaccataccaagaagcaacaacagagatgagtttggggtcagaatgcctggactgtatgactagttgggtgaccttaggtaagttacttagccactgtgcttcacacttcatctgtaaaatggggatgataaagttataactataatctatctcctggggaagttgtgagcaccacgcaagctaattcacatgtaaaatgctcagagaagtgcctggcacataggaagtaccaaacaactgtgagttatattactatttcatgtctaaagaaatcggcagacatttatacagctgaaaagtaaacaatctactgtgatatcaaaagcaaactattttttctttaatatccttaagcatatatcaaaaatatcagaatagcattttgatccatttctggaaaaaaaaaaacttagaaagctagatctgatttgtgtgtgcttcaatttacaaagacaagaacaaccaaacaaggactcagaaaggggcccttacttccttccaaaacctgaggtatcccgataatcttccaataaatctccttttctgtaagagaatctgagttaggtttctatcagctggaaccaaaggagtcctgttaaatacacataaatgagcctgagaaattcaagtaaaccttcgtgagctaaaataagtccctccactacttaccatagacatataaactgatttgcatctgcgcccatcttggtattttttactcctataaaggccagtacggccttctgcaactctatactctcccggatttttctcatgtctttattgtttttttctactctacccaaaggctgagtaaggttaaaactgcaggctaggaaaacaaacactcttctgctctgccttcttttttgaggtgatcctatccatcccaatggttttaagtaccatctgcacgctgtccagaggtaaatgtaagtaccatttcaaaccccttatctgggacgagcacggtggctcatgcctgtaatcccagcacttgggaggccgaggcgggcggatcacgaggtcaggagatccagaccatcctggctaacacggtgaaaccccatctctactaaaaatacaaaaaattagccgggcatggtggcagggcctgtagtcccagctattcgggaggctgaggcaggagaatggcgtgaacccaggaggcggagcttgcagtgagccgagatcgcgccactgcactccagcctgggagacagagcgagactccgtctcaaaaaacaaaacaaaacaaaacgaaacaaaacaaaacaaaaacccttatctgagttctgaattcacacattcaattgcctataacttcccttcatgtaagtttctaggcatctcaaacttttcacatctaaagtggaacttttaattatatgcctatcattccctacaacacatctgtcctttcttttgtccccttctcaatatatggcacaatgtaaatgctccagcaagaaaccagaaaatcagtcttgattccttattctcccttactccaaatgtttaatccatcttcaagttttgtcatgtctatcttcaaaatatatcctgaaaccatctgtttcctccatttcacctaccaccagcctgtgcaagcctccatcgtctctcttagctcagactacctgcagcaccctcctttcagataagcttgtttacacttgttctgcaaccacagtgatcctttgtaaatgtaaatcacaaggtgccactcctctcttaaaatctttctgtggattcccactgcatttataacaacatccaatacctttgtagtgctcacctgttcctgcagcatgatttaccctgtgtctcttttctattctcatctcaaacaacctccttttccaccacacattagtcattggctcctaaataacattattaaacttgcttcttcaatagactgtgatatggtttggctgtgtccctaccaaatctcatcttgaattgtagctctcgtaactcctaagtattctgggagggacctggtgggagataattgaatcacgggggcagttcccccatactaatctcgtggtagtgaataggtctcacaagatctttcacttggctctttttctcttcttttgtctgctgccatgtgagacatgcctttcaccttctgccatgattatgaggcctccccagctatgtagaaatttgagtccattaaacctctttgttttgtaattgcccagtctcgggtatgtgtttatcagcagtgagaaaatggactaatacaggctgcatgcacttgtccctctgctttttgcaaggccacatttcccttattaaaatttccgcttaaatgtagcttcctcagaggctttccatgaccatccttcaaagtagatgcccgtcctgtgccactgtttcttctctctacaccagatcatttcctttaatgcatgctaactgatcggctgatcaccagctcaaatgtcacctatcttctttgtaaaaccttcaatgacctttcccaggaagatactggcacgtcccttaggtttcattacacctgaagaaaacatttatcttggtggattagcagtgccctgtaattagcataccactaaagtgtaaattccttgaaggaagaaacatttatctttctatccccagaacctagcatgatgtttgaaggatctaataagtgaacgtggaactatacttacacttgctctaacattaacctttaagtcacatacagcttatattctcagtggggtcagtatcataaagaacaaaaattggctccaggggatagagtgggatgaaaaagctacggtttttggccctctcagactcaaccatacccaaaaaaatttcattctttaagtatttaatttctaacgttagggagaaattgacttacatctaagttacttaattcttctccttggataatcaagaaatggctgagataatggaaaaaaagcttgagaaacactgatataaggctttttcctcaatcacccttctttctggagttcctgctcatgcccttattctcagctgggaccaccgttttccaccctactaagccaaatcttatctttgaaacctcaggtcaattttattccctccatgaagctgcttcttctagcccacattccttgttccttttttcaccagcccataagcactcacacttatgggtctgtaatataaaattctacacctaattatgtactaattcattctttgatgaattcaaatatgttcatttctcttttccactataattgaagttacctgaaggcagaggccatattaaaacattcgttatgcccctccctcatcagacctaatataatgctcaaacagaaaataagtacaaaataaggcagttgattactttattaagtagaaattctcattattcgagctttagttaagcagtattcaaccaaaatgttaacgtataaaagcaaatggtaatagtgaatcaagtcaagcttaacagcaataggcaaaaaatcccaaaacacacaggaagagcatgcaagtcctctgaaggcagactgagtctacgtgatccccttttaagtgtttagtacagtaccatgtgtagttaagaatataaaaataagacaatgacaaaaagctgaaatcaaatgatagcaaaatacaaaattattttctgttatttggagagaacacagtcttccattaagaaaagcactgaggccaagcgcactggctcacatctgtaatccaggcactttgggaggtcgaggtgggtggatcgcctgagctcaggagttcaagaccagcttgggcaacatggcaaaaccctgtgtctaccaaaaatacaaaaaattagccacgtgtggtggtgcacgtctgtaatcccaactattcaggaggctgaggtgggagaattgcttgagcccagaaagtggaggttgcagtgagccaagatcgcactactgcactccagtctaggcgacagaatgaggcactgtctcaaaaaataaataaataaataaaaagaaagaaaagcactaataaagtcaaaaggaaaaaaattacaggctatttcaattttcactgaaaatccttgtactaatgctgcatcaactctataaactagcccttggtctgttttcattcctctacatactttactagttgaaaataagtctgttaaacttacatggcatagaaaaatgtgtaactttggaattctggataatttttaatttttttcagatgtttcttttgcagaaaatcactgcacctacctttgatctgtctttgaagtggtaggaaaaatgtcttcttccacatctgattcatctacctcaatcacctggcaaggaaacaaagcaacaaacagtttttgtgagaatagactctgaataaaaatgaaaatgaagaaatgaattacacgattaaatcttaagttatatatgagccacaaaaaaggagacagaaagccataaccattaaaactaacactcagtctgacctccctccaatgtccctcttcattcacaaatgttactttttgctcacctctctcctggccatcccaggagcctgagcacctaagggaacacagttacactggtgaatgacttgcataggctcatatgcagaccttatgactttcctcttagtttcttatgagaggtgagaccatcagtgttccatctccaactttaaatgaggtatcagaccatgtgggaaatactagatatctttctgttaaatctgtccctcttaaataccatttgttagtgttaagacccaataaagatatttctgactgttgattctaccacccaaaatactatttctctacattttgttatcttgacatttgatacatacatttgccatatcttcatctaacttaagtacagatgaggatgaagccaaagaccaaatactgaacgaacagcccctgaggctaaggatgctgttaaatatcctacaatgcataggacaacccttcacaacaaagaattatctagtccaaaatgtcaacagtgctactatggagaaaccctgatgtaaagggaagagtattggctcgggagttaagacacacagttttgaaagtgaagtaataagagaatcaagcccatattggactcttcttggaatcgaaaggaagagcagaaggcccaggctaaacctagggcaaaccacatggatcgctggactccagccttttcattcatcttaagtctagcaacagctgttaaggcacagctagtattttgggaagataagtaacaaaaggaaatccagcatagaaaaaacctctataaccattgaactcaccttcaatattagtattccatgtatgagctcttttggttcaacactgttatccttgaaaacattactgtatacataacatttatggatttctataataaccattatttaaaaaaagagagcaaccaagaaaaaaaaaatcaaatcctagaagccctagagataattggtaaagctccttccagctttaatgttccataatttttcttcttttatttactttgtaaatcagagagttgacaattcataatgcagaaaacataaattattaatacacaaccataaaactttttttcttacctctgaataattcttagtagtgacatttcgggaaggctgctgtcttgtagatttaaaggctagaatgaaaaagatgaaatgtgcattatgttattcttaaaataacttagaaaaacttgcatacttctttagctaaagattttctgagtcctatctgcaaaactgaatgatgcctaattataaaactatttgatatttttaaaaatctaaagggagatagaattataggtacgcataactcaatgcccaactgtcagtctcattatttcccagcttattgagatactgtagtgtttataaatacacacactaaaaatatttcatagaaaaacacctgaaggataaaatctaatcacctaaccaaatgaactacaaatgtattgaaggaaagcctcctaatcccttctttgttgttgacgatacctttatccctgttgctacattaggagccatggggttccagtagtttctcattttcctctaccttagtagccatattcaatatctaagaaatattccagaggagaattctagaaaacagcattctatgataaaaattcctttgtatccataccttttttccttttaaacttggttagatacttgaagtttagctagctctttatctttccctttctttttccttgacatcgaaacctacaataaggccaggcgcagtggctcacgcctgtaatcccagtgctttgggaggctgaggcgggcggatcacttaaggtccagagttcaagacaagcctggccaacatggtgaaaccccaactctactaaaaaatatataaaaattagccaggcatggtggcaggtgcctgtaatcccagctacttgggaggctgaggcaggagaatcgcttgaacccaggaggcagaggttgcagtgagccgagatcgtgccactgtgctccagcctgggcaacagagcgaaactccgtctcaaaaaacaaaacaaaacaaaacaaaacaaaacctacaataaatttcaaacgtctaatttaggtttattttctcctatgccttaccagtttgctaatatcaaaaatatcttccccaagataactcacaaactaaatagggcacagaaaaacaaacaaatactcaaaaaatcctgcaaagtccaaaattctcctagtcagaaaactaacgaatctttctatctaacctaaatttattgtgtttgcacatgtttcctattctaggttctgtccccaaacttgtaatatctaagaggagaaacgagaggcagaaacagtgttcttatctgctttactcagttacttttttcacatcctactctactcaaaaggctagacagagcaactgaataaaaaatccagtgatcatgatgatttcaaagaatatttctgttcagtatttattcactgactcctttaactctgagatcctagaaaacaagatacctttctttttatcccactggaaggcaaaagatgagtgatgttgtgaaataattttatcagaaaactaagcaatatgttctgttaggaagacaataaagtgtggtggttaaaagctctggttttggagttagactcattttgacttactagcttgactatggccaagctccttggcttctttaaaactcaatttcctcgcctgtaaaacagtgttaatacttcatgcagaaaactgctgagagggtaagaggaagtgtctagcagatagaaagcattcaaatacatgtagctgtttgggtagcaaacatagtagcagcagtggtacccatagtggtataaatgaaatgtaaaggccgtgacttcagaggtacttttattcacctagccactatcctctgctgactaacttcaatggaaaaatctgggctgtcaactcctatttacaactcccgtggctacaagtgtaatttttatcttttccaataaaattgcagcacaataataaatttccatactccatggaccttgttataagagaatttgacctttatttatctcttcactcctccatttaaaacagagatctagaagttacagtcttaatttgttgcttctgtcccaaagtgatgacaagtatagttactacttcacaggtattctgtcagagacttaaaaaaaaacccaccaaatccaacctgataaaaatgtttcacaaatttatacttaaaaaatcagttcatttttcaaaaaaaggcctagtactggaggtaatcagttaagttagcgaaaccattatatcaaatcaattagataaaagacaaatttagaccaatgattcacataatattcatcttcataatcttattgcaaaacactaccactaatattaataacagctatcatctgtcgcatttttaccaggtgctgtgatcagtactgtaaatacttaagctcatttaataaaattactctgaagtcagtacaacattgtcaaattttatagctaagggatctgatgcttgtagaataacaccagtttgcacttactgagggcttaatatgcatagacactgcctgatacttcacatgcattttctcattaatcctcaaaataacgcaatgaggtggacgcaatcattgtcccatcctacagatgagaacactcattcctaaagatgaaaaacttaacatatttgctggaggacacacaactagtaaaattgagaagtcaggatccaaaccaagatcttcctcactttagaaccatggtcttcacccttacgctacacaatctccaagtaatttttactcagtcattgtcaagtatttaacaagcatctactatgttatgtgccaaatatagtggatacagtgatgaggaggaatgatgcagacccctttctcacagcacttacagtgcaagggtgctaagccagcagtaaagagctggctgtgactgacccaatggacctgactccagagcctgcattcttaaccatcatgctctgctgcaaaaggtaccataataagatttttgcttacaacataattcaggaaatctgacgtttcgtatttagtttatttacatagcctcttttcatagatgaatactgtttccttaaaaaaattagtcaagccattctgtaaaacttttaaggcatcataactggtctccagtctttctacacaaatagaagctttattctatgttgtcaatgggtaacagtcattgcaggctaggttattcagacaaaatgacctctcattgtcttcaaactcacttctgctgacaacaatccaaattagtacctcaaacatttaaaaaaaaaaaaaaattctcaatggcattgaagagctgatcacataccaaggaattaccaggccaaaactgaagaaaagctagaactcagagaggtaagcagagtcctttccctgagttcacttttcaattgggaaaatgttaacattggttttgagaatcctgaagaaaaatagagagggctaccacagcccacggctgcccaaagtgaaaaccccgatgcatttcccttcctaaggtggagccccagtggttgaagagagaagcagaggtaaacaggatttcataagcatgtaactgagtaccctcatttttctaagaggtagttcattactttttctctctcttcttttctcctttcccccactttctacttagttctttagaaatgcaactatagtcttttacttcctcttcatcagagactccctaaaaggggagttcatctaactatgtgcttggaagctccagagttgaactatcacccaccagggggttgcctctagagataacagtcaattcacaatccaaagtcctgctatgaaactctcgccaacctagagagtattcggccacctttatagcctatttctacccatgaagatgccaattcaactgcctggtagataagacaccaaactagaatgcaaaccccccacttgctcgcttcctcccctgcatgccactcctgataggtcccctttaaaagagtccactttctgctgcaaagggggaagcagtacccttaaggtaggaagcctgtatttcttcccctaagttcgctttggaataaaaagtcactttctttataccacaccttgctcttgttaattggactttgcaagcagcaagtgactgaacctgcattttagttacaagtacgtatcaaatgactggtccaagaaaccctcaaatttagcttaaagtggtctatgacttgtggtgccctacaaacctagagaaacaaacgtgaatcttctctgaaggaagatggcttcatccaaggtctcaaattattcctgttgataattttctagggacagtaagtaacaaagcatggaaggaaataagtcaccataaataagaacccacagaaacagacaacagaaagaggccaaagacattcagacactaggttattagatacaaaataaaagaagtccttactgtgtacacacgaaaaattaaaacaggcctaaaaatatcttcagaaaacttctaaaaactattaaaagtgacagagcatattttaaaggaagcaaataggctgggcaaggtggctcatgcctgtaatcccagcactttgggaggccgaggcaggaggatcacatgaagccaggagtttaagaccagactagccaacacagtaaaaccgtgtctctactaaaaatacaaaaattagccaggtgtggtagtgcacatctgtaatcccagcgactcgggaggctaagacaggaaaattgtttgaaccccgggaggcagaggttgcagtgagccaagatgatgccactgcattccagcctaggcgacagagagagactctgtctcaaaaaaaaaaaaaaaaaaaaaaagtgatcagaaataattattcagaatgtagcacagaaagagaaaacagaaaatacaagagtcatgtgaggagagagtaaagaggtcttatcattatttaactgaagactcagaaggagaataagaatagcatagaggtaacatctgaagggataatagctaaggattttctagaagtgacggaagatagcagttcagagattcatgaagcccaataattgctaagcaggctaaacaagagtaccatctttagattcatcacagtgaaactgcagaacaccaaaaacagcaagctgagagaaaaacaggttattttttaaaaaacaaaaaccaacaagcttaactgatatctgatttcttaattacagtggaaactcaaagacgactcattttaagtgatgaattctacccactggagtcaaggaaagcttaacataaaacaagccaggacactggattccacaggacacaaaaacacaaaaacaaaaaagaaaaataaaacaagacaggacaaaaaaagacgatttgggctaaggtaaaggtgggtaatctacatctatgactctgtcgattgcatgctaaccaattttggtggtttaacatggaagtgttcattattttattcactctttttctatgttcctgttttctcatttttaaaagaacacttgataaatgcctactgtgccaggctttttgatcatttaatcttcagaataacccaatacaatagagattattatttccaatcatatctaaacaaactaggagagtgactgatttgtctcaagtcacaaagctgtcatttgttgaatgcaaggttgaactcagcatgaatcctttacaattttccaggctgccttttctctctttcttcctctctgcttttatattaaacctaccaagaatggaacagcatctttccagataccactccctaaatggcaataaagacaacatgtttgtgaagcaaaaagctaaggatcttagctagctcttctgaagtactaaataatacttgagtaaaaatatagcaatggaattttttgtaaggtttaagagtcatttaatcaacctgattttgtatcttttcttcaatgtcagctgtcatttgataaatgttgaaaattcctttaatggagtgatacttacttccaaggcaaattagtccatctttatattaattacataggttattctgcataatgcaaaaattattctatggagaactagtagctaggtctctaatcttaccttgctctggaaactagtacagtggtcaactactggttgtagagtgcagagaatgtgagatcattcccagatctggtactgacaagttatgagatctaggataagctacctatctttttaaagcctgtttccttttctgtaaaacagaaataatatagtaagtacctaccccacagacctgttaagaggcatgcagtttcataaatattagctattattgctactattagtggttttatcaactcagggcaaaactgcttggcttagttccctcacatataaaacaggggaacaaagttgttcttaaatcttccaggtccattctatcagatgagaaacttaaatcagtatgtttctagctattcccatccatccccattgggccaggagttcttaagctggaaaacacgaatgcgcctcatgggagtggctgaaccctttgaaattgggtgcaattgcatgtgagtacttatttaaggagagaagacatagctttcatcagatttttagagaatccataagccaaaatagattaaaaagcattgcctttgggactaaacagatcaaatctattcattccacattttacacgatagaacataatctacataaagatctgaatgtttcccaggttagatatcctaaatcctaagttccttcaaccaatttttttttttttttttttttggagacgctccgtcacccagttcagtggcatgatctcggctcactgcaacctccaccttctcggttcaagtattctcctgcctcagcctcccaagtagctgggactacaggtgcacgccgccctgcctggataattttttgtattttcagtaggggacagggtttcaccttgttgcccagactggtttcgatctcctgagctcaggcaatccgcccgcctcagcctcccaaagtggtaggattataggcatgagccactgcgcctggccaaccattttttatattatttggtatctcttctgaatgatcatatatagttgacagtctccttgaaatataattccaaagaggagtacagtatccttggcatgttatggccaatttagtacacagagagaacttccttgctgtgcaagcttgtccaacccacctcattttgttattgtttttgttctgttttcgttctgttttcttttgttttaggcttttagcagctgaagccatggtttttagtttctgtcgctagtgatatgaggaaaagaaggatgagaaaagggctttactggcccaaccagaaacagaaactaagaatccatgactgtattctctcccttggacacctctgcaagactcattaaatgctgtttaaaatatcaatagatttggacagttgggtatgcctgcataactcttactgacctaagtctttttcacctgggttgctgttaaactcacatacctctcacaactctacttgtgcagctgtccttttggacataaatgtggtttatattacccttgataaacttcatcttctgagaattagttcagctccccagtgtgtcaacaattaatcctagctataagattataaatattacaattataatatttaaaaaatatttataattataaaagtgaaacaataacctcaaataactgataatataaataatatacatatgaatatattctaaatgctaggtagaaaaaagtatcaccacctatcttaatgcatactttttgtaaatatgactaacattttaggctgatctcatcatctataatattaaaaatagttaaacagatccccttgaggccaatttttagaccataggatatacacaaattaattccaagggcctagccataatttctcttaaatataggtcacatgacttctctatatggaaagcagagactgacagggcagtatgggggaagcaaggaaacagtagagacagttcctctctctttcgaccactgtccatatagtgaccaactacttcactttcctgtttccagggtctctctgccaaacagaaacagcatttgtctgaaagtaagaaattataaaacataatttttgttttgttttgttttgtttttgagacggagtctctctctgttgctagggtagagtccaatggcatgatcttggctcactgcaacctccagttcctgggttcaagtgattctcctgcctcagcctcccaagtagctgggactacaggcatgtgccaccacgcctggctgatttttgtatttttagtagagaccgggtttcaccatgttggccaggctggtctcgatctcctgacctcgtgatctgcctgtctcggcctcccaaagtgctgggattacaggtgtgatccactgtgcctggcctataaaacatgattttaaaagcttaccctcttcagtaactctaatgcatagcaaagatcttttaaaaaataatttatcctgtgatcctaattgcccttataacttcccaatgattgcaacacaaataagggctaccaatggtgattaccttggtctttctaatgttggaatttataaataatcacttgcagtctatactcaccatctataatagacatatttctagatgctgacacagcagtctttgagttcctgctacgggtagaagtctccagaccagtgtctgctgttagaaaaatgaacagtcaatgtacaagcctatcagcagctaaggtttatttcatacaacactaaaaaatgaaagctaaataaacttatgtcaaatagtttgtctgtaaaaagccagacatatatataagaacaaacatctagagtctgaccaattttcagagactattcttttaggccacacttcagtttatccaatttaatttatccaattaaaatgtaaggaaataggctggacgtggtagctcacgcctgtaatcccagcactttgggagacagaggcgggaggatcacttgaggtcaagagttcaagactagcctggccaacatggtgaaaccccacctctactaaaaatacaaaaattaactggcatgatgatgggcccctgtaatcccagctacctgggaggctgaggcaggagaattgcttgaacctgggaggcggaagttgcagtgagctgaaatcgcaccattgcactccagcctgggcaacagagcaaagacaagactccatctcaagaaaaattaaaaaacaaaaataaaaatttttaaggaaaaattttgtaaatgtaagaatagtgaaaataatcatcattaaaagatgaggatttctctccctggagattttaaaccaaattaatattcatttcaccagcttaaaattcctatggatgcatatttaataaaaacaattttaaaaaatctttagagatgaactgacataatgtgtgagaaagtcactgagtgaccaatttctattggcgtgaactattcaatgacaatagtctcacagtaaatacaatgttgactatgttaatgactagttttaggaatcaaattggggggcagttttctttcttaaactgactttataaagactacttgataagcatatgtgtatttgtatcttatgacagtaacaaaaataataattgtatgatctggagttttcctcctgttgccaaaggcttttagctattttctttaacaactcatatttgcctattactttgcacatgtgaaaatacatatgacattaaatgtatccaaaaggtactacgtgacaaacacagtgaagcttttataaggtatgtgctaagaacaattaaaaccctaagtgcatgtggccattcaaaatttatttaagtaaaaggcacatgtcagaactgccttaaagactgtctttatatattataaaaatagatttttaaagaaccgtgttttagaaataaaacttataattcaactctgacaagatctaattctgtattttccactcaactgccaagtgtgaatgtgcacaggactgaactcagtgctcacctcttcctctttgagaccctcctctcgatgctgaattctgccctcttccacctcttcgacctcttcctcggcctcttcctttgttggttgctgctgagatgctatcatcagagtcattagccatctgttctgctaaatctatactcataaggtcatcagcactaaaggcagaagcagactcctctgactgagatctgagtgctctggccctggtcatagcctaagagggagaagaaggagaaagtacacacaatgagataacgtaccatcctaaaaatcattaatttaggcattgacatgaactaatcatactataaaaacataaaggaggctgacacagtggctcacgcctgtaatctcagcactttgggaggccgaggcgggaggatcacttgcacccaagagtttgagacaagcctgggcaacacagcgaaaccccgtctctacaaaaaaaaaaaaaaaaaaaaaaaattaggcatggtggcatgcacctgtagtcccgagctacacaggaggctgaggcaggaggatcacttgagcctaggagatacaggctgcagtgagctatgatcacaccactgcactccagcctgggtgacaaagagagaccctgtctcaaaaataaaaataaaaacaaaaaatatttatatatgtgtaaaggagaacctccccaccaatcaaatttaatacttattatctgtcagaccaatctaccatactacctataaaatgagaccctttgaaaaggtttaccaagaaaaataaaattttacagaatcaaaattttcagaactagaaggaatactggcaatcatccctaattcaatgccacatttgacagtaacagactgtcatcatttgagctactttttagaatcggctcctaggaaataataagaaaaaaacttacaaaaaatagccgttatctctgggcactaatattttagggtgcttttgttttttgttcttgaatattacatattttctatattacactttttctaaaaaattagttttataatcagaaaaaaacatgagtaacaatctctcacaaatatatggtaaagagaattaagggctgggcgcagtggctcacacctgtaatcccagcactttgggaggcctaggtggatggactgcttgagatcaggagttagggaccagcctgggcaacatggcgagaccctgcctccaccaaaaatacaaaaaaaaaacacaaaagaacaaaattagccaggtgtgatggcatgcacctgtagtcccagctacttgagaggctgaggtaggaggatcgctcaagcctgggggaagcagtggggaggggagttgttgcagtgagctgagattgcaccactgcacttcagcctaggtgacacagtgagaccttgcctaaaaaaaaaatgaaaagaaacggaagaattaaggagaatatatcaactgaaagcctaagcctaagaaggaataaacaccttaggaccaagaacatgccacgcatttttaatttggtaagaatccatttagaaaagacatcgtgccactgcactccagcctggcaacagagcgagaccctgtcaccaaaaaataaaataaaatataaataaaagcaattttgccttgatcttcccttaaaccaatcaaaaggtagtaagagaacaaaaacaaaatacattttccataaaattaaaaaatagttccaaacccccaaacacacaaactataaagaagagttaatgaatatgataaatatttgacctagctaagggagaaaggtgagaagagtttcaggtattatacagctctccaaaactgatgtataaatcccaagaagacatgataacagtctctcttgcttggaatggcagttctgggtctaagaatagctgaccagaacatttctaagctctgtgataccataaagtaaggagacccagggctaaatgaggagatgtgaacaaggcaggcagcataaagtgggactgaagtggcaacttcatgatgagatgatctcagctgaggtgaaatcacagctaactcactgcatgcagggttcaatacagcattacaatgcaaaaagaaaacacttcaggaaatacaacaaaaaatataagaaacaacagtgatttcaattcatctttcctgtcccacatgaaatacagttaatcctcattattcattaatcctatatttgcaaattcaccgacttgccaaaatttctctgtaaccctaaaaatcaacactcacgatacttttggcatcatttatggagacgcagagtggtaaatattttgaattgcctgacacacatattcccagctgaggctgaacaatgagccactctgccttcttgtttccacttgtgtactttaaagtgtcctttctgtgatagtcatgcattgcttaatgatggatgcctcatgagaaatgtgtcatcaggtgatttcattattgtgcaaacatcatagtgtgtacttacacaaagctaaatggtacagtctactacaaacccagactataggagatagcctattgctccttggctacaaacctgtacaacatgttactgtactgaatactgcaggcaattataacaccatagctatgtatttgggtatctaagcatatcttaatagaaaagatatagtaaaaatatggtattataatctcatgggaccaccactggatatgcagtctgacatcgatcaaaatgttgtatgtggcacatgactacatatttattgcattttctgcatttttgtacttttgctttggtaatgtggtgttttcaaatgaccccctcaacatgtttagtgttcattcctacatgcaaaaaggctgcaatatgacttttggagaaaaaatgtatattagataaacttaattcaagtataagttaaagtgctactggctatgagttcaatgctaatgaatcaaatgttaaatacagtatctttaaacagaaacacattaaaaagattacgtattgatcagctgacaaaaacgttatcagtggctcatagaaagctaattttgtatttcccctaggagcaatgattcaccatttgctaattctgtgctggaagtgattttatacgacataactaccacaaataaaaggaaccagctgtatgcttttagaaagcagacttaagagaaaaaagatgatctaaatcacataattaataagatagatctaattgataaatgttgaattctatacactgaaaattaataatatacttcaagaccccatgaaactttttagctgatacataacagggtgcaaacaaaaatctcaatacatttttgataggagaaataaatttatcacactgtctaatcatcatgcaataaaataaaaaattaataataaagcaaaaacctgcctcctgaaaacaaaccagagtcaaaactataaaacaaaacgaaagttgcagaacatctagaaaatcataacaagaatactgaacatcacaacatatgagagagctaaagcaatgcttataagaaagcctatagcctgctaagaataaatgtaaataagttaattctgtatccaaaaagctaggagaaacaaaataaagcctatccaagtattagaatgaagatgaaaccatatattaatagattttaaacaaaaacacattagaatgaataaatataagcactggtcctttgggacaaaacaataacattaataaaaatcacaaagctttaaagaaaggaagaaaacacaaatatacatcattagaaataagagggacgggcgtagaggctcacatctctaatactagcactacaggtgtagaagctcacatctatactttgggaggccaagtcaggaagatcacttgagccctggagttagagaccagcctgggcaacataacgagactccgtctatataaaaaaaaaaattaaaaattagctgggagtggtagcacactacagagcaagaccctgtctcgaaaaaaagaaagaaggaagaatgggagggaagacccaagacttatgagagaatgctcaattctaaataatctggaaaatgaataacttaatctgatccaaggtgggaaaaaaacaggttcaacaaaccaattatcaaagaaaattttgagaaaattattaaaagaaaaatactcccaaaaaaggaccacaatcagaaagtttcgtaggtaaattctaccaaactttcaaaaaacagataagcccactgctatttcaatagtgccagagcatacagaaagacagcttccaaactgttttcacaatgccagtatgacacagtactgacaaagaactgcgtgcacaaaaagaaaattacagaatcttatttataattatgaaagcaaatagagactccagaagcttatggaaagaccaatatatccattaccagggggtaatggatatattaccaggatgggtcaataagctatgtacataataatataactcactatattaatggaacaaagaaagaaaaaacccaaatgtatatcttcataaaatcagaaccatgtaatcaccaatcattcctgatttaaacaaataagctgatgaataagtggatactttatgtgtcaaaaaaccctaaatatgctatattactatgtgtatatatccagagagagaaagagagggcacacacacacaaatgtgttcaagtgagtgctcttacaaatcaattagagaaagaccaatacccggccaggcgcggttgctcatgcctgtcatcccagcactttgggaggccgaggcgggtggatcacctaaggtaaggagtttgagaccagcctgaccaccatggtgaaaccctgtctctactaaaaatacaaaaattagctgggcatggtagcgcgcgctagctactcgggaggctgaagcacgagaatcacctgaacccaggaggcagaggttgcagtgagctgagatcacaccactgcactccagcctgggtgacagagtgagactttgcctcaaaaaaaaaaaaaaaaaagagaaagaccaataccctactcgaaagagaaaatgtggccaaacaaaatgaccatgtgtttcatataaatacaaatgatttataaacataaaaattaggcagactcattagtaaaaaaaagtagtatgaactgaaaacaacagtaggaaataatttcttaccccttagacttgtaaagatcaaaagatacagtaatacatcacgatggtaaagatgtgaggaaacaagcactcccaaatactaatggtgagaatataaactagttaagacatctttggactaatgtggcagtatgtagcaaaatttaaaataaatatgccctattatgattacttcttggaatcaattactaaccatcatttctaaactttgtattttccctttgtctaaatactgtatcttcatttttatcatctcaaattgtatattcaaattgtattttaactctacctttcctatgaaaaacagagtttactgttatctttggaatgtattacttctaagagcttaactcatgagtgcaggtctagagccaatggcaaaaatgtttccatatacattttgtgagatttgaaaacatactatcctactgttaaacactttttttttgtggtgaaatatacataacataaacttactctttttaccacttttaggtatagtagagtgacattatgtacattcacatggttatgcaatcatccccccatccatctatagaactttctcatcatcccaaactgaaactccatacctattcaacagtaacttcacattcctccctctccccagtaaccactattctaccttctgtttctatgaatctgattactctaggtacctcatataagtagagtcatataatatttgtccttttgcaactgtttttttttcactcataatgttttcagagtttcatccatattgtagcatgtatcagaatgtcattccttttcaagactgaataatattccattacatgcacataccacattttgtttatccatctatctgttgatgaccaactgggttgtttccacttttcggctattgtgaatcatgctgctacgaacactgatgtacaaataagttcctgctttcaattcttttggttatgtacctagaagtgaaattgctatattacatgataattctatgtttaactactttaggaactgctatcgttttcctcagtagctgacccatttttcatccccaccaccaatgtatatggttctaatttctccacattcttgccgaaacttgttattttatggtgttttaataacagccatcctaatgggtgtgaagtggtatctcactgtggttttgatttgcatttctctaatgtctggtgatcttgagtgtcttttcatgtgctataatttgtaaagcttctttggagaaatgtctattcaagtcctttgcccattgtaaaaattgggtttttttgttattgttactgttgagctttagaagttttaaaaatatattctgcttattaatcccttatcagatgtatgatttgcaaatattttctctcattctgtgggtcacttcttcactattgatagtgcctggtattatattttgaaagagggtatcaacccacctcaaattgaggtagaacataagaaatcagaggccaggtaaactaacgactgtgggtaagactaagaatagtttttatatttttaaagggccattaataaaaaaacaaacaaacaaaaaaacacaagaatatgtgatagagaccacacatgtcccgcaaagcctaatggttactgtttgctcttttattcaaatatgaatttatcattaaagaaaagatttgagagtttttctatgtgaacaaaagattttttttttttttttttgagacagggtcttgctctgtcatccaggttggagtgcagtggcgtcatctcggctcattgcaacctctgcctcctgggctcaagcgatcctcccagttaagtctcctgagtagctgggactacaggtgggagctaccatgcctggctaatttttgtattttttgtagagatggggttttgccatgttgcccaggctggtctcaaactcctgagctcaagagatccacctgcctcggcctcccaaagtgctgaaattacaggtaagtcacaatgcccagcctgaaagactttaaagcatactgttttttctccaaatagaagagctaatagtcttgtttgtcagtataagtaatttaagcatggcgctgggattcatattctaagccaaatgattctgcaaagctgtgaattacagcttggcagagtttcagactccattacctaagttctaaatagtatgctgaaaatgaaaaaatatataatatcttatgatatgctgaaaaattacctaggaagccccaattacattttagtcttaaaatatagctgaatatctgaacttgtaagttatttcttctgtaaaactcccatatgaaatttgtcacagcctctcccaccttccttgtataagacgttcactcttaactcttttaaaagcttaatgaaaaattgaggtttgtcgcttcaaacatgaagaactcactcaaacgtaaagaaatatttctgtaccctgttaaattgaaagggttaatcaattttaagctagatatttaagaatcaggaatcatttcttcctagcattattcttgcaatttggcaaactatttctattttaaatgcaccttataagataaatagaaatataataaacgtgttaagccatttctaatctatagcttcttttccttagcttccaaaaaacaacctgtaaaagatacagtggttgcaactatgtgtatttcaacagtgattctgatgtgttgcatgacacttttagaagtttttcatttttagaaaaccatccatttgcaatgcaccgaattaatattataataatctaaaattttgataggacacaggatgatagaaaagtctacacttggagtcagaaatatgttcaaattctagcgccactccatgaccttgagtctggtctgtctcctcatttataaaatgggcacctaggaaaaataattcaataaatatcttccttacacaaatgtctcttatctactaaattgagaaaatcttgtggctacagacctcagcttttttatatgtacagtcctaatataaagcagaatatctaacccataacagggacaatataaaatgtttgctgaatgaaagcaatcaagacaaaactaacagtacatagtttataacttttaaatactagatagcaatcataaaacactaagggcaatcagaaaataagaaaatacatttcaatcataaattcaacaagtaccaggtagaggccccaaatttaagtaaatggttgctaacttgtagattcaaacctgcaatgagactgagaagacagtgatgatggtgcttaagctaattttaatattttagaatagataatagaaattgtctatttgcccatgcttgcttacttatggttaacattgctaaccaaaacactttaagtttcttttttgcccaaaataatatcagctcagtaagataagattttatctataagatgctctgctaacaaagagatattattttgagtaataggggcttttgttgtatatatccccacacacatacaattaaatgggttttatttatttttatttatttattttagagacagggtctcactctgttgcccaggctagagtgtggtggtgcagccatagttcactgcagccttgaactcctgggctcacgcaatcccctccaaccttagcctctcaagtagccaagactacaggtgtgagtcactgcacttgctaaacaggttttagacaagaacaaaatggaaaaaaagagcaatgagcagaatatttgtaggctgaactgaaatcaaccaaaagcagccatcctaagccaaccccagctcactcctatcccctagacctatggactgactattctaactaaacctactggttattctagtttaagaaagtgatatataaacacaagaatttgcagcagaataattacctcacggacttcatcatcttcttcattagtatttttttgtctggtttctctgaaacgacgtacctagatcataacagagtaaatcacaaacatgttgcctattccagttatgtaaatataaaacaaggggctacaattaagaaatgctttatgttataaaacttgcaaatttaacaatgtctcacaaaagtaaatcatatttttccaattattaacgttaaaattgcacaatgtactcttaaaaaaaaaaactcatattgacccgaagcaaaattatattacctgctgccaaaatgtttcacatcactgaaaaagtctttcagactgtacaggaaaaattctaataccctatgggtattacacttcagtaaactagttaaaaacaaaaatatctccttgacaaggcttgaaatatttattacattgcaaatcactcttgtgcaccttgctgcaagacatccaggaggctctgtgaaatgggatctgaagtgggtggcccctgaagatccatttttattaagagtcaactcatgaaggtttgctgagcatggtcctggtatcaagaaggagactacaggtttcttttttaatggttcctgctcacaaggctcttattatacagctatgtatatgttctttaagcccatttatttaataatctactcagcacatatttactgagcaccttcaatgtgccatatattatcgtagaaactgagaatacagttattaacaaaacagacaaaaagctgctctcatggaatctataatcaattgatgatatgggagagggaacagcaaataagactccaatgtaagaggctggagcaattagaggaatcaacaaaagacactgaaaatatgcagccagtgaggcaggaagataacaagagtctggtatcctgaaatccaataaaaaacatgtttcaaagaaggtcaagtgagatgtaagatagaaaactgacagtggatttagcaatggcagtcactggtgatcttgacaagtgcagcttcactagaatgatgggatcaggagcctgagtggatagatttaatagaaaatggagagagaagaatgagtcagcaaatacagaaaactctttgaagcgattctgctctagaagaggaacagagagcagtagctaaaggaaaatgggatcgagagttttgtttgtttcttaagctgaaagaaataacagcatgtttgttatgattcagtagaggaaaaatacaagaataacaatattttaaaagatgagacagtatgtaatcgtgccctaggtgataagtagcataccaaaggtgctaagccattcacagaagagaaatgagagtcagagtgggaacactgaacaggcactatgtgtcagacagtattctaaggattttacatggattaattcttctaatccttacaacaaccttgaaggagggcctattatcatcaccattttatcctcagatgaggatactgagggataggtgggtttagataactcaatgatgggtacacagctaataagggttttgattttgaacacgggtgtctggtcagagccaccatgactcacacacactctttctctttctctctctccctctctctctctctcacacacacacacacacacacacacaccccacacagactttgctgctcaggagtcatgatgtcactccaggtggggatggttatgttttatttctggtatgtacctgagaaatctatttatgctataaattagcaaacccaacacatccagagtcatagagtgaatggttttagagggtgaactgcctgtcctacctctggaagtacttggtattaaataatattagttacacattgacaccataaggctttaagagaaccatgttaaccaaaagcactaaaataagggaatgagttttttttttttttttaaataacattgttttgttcttctgcttagggagaatctgggaaatagagaaagtgatcccctgtaatataactaccttgacataactgttgataatatatctgggatattttctttatttacataaacatacacaattacatataaaataaaaataattgagattatactacgcagttttttatctttgaaatctttcccaattaacattagattagaaatatcttctcatgttcttcttccaaaatgtcatttttaagctgtgtaaaattttatatggtatatgtaccaacatttattgtatcaaaacatttccaattattccccactatgaacaacactaagatgaatcactccatacacaaatctctacctcactattttcatagggaaatttcccaggctgagttaaagggtaaatcttaagcctcttaatatactctgccaaactgcttttcagtaaagctattcaaacgtaatactactaccagcagtgtgctagatactatttttctcaaattgctgccaatttgacaaacaaaagatgtatttgagtttctttgattatcctaggctaaacaccattttcatatgcttattagctatttatatttcttttatgaaccacctattcatgtcctttgttcattattctatcaaatgtttaattatttttaagatttctaagagctcattaatattaagaatattaaacttttttctgcccacatacaaatattttcatgtcaatatcttttaattttgttttttgacaatgtgatatgcaaacatttataatttctatgtagtcaagtctagacagcttttcctgtaatttttccactgcttcttgcttagcagaaattttctaaatgaaattcaagatctcaatcaaaacttactaaaaaaattaaaatgaacaaaaattaccatcctacaaggttcactttaaagccctttcaaaggatctttaagagaagatactatccatggggaacaaaacactttagtaccaaccatatgcaagactctgttctaggcattttctacattttctaatttaaccttcattttatcatttcaattttatagatgagaaaaactaaacaaatcagagaggttaaatagtgatttaccagaaaaaaatctcagagctactcttaaagacagactatttaaatagacctagacactcaaattagttacttacctcctcatcgattttgtcttcgagggcatcaatatgacgttctttaagaaatcgctgtgttttttccaactggtatttcactaattcctcaatggcatctttctcctccttgtccacaaattcttgtactgcttcacccatccctctttctgttagcagtgagagctgcacattctgtaagatacaaatcactggatgcagaaatagtttttattccttacaaaataattatagatgagcaaggaaaattaccaaatatgttaccagagaaaaaatatagtgaacagctgtagttaagcctactaatatcaggaaccagaaaaagcaaagtcaaaaccagaaatgggggaggagtacaggacacgtgaaatgtagaggcctgatggctaggatatggagtccaaaaatggcagctatgattaatagagatgaaattaaccagtgtcataggcaaaataagagccccctaaagatgtccacgtcttaaactctgggacctgtgaatacatggcaaagaggaacaaaggttgctaatcagctgtctgtaaaatagggagagtatcagagactatccaggtgggcccagtgtaatcataagggtcctgaaaagcacaagagggaggcagatgggagctggaaggaaaaataactctggggaaatggttagagagatacaacattgcaggatttgaagataaaaggagagcaagagccaaggaacatagtaggcacctctagaagctggaaaaggtaagaaaatggattctcccttagagcctccaaaaaggaagacagccatgccaaaaccttgattccagtcctgtgtacgatttctgacctacacgactgtaagataataaatttgtgttgttttaaaccactaagtttgtggaaatttgtttcagcacccataggaaactaatacaaccggaggatcttagagtggcatatacttatgacgtaagtttcagtggcttcaccatcatttggctgtctttgtttgtagaataattctgaaattacatccaaatgtgagaaaactaaatctggattgagatctttgtaacagagatacaaataaagtaagaaaataacaacaacaataacagttatgttaataatggtattcacaattaacattaattaaacactaattttctttgatgtgcagcaactacaaatgaatgtaaatgtcaccctagttacttctaagtttcacttaagaatgtccctgatttaagttaaaattattcagtttaataattgcaacagagatacaaagaaagagaataacaacatcaacaataacagctatattaataacagtactaataactaacattaattaaacactaattttccctgctgtgcagcaactgcaaatgaatgtaattaattgtcaccctacttacttcatagaaacattttgaggattcattttgtttaaactatcaactaaacatatcctaaattaaaatctgttactataaggtagccattattcaaaatgtgaactgtaagaaattaccttctctgcggtttgaaagtactgttttacaagatcttctacccttaaagttgttccttctgaaggctttgtgataagtttcccaaagttgatctcttctcctagaaaaaaagaagtatatcaaaaaatagcttctatcataatgttaaaatgtgcatactcattgcaagttgtcagtggagaaggtaaggccaaactttagcaactgccagcttgctcaacatggtaaattttgaggcaaaacaagccatttttgttaatagccacggtcttttccccacagtcagtatttctcgttcatacctccaggataggtgtcttgtagctgttctcactgggtgaagcacagacttctggaggtcctcaagacccattcagggagtaataacgtcaaaaatactttcataataatcctaagatgttatttgccattttgccatctgccatcattgctacactgacgatgcaaaagcaatcatgggtactgctggtgccttgtgacgtcaaggtagttcggtattgatggaacatatctcaaaataataagagctatttatgacaaacccacaaccaatatcatactgaatggacaaaaactggaagcattccctttgaaaactggcacaagacagggatgccctctctcatcactcctattcaacacagtgttggaagttccggccagggcaatcaggcaggagaaataaagggtattcaattaggaaaagaggaagtcaaattgtccctgtttgcagatgacatgattgtatatttagaaaaccccatcgtctcagcccaaaatctccttaagctgataagcaacttcagcaaagtctcaggatacaaaatcaatgtgcagaccaggcgcggtggctcacgcctgtaatcccagcactttgagaggccgaggtgggcggatcacaaggtcaggagatcgagaccaacctggataatacggtgaaaccccgtctctactaaaaatacaaaaattagcaggggcgtggtgacaggtgcctgtagtcccagcgactcgggaggctgaggcaggagaatggcgtgaacctgggaggcggagcttacagtgagctgagatcacgccactgcactccagcctgggtaacagatcatgactctgtctcaaaaaaatgaaaataaaaacaaaatcaatgtgcaaaaatcacagcattcctacaccaataacagacaaacagagagccaaatcatgagtgaactcccattcacaattgcttcaaagagaataaaatacctaggaatccaatttacaaggatatgaaggtcctcttcaaggagaactacaaaccactgctcaacgaaataaaagaggacacaaacaaatggcagaacgttccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaacagagcccacattgccaagacaatcctaagcaaaaagatcaaagctcgaggcatcaccctacctgacttcaaactgcacaacaaggctacagtaaccaaaacagcatggtgctggttccaaaataagagatatagaccaacggaacagaacagaggcctcagaaataacaatgcacatctacaaccatctgatctttgacaaacctgacaaaaacaagcaatggggaaaggattccctatttagtaaatggtgctgggaaaactggctagccatatgtagaaagctgaaactggatcccttccttacacctcacacaaaaattaattcaagatggattaaagacttaaatgttacacctaaaaccacaaaaaccctagaagaaaacctaggcaataccattcaggacagaggcatgagcaaggacttcatgactaaaacaccaaaagcaatgacaacaaaagccaaaattgacaaatgggatctaagtaaactaaagagcttctgcaaagcaaaagaaactaccatcagagtggacaggcaacctacagaatgggagaacatttttgcaatctacccttctgacaaagggctaatatccagaatctataaagaacttaaacaaatttataagaaaaaatcaaacaaccccttcaaaaagtgggtgaaggatatgaacagacacttctcaaaagaagacatttatgcagccaacagacacatgaaaaaatgctcatcatcactgcccgtcagagaaatacaattcaaaaccacaatgaaataccatctcataccagttagaatggcgatcattaaaaagtcaggaaacaacaggtgctggagaggatgtggagaaataggagcacttttacactgttggtgggactgtacactagttcaaccattgtggaagacagtgtggtgattcctcaaggacctagaactagaaataccatttgacccagccatcccattactgggtatatacccaaaggattataaatcatgctgctataaagacacatgcacacatgtgtttattgtggcactattcacaatagcaaagacttggaaccaacccaaatttccatcaatgatagactggattaagaaaatgtggcacatatacactatggaatactatgcagccataaaaaatgatgagttcatgtcctttgtagggacatggatgaaggtggaaaccatcattctgagcaaactaccgcaaggacagaaaaccgaaccccgcatattctcactcataggtgggaattgaacaatgagaacacttggacacagggcagggaacatcacacaccggggcctgtcatggggttgggggaggggggagggatagcattaagagcaatacctaatgtaaatgacgagttaatgggtgcagcacaccaacatggcacatgtatacatatgcaacaaacctgcacgttgtgcacatgtaccctagaacttaaggtataataataataaaaaagattgctatctaatttttagaagacaagagaattattcccactgtcaatttgtttaagacattacaatcatattaaaacatcttccattattatgttacagtttttaataaagattccttcacaaatcctataagaacatttttttacctcataaaaataactagcttacctgttttttccttttgttctctatgcctgaaaaaatggataatgtcttttggattagctacccgatccacaaatttctggctaaagcgaagaacactgaaaggttcaaaacctccactatagtccacctgaaaacacagaataatctatgaacgctaggaaacaacaatttgccaatttttaaaacacacactaatccttcagtattcacagtgtttatgcttgatactttgaaatttatgaattaattttctacagtagatcatgatggagctatatcatttatcctactgagaaactaatgtttgaaaagtttataagcataagcaaaatactttgttcgatggaatcaaggtattgcaataatttccacaatgcagaatgattacatctccccctgataacactaatagtctaggtacctaccaagcaaaccatctgaaaacaattttctgaactttcaaaacaaacaaacaaacaaacacacaccaaaataaaatactagccttaaatgcattagtaaattggtctatcatcttagagatgtgcctcaagagaaagatgaatgctaggaacatccaggtaataaagaatcaaatctgtgagccttgagaaatgattacctccaaaacatggtatctcactgaaactgagaacttctctcaaggtagactctttctacagaagtctgtagtggtaaacagacctttacaaagacaaataccacctttctttctcagagatatgttcttctcaactagctgttcccaaagtacgctatggggaccagcactgcaccacctcacagcttatccagaatgctccctaactaaagtgctcccactttcactcatcatcactatctgctaaggttttttgttcatttatttgatatttgtgtatcatgtctctctttgcacctccacctcctgtaagctcgacgaattcaaaacctcatctgttttatcatccctatatcctgcagcatccataatagcaggtactcagtaagatttagtcaatgaattaatgaatgtcttttagtcagtacaatgtagttttgtaatattacttatatgacaatatgtgctgttttatgaatgaattcgtaatttactgtgcttaggaaaagaaatgccaattttctattaaagtctggttagttttaatgctgtgaggcagacacagatgagaaaattgggatcttttgccataatgaagagaactatgtgattcccttaaagtaattatttttgtattacccagaccatctctctctctctcttttttttttttttttttttgagatggcgtctcactgtcacccaggctggaatgcagaggcacaatctcagctcactgcaacctctgcctcccgggttcaagcgattctcacgcttcagcctcccaagtagttgggattacaggcatgcaccaccatacctggctaatttttttatttttagtagagacagggttttgccatgttgcccaggctggtctcgaactcctgacgtcagatgattcagccacttcggcctcccaaagtgctgggattacaggcgtgagccaccatgcccagccttacccagatcatctctacagctaccatgttataaaagacaaaatactaaatgctaaagctattaggtctctccttcaaacttctcatttataaatgtttggtcataacaaattttattggatgtcctcaatgttctaagtatgctgttcagggccagggatacaaccataaataaatacaatcttggctgtcaagaaattcacaaactgactgggaagaaaaacatgtaaacagatcactggaagcagactgtgagtggtgctataagaggtatgtacaaagttggatgaggacacaaaggaagaagcatgttctctgtgggcaggtcaagaaaggcttctttgaagacagaggctttaggtgggtgctgaagaaggtatagagaaaggaggagagaagtatgtcccacgcaacaggatcaacatggacaaaggttccagtgaaataaactccactgcacccaggggacggcagcttttttggtttagaccacatcatgtagacccctgaatgctaacctaaaaaagtttagactttttcctgttagtgctggggaataattaagttatttttagcagaaaagacatgcaaaactgtgttttacaaagatcattttggcattagtgtggagagagaaggaaactggaggcagagtcctggtaggaggctgcagcaataggccaggaagtattaataagggcttcactatgccagcgacagtgggataaagaaacgggaacagattacctactgtgcaacagacactatttaatccatttagatctcataaatctacgaagcatttggttggtgcacaagtaactgcagtttttgccattactttctacgacaaaacccgcaaatacttttgcaccaacctaatacaaaccaagggataagggatgcggttgctcaaggtcatacaactagtggttgggccagaatgaagctcaggaagtctggctctacactgtactctttacctccacagtctacatcccagtacttctcaaattttcatgaacatatacatttcttggagatttttgttaaaatacagtgggttctgatgcagggtctgaggctctgcatttttaacaatttcccaggcaacaacaacactgctggtttaaagactacactcctcagtaccaggcctcaggggactcctggagatacagaacaagaaggaggtctacgtaaagattttgaagtcatcactctattggtggtcattaaagctgtatgcctacactgaaaagagggctaactatgagacgggacggatacaaataactcagagaatgcccaagagtaattcagcaagatgagacacgatctattggattgaacaattaaaggtcatcttttccactggttatggtgaagtcagagccttggttatagtgaactgaagaagagaaagttaagagagatataggttatatacttttaggggcttttaaagagagtaagcaacatggggtaggagtttggaaaagggaaaagcatagtggtaaagaagaagtctgttgttgtttctttgtttataacacgatagaaaggataagcagatttataggcacaggaaacaatcctaataataaccaaaacaaataaaccgtacatagattagaaggatgtgttacggggaaaaaaataagaagaaaagaggaagcagaagaaggtaagtgaaatcagggcactggagagaaggtaggggctgcaatcttgatgatagggctgcagtgaggtgacacgggagcagactaaagggagataagagcacatcccacatgcccaagaaactgcgagaaggccaagatgcctggaatgaagtgagtagaggaggtagttaaagatgaagccagagagctcagccaatctattaaatataacaacaaattatttagaaaatgagaaaaataagttaccaaacctatcacttaaactgtgattaactcaaatccttatatctttgtttttgcctccgatggtgattgctcttcttattactatgagcactctcctcactacttttcaaagaaaccatgtaaactgtacattactatgctttgaaaattaataatattcaatctatataaataggacttactcgcagtcgtacaagaggcttctctggctggtgagaattacccagacgttcccgttcagcattttcaagcatttcttcaatctcaaaatttttaaaaagattaaaaaacaacgtagtaaactgagtttaacttggctgaatagcagcttattaccacaggaattttcctgaactacataatcatctttatttcctaggtcatttatgacaccttttcaaatataccttcttgtaatgctcctttaatactattccttaatgttttcctttcatgaaagttcttcataatttttcaatctctaaaataattcttttagaataaaacttaaaatattactactcatgtttcaataaggctttcctcagcttaccaacttaaaaccaagtaagtctagtttttgcagtcatatgatccatgggagactcaccagaagatttagggatcaataagcaaggactttagattatttatcttggaagagttcaaggtaaaagaaaataagactgatgttttcaaatatgtggagttgtctcatactctgagaggataagattataacatcttagacttgaaagagttctgaagacaaaagcacttgttctatattgttcttaagggtaaaaccaagttacaaggagacagcactagattattttcataaatggctgtgtgcacagtgattagatatctccagatggccaacttcatagctgaacaattctagttcttagaaagttcttgtattggaacaaaaactgccttcctataacttggtcctgatctcaagaacaatacagaacaagtgtttttgtcctcagatttctttcacatctaagactttataatcttgtcctttaaactgtctgtaacaatgaagtccaaaagagttttctgcaataattttttctatgtgcatattcaatatggttgccaaaaccatatgtggatatagagtacttgaaatgtggctagtacaagtgagaaactgaattttaaatttaaatgtaaataattaaatgtaaacgccacatgtgctagtgaatacatatcagacagcacagagaaaatctataagaatatgatctcctaggtcaattatttcaatccaacaagcatttatagagcatcattttgccaggtactaggtcaagtgctgagacagaaaagtaagatatgggtcctgtcctcaaagagttcagaagacactcacatgcttataaaaaataatataacttaactaagtacaataacagaaatgtacataaaatacagagataacagaaagttatgtgcacacctggtgtttaaaatgaacctctattactttgtgtcaccagcgtctactttcctctctggattcatgtcaccaaagcccacaggatttaggtgaagttcatacagtagacctcaaccagaggtgactttgcttctctaaggacatttggcaaggtctgtaaacatttttgatcatcacgaccagttagaaggggtactactggcatctagtgggtacaaaccagggagaatactgctaaacatcccagagtgcacagaactgcctcccacaacaaagaattattagtacaaaatgtcaactaagccaaagttgaaaaacccaggtctgactccagggaagggcacatgactcaggcctggatcaatcaatgcaaaagcaattaatgcattttctatctctttggcttgagagattggatttagggatgccagaatcttaatctatgtttgagtttctagagtcaatcatcttgaaacaagcgtacacttttggttacgtgagctacacactgctcaaaaagctgtgacactgaatgagtcaccttatctaaggttcagttcctctaaactatagatggtagaaactactcacatatagtattgttggctagattaaatgctgtcaacagtgcacatcacatacagtaaatcagtaagtatcactggtcataattattatcattgttactatgttacctgatttttcatgaaaagaaaacatagtaggacagctgacacagagttaagaactgagcgtcagcaagtgatgctaattaagctgtcaaaccacatattattaaatgcattaatccacccaaccttagtagtggctgaaattttctagagatttaggggtggcaatgtgcatagagagggaggtttgggacttacattgcagcaatagggtggatagcaaacacatttttcacatttcatttggggtagctttcagggtgaaagggacgcctaatacagattattagaagctaaggcttttctcacacacgatagtctcccattcctcaatcaaagttactgcctgctttcataaataaaatgaacaaatcatcaaatcaggattaaaaaggagaaaagattatgtattatgtttttgaaaaggaagaaagaaactaggagagagatttaattttttttaacatccagtattcctctctctcaatgacttaaaaaaaaaaatcttggacacaattaaacacattcactgaagaacagtgtccttacaggcttcatgagaatgtaatcaacataaaggcttccctctactctattaaattacttaattgaaggtgaataattcttcaactaaagtagatctcattgactttatcaaaaagaattaccttctccaaacagaagctttgtatggcttgggttactttaggattatctgggttaaaaatgtctggatgattagctagaacaatatcctccatgaaaaactgccgcactgtgtgaagaggaattttatgcatattcatcttcctccctttaatacgcagcaaaccaacatgtctgaagtggagagaaatgaacaccgagtcacagtgtaaatttcctcagggtgatgtgcaaacgaaagctttcatatttcttagtttctaaaaatgcttctttataaaatcatactcttaaaaataaatgtttctgctaatttaaccttaatgttatcatcacaggaaaagatggtagacattttccttccccagagtaaaatcaactcatccattattatccctgtctgatcagtcttgtaagatagacataataagcataaaaaaatgttaacaggactatgatggtagcatatgtagactatagtattacatctatatacctatgtatatgtacatacatgtacacatatagacaaaatgattttgcagtggactcatgaagaaaaaaaaccaaccaacatagattctactaccatattctttaaccctattatcattgtaacaatcagaactcaagtgattcaaaagataaaacccataataaaaattgagtttaatcactgttaactacttcttacaatcatatcattcccccaaaaatgttttaaaaatgagatctattatactgcacttataatcagaaaattttcaattaaatggttttaggataattttttataatgaactttgtgaaattagtaatcatcaacctaaaacatctaccttgaaatataataaaaatgtgcatcttgaatttgcctaatgagcagcaaaataacaccaattggatgctctctttttgaaaatggcttaaaatctggaaaaacaataagactacacagaatgatcaattttcaaaaataaagctatcatataaatgacaatactgccagttagcggtaaccttaacataggccttaaacctatgagatgattagttattatagcaaagatttcttaaaaattggctcaaaatatataacactcacttctttacagcttctcctggggaaagagaagtaaccactgagcttccaggttgtgagatataaaacagctgttgttcatttttggttggagctattttacactcatgttcatggccccagataacaagatcaatgaagtcatccaaaaattgttctggaatgaagttagtacttccatgtttactcctgtatcaagattttgaaaaatataaattcggtgattagaaaaatttcatattattgaagtctatacagatctttctttctccattcactaaagattttattgcatccttctatgtaccagaaagtgtgcacaggattgggaatgtaaagatcatcaatgctaactcctgaccttgagagctttacaaacttattggacacagacaagtggaaacccgaaaagagaaagcagtcaattctatatttggaggaagatcatgaaaggttttacataggaaggatttcccctttggtcaatcagaaaagcatgaattctatcaatagtagaaatctataaatcagtctaactatatactagagaaaacacacagaaaatgcaagtaagtataaatatgtccagtaatttcttaacattatctttttactaataaatataatgggagtaaaaacatcaatctcacataagtgctaagagttttcaatatcaaatattaaataaacaagtgatatgcaaactatggtattatacctatatcagttattatttaaagatacatgaaatgcaaggtgatagaagacaagaaggaatagttttccctaatattaacttacatcattggagattcaagtaaaagtgttcacatagtttaaccaagcattcatttaatccaaaccaatattcttccattcacccaacaaatactgttacccaaacactgtctactttatgtcagatgtcccaggcttcttctagatatggaagacacagcagtgaacaaagtccttgttctagtgtgggaaacaagcaatgcaggttgagtccctaatctgaaaatccaaaatccaaaatattttaagtgccaacatggcaccacaagtggtaaattccacacataaatacttaacacaaactttgtttcatgcacaaaattattttaaaacatgtataaaattaacttaaggccatgtgtataaggtatatataaaatgtaaacaaatttcatgtttagacttgggttccatccccaacatatgtgcaaatattccaaaatccaaaaaatccaaaatcttaaacacttctggtcccaagcatttcagataagggatactcaatctctaatacaagatgtatatgcatgtgtgtaagtatgcacatgtataacttgtcagttagtgataggtgctgtaaagaaaaataaagggaaaagtgacatagaagtgccatactcctctctacatacacagggtagtcaggaagacctctctgactagcatcaaatgagcagagaactgagatgaagcatcagtacgcggagagagaaagtcctaagcagtagaagagcagatggtgctaaagtgggaatgtgttcagtgaattcaaggaacagcaaggagaacagaagggctaagcagaataaatgcagggaagacagaatatacaggcttgtgtatccaggaatgtttttatgtaaaaaacatacatctaaggtatgagattatcacaactactaaagaaaagcagaataattcccaaatacaacatgatgccattgtgccttcattgagtgctggttctttcccggaagaagaagggaggatgatgctggtaggctgactgtaatttgtgacctagaagtgatcacaatatccttgttgaaagattttgcatgaccaagtcatctccaaattcagattctttcttctttgaaacaagagaaaaaaacagttgatgtagagaaacaaatgggaaataaggcaaaatgcagaaggctcaagattctcacccaatctgtgaaaaccttctttgttttaaatatgaaagcagaagtatcttgagaatgcacagggtgacaaatgaatctaacagcattaccaaagaaccacataaccacagtgaagggggtggggagaaaatgagctaagtaagtttgaaaaattaggtttcaactagatacagaaaggctaaagactaaaataacttacacaaacattgtaacctagttgggaaagttgttttgcacaggggtatgagttagcaattttgaaattactttataatttcaaattataccaggattggaaatataattaaaccaagattgaaaaaataagtaaacatatatatttataatatgatccaggcttctgttagacaaagaagtcacaagtaaggaaagggagaagacaaaaatggaccttgtagggctggattagaatcagtctgaacttatcattggttttttaagcacatatatagacatgtatgtatgcatgggttactatatacacatatatctattcccataactctgttcattcagagtgctgagcaagccctggtagcagtaagcacacctagtacgcatttgtggatttctgaataccactctccaataaaaagaatcagagcaccttggagaaatggttgattccagggctaggtaggaaaatatcaggttggtgcaaaagtaattgtgatttttgccattacaagagccaagagcctagaccatcttgaggtgccaaaaagctaactaaggtcatgacctcaaaacagatgggaagacattgaaaggacacagaggccaacataaaagagaatgcaatggtcaaagctgcaacaatcagaggaacagtagcaaccaaaaaactgatagtactggatcttcaagtccataatgacataaataagtaagtaaatagagaagaagggacaaattttccttacagaagaattccattaataaatatagaaagaatgaaggaaatcaaaacttacaattaaaataccacagtattaattactggaaataagatcacccatggatgctaaaattagcgagtaaaagtttaaggtgaaacaggatatttgcatagtctcaaagtattttcccaaaaatatttattaattgaaaagtagaaaatgggaactttacagcagagaaagctgttacacattcccttaatcaaatgatgaggggggcaatgagaaaaatcaacatcatatggtgactacccattccccttaccaatgctgctattctacctttcatttggcttaaattcttagaattacttatgagttttcctttcaactcatcatccctactttggcatagtacaaaaaaatggtagacctgggaagctctatggaagagaaggaacaaatcccagtggtgcaaagttatatgaagaccacacacatatctaaactctggcctgcccctcctttgaaactcacagtttattcaagaactcacacataaggtaacacaagtcagcctcttaaaccctttcttttaccgagtatttaacctaagtctgcattcactgaatgcacagagtagtctgcattcaataaatgtgttcaataaatatagctggccctctgtattggcagattcgtggattcaaccaactaaagatcgaaatattcaggaaaaaaacaataaaaaataacaacgaaaaatataaatttttaaagcaatacagtataacaactatttaaacagtatttacattgtatcaggtattacaagtaatctagagatgatttaaagtacataggaggatatatgtaggttatatgcaaatgctataccattttattcaagggatttcagcatcccaggattttaggtcctggaccgaacaccccccgtggataccaagggacaactgtaataaattatataatcaggccccaaatcctttgagttcttccctgacaacttctccggtgtgtccctcccatttctgtttcattgccatcactgtcaccacctcacatttttactgcagtgatcagataataaatcttgcttcttcaagtctgtcttcttttcaatcaatcctataccctgccaacagattaaatttcttaaaactactaacaaaagaaaggtaatctagctatatttgtatatcctggaagaacacttgcatatatgtagcaggaaacatgtctaagaatgttcataacagcaaggtttataaaagcaaaaaactcctgttcactgacaggaggcaaagcataactgtacacatcagtaaaaataaattacacatccaagcatcaaaatggatctcagtaatgtaatgctgaacataagttggctgtaaatatagcataatatgagtatacatgtgattaaacagcaaagaaaagcaatgaaataattaattcaaaattaataatgcttccctttgggatagggggaagcaggtgggatcagggaaaaggaatgggataaaggaatggataatccaacaaaaagattctacctttttgttgaattgaggagtattcatgtgtatgccttatccttatgttacaaatattcttgtaggtattaatatatactaaaaacaatttcaaaatgaaatcacacaaagcaaatctatgttttgtctgatcttgcattgacaaccttgaaagattaagggcatttcactaaaataggtaagctcagaaacagatttgggaagcctcagcacttggctcaaactttttcagagaaaagttttacctgttctgatgaatcacaaataagttaaaccaagagttctcatcttcctttggtctcaacattgttacttttttattgacaaacattcgatagagcctttcatctggaatggatcctgaaatggacattacattatttttaaattgttttcttacttcggcttaaaaaatgaatctattttgcttctaaattatgtccttctcaaagtatttcactttactgttgggagatatatttgaattctggaataatttataagtgggtatgttgcaggttctttttttatcttttttttttaactgagacagggtcttgctatgttgtccaggctggtctcaaactcctgggctcaagcaatcctctcgcctcagcctcccaaagtgctgggattacaagcataagccaccatgcctagctgtttcagggttttttttcttttcttttcttttctaaacacagtcttgctccattgcccaggctggagtgcagtggtgtgatctcagctcactgcaaccttcacctcctgggttcaagggattcttgtgcctcagcctcctgagttgctgggattacagcatgcaccaccacgtctggctaatttttgcacttttagtagagatggggttttgccacgttggacaggctggtcttgaactccggacctcaagtgatctacctgccttggcctcccaaagtgctgaaattacaggcgtgtgccagcacgcctggcctgttccaggttcttgataacagtagttagttgcatttgaaaaacattttccatttcagacatatacatgttcaaaaccagcaaaatgtagaataaaaatgtgagttttctatggtaaaattcttattaaaacttctagtaatactatttttcaccatccctttgttataaattatatatacttttgatctaatatatacattataacatgtgcagaaataaatattaaaagggatgataaaagtgtatttaaaaacaatattcttacattgttttaatatattgtgctttttaaataactcaatgactttcaaacaattctcatactccacaggttcaccttgatctagtgaaagaaactaacaaaaacaagtcaacaaaatagttacaaatattaaatattataaaaggagaaaaagccaggatgctaagatggcgaattaacactatggaattaaaagggtggacaacactgctactttatatacggattagagagggtctcagaagaaaagccaacaatgtagaagtctagaagttagaagtggcctagctcccaaggagaatgctacaggagtggccaatggaatacatggctgaggtggaatgtagaacatgtaactggagacaaaaaagtcaaggcacacaaagcccaaggcattagaagattaatctacttgagtgttgaaacactaaaaacactggcaaaattgaaggtaggtaagtaggtaaaaagtctgagagaaaaagcaatgcggtttagccagatggcagaagcttaaagggaacagtgtgtttgcaggcagaaaaggaagcagtgggtggagcaaggagaacagtgatccccgcttctttccaaaagcccaggggtaagagaactgcatgggacacaggaacctcaggggacagctgggcttcactgaaggttagaaagtggaggtaacattcagagaagagactgataataatgaggaatctgataattataaaaagagttctagagtttataatgaagagctgggggacagggaggggtgcagggtggagacagagtccagttaaggaaggtataatagaacaggataagataagagtttgggagaaaatggatgactggagagatgtgcttctggtggtgactgaggcataatggaatctgtccttagtctgaatggaggaggaaaggcaattttctggagatatgatccctaataacactgcagtgattaaaacaactgttaatagcttttttaagaaaagtatatttcacttcctgctctttcacttgcagaatcagatataacatccagatttcattttccttatctctaaaatataaataaccatgatgcttttctacttgccagaggtattatgaaagctgcacaaaattataagctagcggtattgtacagtgaagcattagacctttcaaagacttccaagatatcaaagtgcagttttgctaattattctataattctaacattcaggattctacacctgagtctaaaaaaaacccaaaataataaatagtaacgaaaagacattttttcaccaaaaatttttaccaaaaccatccatcattttttatagtcaccaataaagaataaggtttgccccattttttccaaacagatacaaacttatctccaaatttctcaattgtttaaagaatcacacatggacataaacagtaaaataaaactgtcttacctaaaccatatagcgcaatctttgtgcttcctttttgaagcaaaaccggactaatgtctatcttctccacagacattgaacgtccaaagtgatttacaaatccagcacaacttaaaatgtccaaggcacaaagtgcatctgcctatgcaaaataatttcaaagaatgttagtgtgtatgtaaaagtaggtatctgcatgaatatcgtatcacctgttaaaagcatactccatattctacttacaaaaacatagatgaggatagtgtcttctcaaaacaaaattacaatagtaaaagtatttgctacatttttgtactacaaatcacctacagcaactggaatcacatgccaaaggcaaggttaatatctcatcaaaacttatgatgtcttggccacaaaaaaataaaaattagccatgagataaatgctttgtaatattaagcaaccgtcttaaagcctggggaaaaaagaccatagataatcagtgattcataatattaatgaccagataaaatgaaaaaatacttgtaggatctctagtcttacttccatatcaaacaggtaataagataatctaatttagatttaaagatggtcttgaacaatcatttcctaaaagtgagattttataagatagttataaaaacactgacaaactgtaaaccactatacagatgttaggtgttcactcctactcctggcttcttattgttaacatcagtattaatgaaataaaagcatagctcatacaccaattcttatttcagatttttaaaaaatctaaaaagcagtataaaagcttgtatgaatgtgaaaagtcaacttgacttttgactcaatttgactacacaatgagaaaaagggaaggcatgctttccacagacaaactaaactgatcatttccaaaattccaacaaactctaagaaaacaataattacccctgtgggatcgtcatgattgccatgaatactaaacactggaattgaaatgttgaggttgccatcttgatagttcacccatggaaaccttaaaaaaaaaaagttacttaaaatttccatacgggacaaaagctgttttccctaagattctcctccaaaatattaatgcaatcataggcaaactgcataatctacattggcatatgaccactagtttagagctttaaaaaataaaatcataggcgacaattcatttcaattagtttgaaaatatctcaaagcactacattttaaagaaaccccaactataataaacagtgcttgtggtatgtatgagtagtatatctaattaatgaaaagttaataagccttcaaaattttaaaaacttagcatatggtttttattcgtagtggggggagggaagaaaatccatatactttagaatcccaaagaggtagattaaaactcccagctctatcacttattgcctgttcaaattaaagtctcctgtcagcccctgcccccagccatccagctcctcttctcagaggcaaataatgttagcaatttctagtgcatctttcaaaaggatcctatacctatccacacaaataaacagatttttctttctccttacataaatgatagaaaaatatacatttctgcatcctgcttttatcactcaacatattttagaaatcattccacatcagtacatgaagacctttcttctgctctgtcagccacacagtactccattgcatggatcaccacaatgtgtttgagcagttccctaccaatggacatttagattcttggcagtcttgttttacaaacaatgctacagtcagtaatcttgtacaaagtaatcttctacagcgagtaatcttgttgccctggtgagtcgacctgtaaaggaatacctggaagggaattgttaggtcaaagagtacatgtatttgtaattttgataggtgctgccaatttcccaccatagagatttacacataatgcaatggcagtgcacaagagggacagttttcccctacctcactaacacagtaggtcatccagctcttaaatctatgctagcagttcttaatgctagcagcatgttggaattatcttggggatctttcaagaaatgccaatgcccatgacatacttggagagactctaagttagttggcctggagagggggccatccatattttcaaaggttcttaggtaactgtactgtgcactcaggattgagagtcacagacctatgccaaccttataggagaaaaatatttcagtatagctctgtctttttcttatgagtgaaatcaaacttttaaaaataggtttaggccggatgcggtggctcacatctgtaatcccagcactttgggaggccgaggtgggcagatcacctgaggtcaggagttcgagatgagcctggccaacatggtgaaaccctgtctctactaaaaacacaaaaattagccgtgcatggtggcacatgcctgtagtcccagctacttgggagactgaggcaggacaagtgcttgaatctgggaggcagaggttgcagtaagccgagatcgcgccactgctctccaacctgggcgacaaagcaagactctgtctcgaaaaaaaaaaataaaagttaaatgtcatgttatttccttttctgtgaagtatgtccatattctttatttattactaactcatgaattttattgtcttgaaagaactgcttattggggaattcaaccttaatttgcaattggttgcaaatattcttcctgattgaactgtgacttctggctttgcttcaggcagtttttggcatgcagaaatttatttttgcaaagacaaatgtatgaatcttttatgacttctgggtcttgtgtcatacttagaagccttccccacacctagatttttaaaatatgtgtaacagtttctcctagcagttttactgaatccattatttcccctacattgtgagatggtgaccttcatcaaatactcaattcctacatgtatttgaggctatttctagagtttctattctctttcacttacctatctactaattcatgagccataccacattttcaattattgtagcattgttatacttcaaatctaattggctactaactccttagtagtcttcttttttgggatttccctatctttgcctattttctacatgaactgtgaactggaagattaaattatccaaaatgaaacacaaagaggtaaagttatgggcaatattttttttaatagtatgctatataaatgatattcagaaagagaaaggaaacaatatttgaaaacataatgaatagaatgggaatttccccaagttgctgaaaaacaatattacattagaatatatgataaagcccacgcggaacaaacagaattaaatccacagctaaataagactgcaacatgttaagaacaatgagaaaatcttaagttacccaagtattgtctttatgctggtcactactctagccatttttcttatcatctcaatcttctcaactctgtaagattggcacatttctttcccatgttatgaaggacagaactaaggtagagtagttaagtgactaacataattttacaactactaaatgacagaaccaggatttgaactccagctgttttataccggaacccatgctcttaatcactatgctaaactttctagcaactcacctaacagtagactcctcaacagcaacaaaaaataagagtttaccactcactgacactccatgaaaaaactactgaaaactgtgcttcagaaagaaggaaactgaatctacacaaaagaaatgaaatacaaggaacaacagtgagcaaagaaataggtaaacatgtatatagggtggggaaacagttttcaaaacagaatgcaatttaaaaataagatgaaagaaagaaaatactgaagttaaaaaatgtcccggctgggtgtggtggctcacgcctataatctcaacactttcggaggccaagtcgggaggatcacttgaggtcaggagttcaagaccagcctcaccaacctggtgaaaccccgtctctactaaaaacgcataaaaaaattagctgggcatggtggtgcacacttgtagtcccagctactcaggaggctgaggcagaagaactgcttgaacctgggaggtggaggttgcagtgagccaagatcgtgcctctgcactccagcttgggtgacagtaagactccttctcaaaaataaaaaataaaaaataaaaaatgtcccaagttttagatttgaatagaaggagggtaaagacattgatcacaattttgaaaaacaaggacaaagtattatacaaatcttttaaaactcaattatatatgcagccaaactatcaatcaaggggaaagtgaacataaacattttcatgtggacaaaatctcaaaaaaaaatttacctcccaatataaagtcacactttaaaaactaaataagaaataaatatgggctgggcatggtggctcacaagtgtaatcacagcactttgagaagctaaggcaggaggattgcttgggcccaggaccagctgggcaacacagtgagaccccatctctaccaaaaataatttcttaaaaattagctgggtgtggtggctgatatgctttgactctgtgtccccacccaaatttcatcttgtagctcccataattcccacgtgttatgggaggggcctcgtgggagataattgaatcatgggggcaggcctttcctgtgctgttctggtgatagtgaataagtctaaagagatctgatggttttaaaaatgggagtttcccagcacaacctctctctttgcctgccatcatccatgtaagacgtgacttgctcctcttgccttcagccacgattgtgaagccgccccagccaggtggaactgaaagtccattaaacctctttcttttgtgaactgcccagtcttggcgggtatgtctttatcagcagcatgaaaacggactaatacagtggcacatgcatatagtcccagctacttgggaggctgaggcaggaagatggcttgaacccaggaggttgaggctgcagtgagctatgatcatgccactgcactacagcataggaaagagagccagaccctgtctcaaaagcaaaaattaaataaataaataaataaataaataaacatgagtatgtctattctcatgggttagtatgtacacatatttttcttagctctgtccagtgagagcctagaagcaacaatacaatagtaatgtgcacatgtaacatccagatcttggtttccaaataccattctccaaaaggaaccagggttccttgaagaaatggctgagtctgaagacaagaaagacaaagtaaaaaatcagaagaaaaggtgggatatatcaaaaggatacaggagccaatctcaaaaggagcccaatggctaaagctggaacaatttaagccacaagtaaattatgatagtaataaattataacccaaaggaaaaaaaaatgggtttctactgatatagacaattgaataaacaaatgtgggacaagggacaaatcttccttacaaaagaatcccaattaatacatgtagaaagaatataggaaatggaaaatcacaattagaatatcacagttataactgttgtaggtaagatccactgatgaatctaaaattaatgaacaaatttaaggaggaacagaaaagtcgcacagcctcaaaatatctaccctaaaatatttattaattactttggtggttttaacttatgtccatcagaagtggaaacttaactccctgccctttgagagtaagctggactcagagactcaattctaaccaacagcatatggaaaggaaaaaataatgactttacactggagaaacctggcagagaccagcttaaccaagtgatcaaggttaaaatcaccagtgataaatcaggttgatgtcacgcacctcctgatatgatgcgactgaaagggtacttcacttcttgaatattctcccccaaaacctgtaatcccaatctaatcatagaaagcaggagaaaataccaaattgagggacgttctacaaaatacctgacctctttataagtatcagggtcatgaaagacaaggaaagacagaaaacctgacatgggctgaagaaattaaggaaacgtttctactaaatgcaatgtgagatcctgtacaatgtttaagacatgatgggccagaagcggtagcttgcgtctataatcccagcactttgggaggccaaggcaggtggattacctgaggtctggagttcaagaccagcctggccaacatggcaaaaccctgtctctactaaaaatacaaaaaatttgccgggcgtggtgatgggcgcctgtaatcccagctactcacctgtaatcccaactactcgcctgtaatcccagctactcaggaggctaaggcagggagaattgcttgaacccaggaggcagaggttgcagtgagccaagctcatgccactgtactccagcctgggcaacagagcaagactccatcaaaaaaaaaaagaaaaaacacatgatgatatttttataatatagggattgacaaatatcataaatagtcccaaaggcacaaatggaaaaaaagaaaaaccaatagatttaactacataaaaattaaatatttctgtcaacaagagtccataaacaaagtcaaaagacaagccattgattgggaaaaaatatatgtatcacaaaggtttactaattagaatatataagtaacttctgcaattcaggtagaaaaacaaacaaaaaaatctcaatttttaaaataggcagaggatacgaacaggagaggataccaaaatgtacaatataaacctgagaagatattcagtcccaccatgtattttttttttttttttgagatggagtcttgctctatcacctaggctggagtgcaatggcacaattttggctcactgcaacctctgcttctggggctcaagtaatcctcccacctcagcttcccgagtagctgggtcagttccactattaattaggaaaatataaattaatacaatgatgtacaaaaaaattcaaagaatgatatttactaagaaaatagcttatatggaaggcaaaacagttgtgtgtttacgtgtcttatacagcaaataccatacacaagtaatcactcactcaagtaaataaatatacttacttactaaaaccaaagttgactgactgatcactgagaatttcaaactggacaggccgatcacccatacaatattttcttaataactcgaggcaggtatgtaatgttttccttgagggcttattttcatgaaaaagatcaccacctaacaaaataaaatccacctgatcaacagaaaaaggtgttaaaattagtatgttttacaggtaaaatttttgtaaactacagatgaaagagataaaaaaaaactcacaaaagacactattatatatggcaacttaaaaatttacattttatttattcaaagggactttcaatctggtaattaatctggttctaatttagctgactaagctatcttcaaaaaagccatcttccaattacaccaagtctctgattcaggccacacaaggtgatcatattttttctattatttgaatcaaacataaacttagcactttaacagaacgtatgggaagagataccaaattcaatccaaatcattcatttaattcattcagcatttatttacagaattcctacaggttctagaagctcaaaaaatagcaatctacaaaatagattatatccctgccctcattaaatactgactctatgcaagaccctctactgagtcctgaggatacaatgatgaataaaatatgatccctatcctaaatatgttcaaactctaatggaagaggcaaactgttatacatttaaacataagtcaaactctggggtgcactagaatggacacgtaagcaaccagcagcagagatgacactacgatgaatttgaactcaagggaggacaattcgcctgaggacagaaagtctagaaggaatgaactaacatggtggcatgttagttgcactaggaaagataaatgattgtgaggaagagaattctaggaataacttcagtgaaggagggaaatcatacagaaaaagtctaacacaggctttcaagacgtatacgatgcacctaaagaaacttaagttcttaatcacacaaaagaatacaaggtatagatcactgtgcgtatggtagttaggataactttaataaaaatgtgaggtttaagctaggccttccagaatgaacactatttgagtaaaaggaagaaaatgatctcaatcaaaggcatggaagaaacaaaacaaaaacaacaaaccaaatgaaaaacatactggggcgaaaagaagttgttgcttaatgggtgtcatttttgcaagatgagagtaattctggagattggttgcacagcaatatgaacatatttaacactactgtactatacacttaaaaatggttaacaagggaaattttatgttatgtatttaatatattttgccatcattcaaacatttaaaaaaattttttaaactggctggcagtgactccaggaaatattgaaaagaacacgactcacttctgtggtattcttgccgaaagtgcagaatctgaacctaatcatgaggaaataccacttatagccaatttgaggaagattctataaaataactggcctgtgtactcttcaaaatattagggtcatgaaaaacaaaggcaaggcagatgcaggaaaatgtaccagattaaaggagacaaagagacatggcaactaaatgcaatatgtaaacctggactggatcctggacaccaccaaccagcctccaaagtgctgtaacagacattacagggacaattggcaacatcttaacattatataatagcactgaatcaatactaattttctggttttctatgattatacatgcggtttactctcaaatggttcaggaaaaaaatcgtgtgtatttgtaaagagaagataaagcaaatgtgacaaaatgttagaaaacctgggtgacgggtaaggaattctatgcgctattcttgccaacttttctgtgagactgatgttgtttcaaaataaaaagtttttttaaaaaaagactccaagaaactagggaacagaactaagactggttagtgggcatgggcccacataataagggacttaaaagtcaggaagactttagattcaataataagaaatactaaatacaaatcaagagaatgagtaaatataatacacatctagaagtccctacctggggttatggggggtggaacagttacaattaagggacgcagggaagagaaacagtagaagcagaagtgaaggaaagggcaaagtagaattaagtagcttacactcaggagaagattctgttttagggctcaagagttaaaaaagaaagagcacatacaggattctctggcaggaaacagacctcctttggccacaagtttttttgccttcaaggaaggaaaaatgcaccttacattctattattgaaaagtcaaaaaagaacagatgctggtgaaattacggagaaaagggaacacttatacactgttgatgggggtgtaaactggttcaaccattgtggaaagcagtgtgacgattcttcaaagagctaaaaatggaactaccatttgacccagcaattccattacttggtatatacccaaaggaatataaatcattctaccacaaagacacagcacacatatgttcactgcagtactattcacaatagcaaagacatggaatcaacctaaatgcccatcaatggtagactggataaagaaaatgtggtacatataaaccatggaatactatgcagctattaaaaagaaccagataatgtcctttgcagggacacggatggagctggaggccatcatccttagcaaactaatggaggaacagaaaaatcaaatacttgtaagtgggagctaaatgatgagaagacatggacacaaagaggggaacaacagacactgggacctaccagagagcagatgataggaggagggagaggatcaggaaaaataatgaatgggtactaggattaatacctgggtgccaaaataatctgtacaacaatccctgtcatatgagtttacctatgtaacaaacctgcacatgtacccctgaacctaaaataaaagaaagaatccagccattgcctcacttaattaagaaatttaaaatatgtatacccactgctttctgattctttctaagcactaagatacagcatgaacaaacaaaagatttccactctcatggagttttccttctagtgaagacaacagacaataaacaagtaaataattcaataaattatttcagatagtgctattaaaaatatgctatgaaaaaaagcagagtaatgtgataaaacagtgcttggaagtatcagggaagacgtctccaaaaaggtaagacttgaactctcagaagtcggccccaccaagatcaatgtgctccaagcagaaagaactagatgtgcaagggcctcagagtagaacatgccggtgtggatgtagcactgtaaatcaggcagagagtagtaggagatgaagtttcatggcaggggtcaagatcaagtcgaaccttgtagtttgaattttatactagattcaatggaaggacacttggaaaattttaggcaacagagtgccatgatctgatttattattttaaaagttcactttggctgctatgctgagtagatgtagcagaaaagaatagaagcagaaagatggaaggggacctcctgcaggccatgtgaaatgtgatcgttttggactaagtttattagtgtgaaaagagtagtagagaggaaccatatatatttgggaggaagaactaaggacctagcagataaacttaagagaactctccagaaaagtcaaggctggcggtgttaatttgcaagtcaatttttacatttattctccaactctctcctgggctggcgtgttaactgcctgctgaaatttttccctgaatgtcccattgcagtctccaactctaagtttgtcgaaatcaaacaaagaatttgtcaccttcccacatgaagcagtacctcttccttatctacctatttctatttttggtacaactattcacccaaactccacacacttcagagtcactgtcatccctttgccctcatccccaccccgctacaactaaccaaagtacacaaatcctctttttgcagtatcccttgcattcatttcctcttttccatccctaaggtcaatacttcaaaaaaagcctctaactggtctccaattcatggtattatactccgctgccaaaagactttctcttgaactggatacaaatttctcaatctgatatttgaagtcctcattaatgcagctcaaatccttccttctagtctctcagcatgcttgctaactatgacctgctggtgagccaaattgactacagggcccctaacataccttatactgtctcacgggtttcctcactcctgcttcacatggatgtacattctctatgctccccactggccaaaagtctacccttcctccaaagcccaagttaaacacaaccttcttcattaaactcatcttgctataatctaaacgtgattttttctgcctctaaactcaaaggaaatgttatttagaattttcttagggctcctatcacatacaaccttgcatctgtggattgtggatatttgtctttcacaccagttttcttctacgttatctgaaagcagaagctttgacagtcaccttacatttcgaatagacactgccacaggatcctgcattcagtaaacaccccaaaaacatttgtaaattttaacagactatttacaaaagtagctcctacttgaatttaagacacaaagcatacaaaatcagctttgagctttcagtatattgatattcaagcaggcaaggtaagcacctgagcttataaaacaaatctctaactttagaaggaaaaataacttgttaaccaagggaatatggtagatagtgcacaaatacaaaccacactcacttcattttcctgggcaagtcttaaaatttcatcgagtgttacaaacgtatcatttcctctgactgcatctttctccataaatccaagatgaatatctgttgcaactaatattttaaatgtgttttcatcatcactatattaagaaagaagaaacatttcaatatattaataattcattaaaggatattcaaacaaattgagacaaacttataaaataaataataacagttatagagtaaaatcattttttttagccttagagttcatctgaaaatctgaagtattcaacgttatcattaacattacagttttcctaaccactagttcaatacagaacaaatgtacataaatctttacaaggttctataactgcttcaaaaatttataaccttgttataaccagttttacaaactcatgtaacccaggcccaaaagtttgcttgttttcctcagataaataaacttgttatttatctgacttcgtactcttccaggaaaatcgaagttaatttaaaaagccttcctctaagtttatgagtcaattttatactaatatgcaataatttacattcagggccttgaagacacttgcatgactctactctctacagagttagatttcattaataaagttggccaacacagaattgtttcaatttgaatttggtaatattcaaaggtactttaatgtgaagtagcaatgtaatagttattaatactcttacactaaatttaattgtatgaaatacttttatttttatgatctcatctcaaccctcacagataaagagtcaggcattattatctctgacaaatgagaaggctaaacccagagaaattaactgctttatcacataactagtgacagaaacaggactaaaacccatgatgaaaactcaggctattttcaataaaccacaatgaatttttaaaaaatctctgtatatatctccaaaattcaaatctttacaaacaaaagatatttccacaaacgatttctcttcaaaaacttcaaaaatgatatgcacacagttctcactgatatatccaagaaggtaggtcagatacttttcaaatcataatactacatgtttctgtagcaatttatgaagtattttctcatgaattctctcatttaagcctcaaaattaatctgaaaaaggtataattattccaattataccaatggcaaaattgaggcaaggctcagagaactgctgacttgcccaaggtcacacagctagtagggtccaaggacttgaaactagggtaaaagactccaagtctaaagtctttcccacataactttttttttttacgatctcggctcactgcaacctccgcctctcgggttcaaatgatactcctgcctcagcctcctgagtagctgggattacaggcatgcgccaccacgcctggctaattttgtatttttagtagagacggggtttcaccatgttggtcaggctggtctccaaatcctgacctcagatgatcccgctagcctcggcctcccaaagtgcacataacttttacagtccttttatttattcccattccattcaaattcatttccagcttatttaatactagaggaatttactctaaaaatcttaaacagaactgcattgactaataagaatttgtcaggaaaattcaagaatatttatcacttcaataatttaagatgaagcctaagaacataaacaatactatatcaatatatcaaattactgcaagactccaatctatagctgcatattagcttccagttaacaaacagataaatatttaaaacattccaaataccctttttgatgactaatatttctgttcataaacaggttccttatttactgcttattaaataagttttcttttactgtgatcacagttgacgagctttagaaaccccaaataacaagggattccagaagtcaggtgcttacagtgcatctgcagtactcatttttatggtcagtcaagctcctctgggaccaggttcttctccaagaacccctgggtactgtactcaaatgtcagaaaatgcactcgattccaaattctagaaattctaaaaacaaaattacatcataaaacacattttttaaaagcctgcacgtatttaaccaacatgatttacgctgcacaaggtacagacgtcttaattagactggcaaatttagaagtctcattttcatctaagcacccactatacttttttttaatgaactgagcatagaaaataatatatctccagtgtacatcctgtttcctagtttcaccaagatgattaaactcctattttcctttcccgtgctcttatgggaaattaatgtatgctaaataaatgggcagaaagggtcacatacggttctggttcaacacacaaacaactctagatgtgcagatatttttaagttgcacgcataggttactctggagaacagaggcaatcctgtatttcctattcaaaccccacgattttttttaaaggacctggctagtttggaaaagggaacgggcccgcgtttaaagcgagtgtaaataaacaaacacgtggtctgcggaggaacacctttaagcaccagcaggatgactgaaaatagccaggtttggggaagagtggctgccaccgcgagacaacccccaccacatctggagctccagattccgtcgggattccaagcctcaacacgccctcaccgcagggaacctcggaatcagaacgctgagcccgccaggacccctcccctgcccactcggcccgctcttcccgaggttccagttaactctgggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgt

SEQ ID NO: 1870 - DNA, 76574 bp, Homo sapiens; identical to SEQ ID NO: 1869

SEQ ID NO: 1871 - DNA, 14944 bp, Homo sapiens
gtctatcagcgatttcatcttcaggcctggactacaccactcaccctcccagtgtgcttgagaaacaaactgcacccactgaactccgcagctagcatccaaatcagcccttgagatttgaggccttggagactcaggtaaggaatcaatttgctttctttaaatgacttaaaggaggtgatggataaggtatagaatggttttgaagactggaggttcttgatcttaattctagagtttccctagtcagacttcctaatagttctatgacttaaggaggggtgacgatatcaaggcttgctgcccactcactcctctaatcagtctccctctcaacaattaccctatgcagtcaactgtgaatcattccacaaaagtagtagattgcagcatatatattaaatcatggtttctaaaccattgggttcaaactggagctctaccactaacaaacaatataaccttgggcaaattactaaacctctaaagcctcagcttcctcatctataaaatgggggcaatggtacccattacattaggaaaattggaactaaaatcctgaatcccttaggacttcccaataccaaatgagaaaataatcagtcataggcataatgaaaaaaactccatttgtcttcctgtaaatgcttttgtctacattaaatgtaaatatacctagaagtataggtggctttacaggctaacattttctggaggggatttgtggacaccaagttgagcatgaaatcctgcctcaaatctatcacatgggaaaccaagagtaagagggggcgctgcagatgtgggggagctctaatgaaggaaaacaaggattaattttaatcatgccattactgttttctgaatccagtatataagtgattccctttccctgtttcccataaaatggcttaatctcactgagaatccggtggaaagaaatgtttaatccagcattgtgagcatttttgtgtgtgtgttttgtttgtttgttcattttttagtggagacaaggtttctccatgttggccaggctggtctcgagctcccgacctcaggggatccacctgcctcggcttcccaaagtgctgggattacaggtgtgagccactgcacctggccattgtgagcacttgttaagcttccctgaggaagtagctgagtttgatgttcagcttaatgtaactgagctcatagtacatagaaaacaggttccctatgcaagtctagtaggatacaggattctccgaagaaagtagttgatgtctagtaaggaaagcaaagagctaggagctctgaagaattccttgcaatcaggcaaggagagcaggaacgccctcaggtgatgtgcatatctaatgcagagtttgattgaaagtaaagagggagggagaaggaacacttcaaagttgagaagattcaggaaagaaggtagaggacatgtatagaccagtggctctggtggcggtagtgggatatgagcttgggaagtcatacagggctgaattccaaaggccttgaggggttagatgaagggtttctccagcaggtaatgacaggccagcaaaggagttcaggctcaggaagagcatcactcaaaacagtgatcgggagcttgatgtagcagccttgtggacaatggattagaaaagagaaagactgaaggcagaaaagcatgaatggaaatgagaaactcacaggtgactctggatatagaaaaaagacccacatgcaaaatgtattgcagaggtagaaatggcatgacttggccactgactgaccaacagccaagatgaagatggactgagagatgatggagctaaagtgaaatgtggtcccaactatctaagcctgggtggcaggagaaacaaataaaacaatctgagacacgaggcctgagaaaagaccactgacttcacagcacagtcctcaaagaccagtttcagtccactgactggcggaaactagttgccaagcattgagaagtgagtgggtggagaggaggtgggggaagagagtgggtagcaaagctttgaagcagctgcggtgaagaaaaagtgagcctgggcagtgggcaaggacattgctagattaaaagaagaggactttgggattcagggacactgaagtacattttagtcataaaaggagtatttagcaccttaacaaatgcaacttatctcatattctcaaaatgatactttgaaatggggaaggtaactattaccttaaacttacagagagaccacaagaggagcaagcaagagagctgggactaactctgtctgctacatattgccagaaattgggagactgaaggtgcaaagaagaaataatttcttggaagggctaacagcttggttggactgagatgggctgaaaagcacagagggaagggaagtaagagcactcttcctcggagataggtgcacaggaggccagaagggataaaaatgcaaaactattttgagtggaagagaatgaagatgaggtaacaacagtgaggcagtttttaaacttctcagtacatgatggtacgagtggacttaaaagtctattcaaaccaaaacccataaaggctgtgagatcttattcagtggatggacatgaaaacaggggtgcctttaaaaataaaaaaatatttgcaggagttagtgtgagtaattaaatgcggtactgagtgatcacctgagtctctattttaacattcatgctgatttggacaccagcaaatgtaaaatcttattgttatcatattgcggctaatgtggtccataacccctactaatctaccaactagtctttgagcataactgtgcattgggcactaagtcattgtgaacaatttattttaatgataaggcaaaattgcgagaatctccaatctccgtaggcgagttttatgtatttatgaattctcatggaacgaaagcttttcattacagtcagcccacaatgccataaatcgattaatatatttacctctcatatatgagacagatatatatataatcagatatatatatgaaagatagtttccataagaaataaaaaaacagagaaagcactcatgtgtttctttataaactactattttatacaaatatttgtttaaggtttgtagaagtatagttgccaccatgagataccattttaacagagaaatatcacacacacacacacacagccctcatggtcattattgccattagttacaacaggcatagcccaagtagaattggcttacaaaaaagtttatctcgccaataatacagacacagctttaatcaagcagttgatgaataaaatgaaattaaaacaatggcagtccaatcatctccttcagttcaaacaattgatgacctttgcattttaagttatcttcactaaagttacccctctggggcggagtgtagtgactcccagctcattccatacttgccataggaccttgggaaaaataacctctctcaacctccatttcttcatctgcagaaagtagtcaaaatgcctacttacgaaggtgttgagtgagttggcaataccatatacaatatctctagtatatagtaggtgctcagtaaacaactataattatctggactcacctatggtacagcagaaaaagcatcaacatcagagccatggtgagtgccttctagcttggctctgttgctaactgtgaggtctttactaaggcaaattctatacccagactgcagcttcctcatttgtgaaatgaacagaatggtttctgaggtttggactagctctagaaatcctacctagtgaccagaatcagtccgcaaactctttagtgggctatattaaaatatctgtttttgttagaggtcttgtagagtggcttgttgtacaaagcagatccccaggaccatgtggcatctggctatctagggcaggggcaaaatcaagtgagaaacaaccaaagtttcttctctctttcctctagcccatgcgccagacagataatacttttcaactgatttatagtcattcacatagtgcatatattggaaggagaaaagaggggtcataagggaaaggctgaattcctatttctcacaggagacaaagcagcctggtaccctggatgcctaatttgagagatccaagtcttcattttaaatctttacaggctgggcatggtggctcacagctgttatcctagcactttgggaggtggaggggggcagattgcttgagtccaggagttcaagaccagcctgggcaacatggcaagaccccatctctaaaaaaaatataaaaattagctgagtatggtggtggttgcccgtggtcccagctactccagtggctgaggcagaaggatcacctgagcccaggaggtagaggctgcagtgagctgtgatcatgacactgcactgcagcctgggcgacagagcgaggccctgtcatgaaaacaaacaaacaaacaaaaaatatttactaattatgtaacttggcacaagtaacctagcttctccgtgcccttgtttcctcttctataaaacacaggtgatgattcaccccttgcctgttctataaggctcagatgagatgccatgtgtcaaatttacttccagccctaaagtaggtataaatgtgacagtagtcagctgcctgttttacagcacacctgcagctactcagctctgattgacttcagtaagatatacttcaggctgtggtctaatggctgggatgtggcaccggcttcagtaagatatgtgacctggatagacagtcttgatttccaagacatcttacatgacttacaagcaataaagacaagagcaaagatgtgtccccaaaagagggattttcagattccaggaaagacccagtggagtccgcataagtggttaacatgaacaagtgaatgctaaggaaacccaagatgaagattgaacagaatcttaaaatgtctgagctggaaagggccgtattaattgccttctcacttcagaaatgaataaatcatgaaaactgataaatagcatttactacactctccctttgtcctaggcacaattacatatgttaacttatttatgtcttacatctcagagaggggtactgttctaactttacagaaggataaaatcgaaactaatgctcagcaaagtacaaagaacaagaatagcaacaaaaataactatttattccaacatgggttctttgcatacatttatttcttcaataatatttattaagaagtaactaaatccaaaaattattttagatcctgaacaagagagaacaaaatctctactttgatggaacttccattctgtggggaagagactgacaataagcaattaaataaataaggtaatttcctacagtgatcaatgccgtaaagcaattaagataggattttgtaaaagacagcaaataggagtacatgttatagattgagggttcaaggtaggctcctctaggagctgacatttgagctacacctgaacaaaaagacactagccatgcacagaccatgagcccagttaagtgttatagcagcccacgagataagaattattattatttcaattttacagttgaacctgaggcccagagaatttaaagaacttgcccaacatctcagaacaaatggaggaatcactattgaaacctaggcaatctgactcaggaggccacagtcttatatactgcattagaaagccttagagagccttttctttttctttgagaccgagtctcactctgttacccaggctggaatgcagtggcatgatctcagctcactgcaacctctgcctcctgggttcaagcaattctcctgccttagcctcccgagtagctgggattacaggtgcacaccaacatgcctggctaatttttgtatttgtagtagagatggggttttgccacgttagccagcccggtctcaaactcctgacctcaggtgatctgcccatcttggcctcccaaagtgcttggattacaggcatgagccaccgtgcccgacctagagagccttcttgatgtgacttgcacaaggtggcagagttagagacagagagaggcctggaatcgacccctcctgcttctacagatagtccttaccatactctgcaatgttgcctctggcccatcataatgcacaaaggcagataagcaaaaggacaaggacaagtccattgaaaatacatttttcaatattaaagcaaaagaaaagcatccaggaataagaaacaaagaggacatgcagtcatatatgcaaggtgtcctctacaaagataaagaatgccccaaacccagttgtcaagatcactggcagggactcctgggcccacatgctcttcctaaacaacccctccatctcctttctcagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggtaagtcagttgccttccatcccatgtcgtagggattctctggctgacagaagctgatgcggtataggccacatacagaattcaatccaatttgaagaattgggatccaacctgatgtcttctttatgtctaacacagtgggccaaatcaggggtgcatcagagaagttatcacttagatcacctctgggtgatcttatgtcaccttttggttttggggcttgtatatgcaggggtcccccatcccagtccattgccagaatcccaggcatacctgctccctggaaatgccccatgtggttgaggaaacagattcgaacaagaaaaagacaaaattcttggcacctccactgcttcctttaggcattcctcacagctccaagtcaggagccagagcttccaaccttgtctttgcctgctagcagtgatgatttcagctcatccactgctgcctctgttctctccccaggctgtccagattatgaatgggctcttccacattgccctggggggtcttctgatgatcccagcagggatctatgcacccatctgtgtgactgtgtggtaccctctctggggaggcattatggtgagtaaaagaatagcagccatttgggaaatggtgcagacaaaaatgttaaaaggctccacagggatatgccagattatttctgtgttgagggaaatatatgagtaggaaatattattgggttaaagtaattaagaagacaggttgaccaaattgagtataaatcccatggttgagagtcagtggtcctgtttcatgtgaattcagagaaaggggccctgcatggatctcacagggactgtccaaagcaagaactctccaaagtcagttctggtggggagggtggccctagacatttagactagatagcaagatgttttggaaagcaagaggcagcaggaacatccacttccatctaccccttcttgcttacaattctgtttggttactatggtacctggtgaaacctgtcccatcacaagtcagtctcattttgcttatcgacagagcagcactcttttggctgttttacgtacatgttttccaaatctgtaaccctgtctgggtgtggcacataggacagtgatgtttatttccccgtgatacttttcatagttgccactataaaagataagtccaggattaaaattttccaaacaagtagagatgggttagaacaagagtttcctccattctacagcctgaatgtgagaaaaggaagatgagcaatagtcatcatcacttcctgtaacagccaatgttttcatggagtgcctgtgccattcaggtcaagtatttccttctgcatcagttcactcttcagagggcatcagagtcatttatgtcactgtgaaccccaaagggcagttccacaagttaaaaacaaagaaaaactagaaataaaacttttaaatttatggtatgagtattaattgatgaggaaatttgagttctgtctctttggtcttactatattcctagtcacagatccccagatgattgagtaaaaggcatgaatttagtgtcactgagcctgaataaaggaggaatatgacagctgaaaaatgaatacaactgataaaaatgggtggatggttgtgtgaaagttgctgaaagtgtaggcttctttctgaccagttatcaatgttaaaaagtgatctccctctctcctctatctcctgtcttgcccaccccctctccatctcccccacctctcttttttacagtatattatttccggatcactcctggcagcaacggagaaaaactccaggaagtgtttggcaagtaaccatatgtccttctttcccacatgtcagagaagtacctatttttttcggttaaaaactgagacccttaaaaagccaaggtatcacagcctctcagccctaaaaagcaaagaccctccacaatgttattgtgattttatttatgaaaaacttagaagcgaggtctatctgaagtatgttcatgggaacagaactaaaagcagatccatgaaaaccatacctacagtcttaagaacgttaaatgctgtgtgaaaataatagacctttctgaaagccctatcatttctcccagatcaccatttaggaaaattatctgatcaatgtcatgattgattcaaattctagctaagccattttttggccgtaacattgaacaagtcagtttacctctatgttcctgagttttcacctagaaaggaagggtaacagtccttgctaccatgtgacgtccaatggagatgaaaggcagtagagtgtgtgatggtgcttcacaggctataaagtactacactgtggtcttgcccataaaacccctagggactcatctagatccagaggaaactggcctgcagagctgctgatgctgtatggatgaaaagagtttagcagcaagttcgctcccaaaaaattcctcccccaacactgttactaaactgtgtcactttcataatcaatgagggaatgggtggattgagatggttcctgtcttaaagtggcctgacacactcagtttggggggaaaactttttatgaacatcaaattattctctagatacagccagatttactgacttgccatgtgtaggtcatagagccaggaatgaaatatgcgcagcataaaataataatcaataatcccatatcattatggtacttgttatttatattttcctgtttcaaccttttatcatccctgcaaggtagaacattcacactgatattttcttacctatgctacccaaagacatcagccctaattgtattttggaagatagctgactggggctgattgcaacctatgtcagcaggaatagatgttgttactgttgttgcttctgctttttttatttccatttatttgatagtacagatctagagggttctatctgaaccttcccaacctatacttcataataccatcccactaaagtgtgatacaagaaacttcttcactctcttccctctacctatttatgaaggcagataataaactggataatatttatcttcacttattcaacaaacatttattgagtgcctactaggatggtggcagtggcagtgaaggaaatgcaaggatacaagatatagaatcaagggttactcttagaatttttgctttataaaacagatggatggtgaatgagatagggaagactgagaaaagaacaggatagagacatgattttattttatagtgacaaagaggctaaaaacaactgagagaacttcagtatatttagttgtagttgctttgtgagtcagggcagttgcatttggaattccctcccagattatgttttccaaagggaaatcaaacccaattaataaatctgtgtctccatttcaggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttggtaagtgttcttggtaagtgtgagattggatttctctccagggaggaaggatgacttgtttattatgagcatgaactctggatccagaccacctgagtttgctagttactgtctgtgtggctttgggaaagaattttaaccacactgtgcctcaatttcttcaactgtaaaatggggatggtaacactatttatctaatagggttgttctgaggaataaataagttaatatatacaaagcatttagaacagtgtttggtacacagaagtgctatataagcattggctttaacattaattattctcaacatcattaatggcattaatatttaccattatattaactaagatgagcatagaagaaattcctaagatgttatgaatatcttttgcccaaggacttttaaatgtagagtttgaaagagataaaaaaaaatgcatctcccaaggatgaagaggtctcctaggcatgatgccacaccaactaaggctgaatacaatttaatttgagactcattacttattctttcctatacagaattgattcttcaactgattattcataccttactttctatcagcaatacacattaaccatctgttgtgtgccaaaagttgtgttaagagttagggttataaagatgctgtctcctgtactagcagttctcacagctattcattacttgtctaaagaattgatctcttaatcgttcaattatagtcaacaataacttactgaacaccaacaatgttctttgtgccattattacattttcaccttcattcttctgttgtttttcagggcattttgtcagtgatgctgatctttgccttcttccaggaacttgtaatagctggcatcgttgagaatgaatggaaaagaacgtgctccagacccaaatctgtaagtagtagcccctctggccaaaacctccctctagaaaatccacatccacaaaggatcatttatggagaatgtaatctgatgagttgttgaaactaggagcttgatttaaaaaaaaaaattggtcttggcatatttctagaaagcaaataatatgatgtcttgaaatttgaaataagtctgtagttagagcctacagttctatattctgtgcgtcttttttttttttttttttgagacagagtctcactttgttgcccaggctagagtgcaatggcgcgatcttggcccagtgcaacctctgcctccgggttcaggcgattctcctgcctcaccctcccgagtagctgggattacaggcacccgccatcatgcctggccaatttttgtatttttgtagagacgggggttcaccatgttggccaggccagtcttgaactcccgacctcaggtgatcctcccacctcagcctccgaaagtgctgggattgcaggcgtgagccaccatgccccacctctgtgcatcttcttattaaccttccctgctgcttgacttcaggcttccatcctgatttcatgattccatatacagtgtgtaaaagcaagatggttgaaggttgaaggctaagtcactagttctttggtttcatttttcagtattcccctcttccctccttttcacctaattcctcttccaaaacaacaggttaaagggctccacaaatgggaaataaaaacagaccaataatagatatattactaactgcttcagaaccagactgttagatttagaatttagaaatcatcgctaattacttcattttgcatttaaagaaaaatagtatcaaagagagaaaattattctcccagagttatattcactaaaggcaaatcagaacgaaaatctaaactcctctattactgcaatgttcttttcccaataccacgtggtcattccaggcactgtggtcaatgtctgctgcccttgaagatttattcagacttgagttttaataaatgacttgataaggatataagcacctgcaaaaaaattttggcatttaaaggcatataataaatgacataagtagcataaaaaccaggaggtatttgataaatgtttgtggagattgttgacaaaggtgtcagtggtaaaagtaaagaatggtttgtttaattttctgttttagaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgca

SEQ ID NO: 1872 - DNA, 14944 bp, Homo sapiens; identical to SEQ ID NO: 1871
